United States Patent 7,183,083 (NUCLEIC ACID AND AMINO ACID SEQUENCES RELATING TO STAPHYLOCOCCUS EPIDERMIDIS FOR DIAGNOSTICS AND THERAPEUTICS) - sequence listing, part 2

SEQ ID NO: 1495 - DNA, 2472 bp, Staphylococcus epidermidis
aataggaggtatttatacatgttatttggtagattgacagagcgtgcacaacgtgtgttggcacatgcacaagaggaagcaattcgtttgaaccattctaatattggaacagaacatcttttgcttggtttaatgaaagagccagaaggtatagcagcaaaggtattagaaagttttaatattactgaagataaagtcatcgaagaagttgaaaaacttatcggtcacggtcaagagcaaatgggcacactacattatacaccgagagcaaaaaaagtaattgaactgtctatggatgaagctcgaaagctacatcataactttgtaggaacagagcatatactattaggtttaattagagaaaatgaaggtgttgcagcacgtgtatttgcaaacctagatttaaatattactaaagcacgtgcccaagttgtaaaagctttaggaagtccagaaatgagtaataaaaatgcgcaagctaataagtctaataacacgcctactttagatggattagctagagatttaactgttattgctaaagatggaacgttagatccagtcgtaggacgagataaagaaattactcgtgtaattgaagttttaagtcgtcgtactaaaaataatcctgtgctaattggtgaacccggtgttggtaaaacagcaattgctgaagggcttgcgcaagcaattgttaaaaatgaagtaccagaaactttaaaagacaaacgtgtaatgtcattagatatgggtacagtcgtagctggcactaaatatcgtggtgaatttgaagaaagattgaaaaaagttatggaggaaatccatcaagctggtaatgttattctatttatcgatgaacttcatactttagttggcgctggtggcgcagaaggagcaattgatgcatctaatattttaaaacctgctttagctcgtggagaattgcaatgtataggtgccacaacattagatgaatatcgtaaaaatatagaaaaagacgctgcattagaacgtcgttttcaaccaattcaagtggatgaacctacagttgaagacacgattgaaatcttaaaaggattacgtgaccgttatgaggctcatcacagaattaatatctcagatgaagctttagaagcggctgctaaattgagtgatcgctatgtttcagatcgtttcttgccagataaagccattgacttaattgatgaggcaagttcaaaagttagacttaaaagtcatacaacgccaagtaatttaaaagagattgaacaagaaattgataaagtaaaaaatgaaaaagatgctgcagttcatgctcaagaatttgaaaatgccgctaatttaagagataagcaatctaaacttgaaaagcaatatgaagatgctaaaaatgaatggaaaaatgcacaaggtggtttagatactgccttatctgaagaaaatatcgctgaagtaatagctggttggacaggtattcctttaactaaaattaatgaaactgaatcagatcgtttattgaatcttgaagatacacttcataaacgtgtcattggacaaaacgatgctgtcaattcaattagtaaagctgttagaagagctcgtgctggtcttaaagatccaaaacgtccaatcggtagttttattttcttaggacctacaggtgtgggtaaaactgaattggctcgtgctttagctgaatctatgtttggtgaagacgatgcaatgattcgcgtagatatgagtgaatttatggagaaacatgctgtcagtcgattagttggtgcacctccaggatatgtaggacatgatgacggcggtcaattgactgaaaaagttagacgtaaaccatactctgtgattttatttgatgaaattgagaaagcacatcctgacgtatttaatattcttctacaagttttagatgatggtcatttaacagatactaaaggtcgtactgtggacttccgtaatactgtgattattatgacttctaatgtgggagctcaagaattacaggaccaacgctttgctggttttggaggtgcttcagaaggtagtgactacgaaactgtcagaaaaacaatgatgaaagaattaaaaaattcattccgaccagaattcttaaaccgtgttgatgacattattgtcttccacaaacttacaaaagatgaattaaaagaaattgttacaatgatggtaaataaacttactcaccgtctttcagagcaaaatattaatattgttgttactgataaagcgaaagaaaaaattgcagaagaaggatatgatcctgaatatggtgctagaccactcattagagcaattcaaaaaacggttgaagataatttaagcgaattgattttagatggaaataaaattgaaggtaaagaagtaacaattgatcatgatggtaaagaatttaagtatgatattcatgaaattacagctaaaaaagaaacaacagaatcataa

SEQ ID NO: 1496 - DNA, 177 bp, Staphylococcus epidermidis
atgaaatatctattaagttacatgtcgatgttcatcgcaatgatcatcacattaattttaggaggtggtttttttacggtaatagcattttcaatgttaacgcttatctttagcacattcttttgggagaagtggattgagataacaaaaaagactgaaacttgcgccaacaagtaa

SEQ ID NO: 1497 - DNA, 516 bp, Staphylococcus epidermidis
tggttttttcaaacaaaaatcacgtcaattctggacgcaaatgaacatagcaccgtctatggcaaaagaggaagagaaagagtctacgaagaacggtatcgagttcatgaagaacaactacaaagaaatcatgggcgagctaccttactagattattcagaaatacggcagataaccagtcaatacataggctatcttccttatgatgaattaatgagtttgacgcctaatgaatggaaagactgggttatcggtcgtagattggcgttacttgatgaacaagaaactttattgtttggtgctcaagctaacggccttgtacaagctggcaagtcgttaaaacgactacaaaaacagttagagcgtgcaagatacgaagttcgcgggcaatctgatgagtacgaacgtatgaaaaaacgtaagctagcacaaaacaaacgtaatagagaagctcaaaaacaaggtacacgtcgttttatgaattcattacgtaatactagtcaaagaggaggttag

SEQ ID NO: 1498 - DNA, 465 bp, Staphylococcus epidermidis
gagtgcactcatatgttttggatatttaattttatatttagctttcttgcttcactctttttctgtgtcatatttgatgcccctaggaagttgtattttgcttgtggctttgtcggcgcttgtggatggatggtttatactgtattatttaacggctttgaactccatacgatttactcaagctttttcggtagtttagcgttaggtttacttagtcattatatggcccgtcgaaaaaaagagcctgtaattatttttatggttacaggtattatacctctggttccaggaggacttgcttatgatgccactaaaaatttagtgttattacactttggaaaggcgattaacacaatgcttgaagtgacattaatagcaggtgctattgctttaggtttattatttgctgatcaaatttctaaaatcgttatttcaggttttgctcgtaccagaaaaagattgtaa

SEQ ID NO: 1499 - DNA, 126 bp, Staphylococcus epidermidis
atctcgactcataaaaccgatgttttttatgtattattaaaagaaaaaggacgtagacgtgcgaatcgactcacacatctacgtcttactcaatttaaaaactttattttccgtattgctctataa

SEQ ID NO: 1500 - DNA, 489 bp, Staphylococcus epidermidis
gggagaagtcacatgtatagtgtcagacaagcaactgaaaaagatgttgtagcgataagagatgttgcgacaaaagcttggtataacacatatttaaatatttatgctgcttcaacagttaatgaactgttggccgcttcatataatgaaacgcatttaaaaaagagactaaatgagcaattatttttagtggcagaagaagatagtgagattgttggttttgcaaatttcatttatggtgaagagctttatttatctgcacactatgttagacctgaatctcaacatagaggttatggaactcgtttgctagaagcggggttgaaaaggtttaaagaccagtatgaaacagtttatttagaagttgataacaataatagtaatggcatcgaatattatcaaaatcatggattcgagattattcgctcatatcaacctgaaatgtatggtgaaatcatggatttagctttaatgaagaaatcattttaa

SEQ ID NO: 1501 - DNA, 150 bp, Staphylococcus epidermidis
gttaagtaccatgttttcacctccgttcgttctcttttgagaactgtatataacttaacatttttcgttcccgttagtcaacacttttcactgcaaaaaattcaaaaagattttttctacctatatattgtattcatttgggaacgatga

SEQ ID NO: 1502 - DNA, 393 bp, Staphylococcus epidermidis
tacgtaaaccaaggaaaaagcaaaacgaaacaatcagattcaccagctttaaacagaggtttcaatagtaaaaagaaacaatttactaacttaaactcacctcaaaaacgtggtgtatgtactcgtgtaggtacaatgacacctaaaaaacctaactctgcgttacgtaaatatgcacgtgtgcgtttatcaaataacattgaagttaacgcatacattcctggtatcggacacaacttacaagaacacagtgttgtacttgttcgtggtggacgagtgaaagacttacctggtgtgcgttaccatatcgtacgtggtgcacttgatacttcaggtgttgatggacgtagacaaggacgttcattatacggaactaaaaaaccaaaaaattaa

SEQ ID NO: 1503 - DNA, 174 bp, Staphylococcus epidermidis
cacgaacgtctccccctcagtctaatcaaattaatttcaacacgtttaaatcactatgcggaatatcatcggtatcataagtttaaaaatatgaaaagagcacctctaacatttgttgctagaggcgctctcgcacggttccactcttcatttaatagcaatactcatatttga

SEQ ID NO: 1504 - DNA, 939 bp, Staphylococcus epidermidis
ttgatattacatgatgttgaggtatacaaaaataaagaacgtttgcgtattagtaacaatcgctttactggtactgcgttgagagttgtttcttacgatgttaaaggtgcaggctatgaccgaaagtttgatgaaattgatcgtgttaacggtagatttcataatgctactaaagaagaaaagaaaagtatatctatgacggttaggtacgatgtagaaaagatagcttacgcttctcatttaaaagcgaacatacaagctatgctaagaggtcatttttatcttagagaattagcaacgtccgaaagtgaagttaaattcgagaatatattcgaacctaaggaacaatcttttgaactagaatatgttgacggtaggcagatacttgttggcttagttaatgaagtgtcattcgatactactaaaacgtcaggtgaattcacactagatttcgaaacgattgaattaccatactttgagagtattgggtatagtacagatttagaaaaagagagtggtaatttgaataaatggggtattccagacaaaaacccgttcaacacatctcataaagaacgtagatacacattctatgatactaaagtaggcgatgtatattacggtggtacagctgaaattaaccaattcaaccaagatagtgttgtagaaatgacacttggagaaaatgtcagtaaaaatgatagcgatggttttaacttctatatgacacatagtgacattatgaaaataagtggattagaattgagagccggtgatgttatcaaatttgacggcattcatgtatatcgtaataacttacgcattgatgattacaataagacgaaacaacaacctgtgttaatgcctggttggaatactttccatactactaagaaacttcaaaaaatcacgtttaaacacaaaagatattacttgtaa

SEQ ID NO: 1505 - DNA, 834 bp, Staphylococcus epidermidis
catatggcacaaggaacaacaactaaaagtacacaaatcgttccagaagtattaaaacctatgatgcaagcagaattagataagaaattgagatttgcacaatttgcagacattgacagtacattagtaggacaaccaggcgacactttaactttccctgcatttgtttacagtggtgacgctacagtagtacctgaaggacaaaaaattcctgtagacaaaattgaaactaacagacgtgaagctaaaatccataaaatcggtaaaggtactgatattactgacgaagctttattgtctggttatggtgatcctcaaggcgaagcagtacgtcaacatggattagctattgctaacaaagtagataatgacgtattagaagctttacgaggtactaaattaactgtaagtgcagatattggcacattagcaggtttagaagctgctatcgatacattcgatgacgaagatttagaaccaatggtattattcattaaccctaaagacgctggtaagttacgctctagtgcttctgcaaacttcactcgtgcaaccgaattaggcgacaacattatcgttaaaggtgcatttggcgaagctttaggagctgttattgtacgttctaagaaattagatgagggcgaagctattttagctaaacgtggtgcagttaaacttatcactaaacgtgatttcttcctagaaactgaccgtgatccttcaactaaaacaactgctctatacagtgataaacactatgtagcatacttatatgacgaatctaaagcagttaaggtaactaaaggcgcaggaactacagactcaggtgcataa

SEQ ID NO: 1506 - DNA, 129 bp, Staphylococcus epidermidis
tataaaagacaaaaagaaaacggcaacacatatgatgacaccattttcgatttctatttacacttaattaatttatccattttacgtaaaagtacacacttattgaacataaatttttacattttataa

SEQ ID NO: 1507 - DNA, 138 bp, Staphylococcus epidermidis
caagaaagacaaaaaaagctatattacaaactaattaaacataagaagtatcactgtgcttctatatatggtgatataaaagacgatactgatgaaaatggtaatgaatataaaattcatatttgtaagattcaataa

SEQ ID NO: 1508 - DNA, 1221 bp, Staphylococcus epidermidis
agaaatatgcatattgtgattgggatattaggaatcattttctttttagcactcgcagttttatttagttcagacagaaaaaatattcgctggcgatatgttggattgctattagtaattcaactaatatttgcatttatattacttaaaactaatttgggaatttcagttattgggagtatttcagatggttttaattatttattagctaaagcagcggtcggtgtcaattttgtatttggtggctttaaatttattgatcctaaacaaccaccattcttctttagcgttttgttacctattgtttttatttcagcattgattggtatattacaatatacacgaatacttccactaattattaacttactgggatttttaatttcaaaaattaatggaatgggccgtttagaatcttacaatgcggtcgcggcagcaattctaggacaatctgaagtctttatctcattaaaaaaacaattaccttacatacctaaacaacgcttatatacattaactgcttcagcgatgtcaacggtatcagcatcaattataggcgcttattttacacttattgaaccaaaatatgttgttactgcagtagtgcttaacttgtttggtggttttatcattgcatctatcattaatccttataaagtcaatgaggaagacgacaaattattaattgatgagaacgaaacaaaaaaacaatctttctttgaaatgcttggggagtatatactagatggatttaaagtagcagttattgtaggcgctatgctgataggttatattgcaattattgctttattaaatggaatggtgagtggaatcttaagctttatgtctggcggtgctattcaatggaacttccaaacgcttattggatttatttttgcacctttcgctttcctaactggaataccgtggcaagatgcagttcaatctggttcagtaatggctacaaaattactatctaatgaatttgtagcaatgcaagatttaggtaaagcgactggattatcggaacatgctaaaggaattacctctgtcttcttagtatcattcgcaaactttagttcaattggtattatttcaggagctattaaatcattgaatgatgaaaaaggtgacgttgttgctcgtttcggaataaaattattatttggtgcaacacttgtttcgtttatatcagcggctattgcaggattctttatctaa

SEQ ID NO: 1509 - DNA, 741 bp, Staphylococcus epidermidis
atttcaatgcaaatacaacctgaattctttgagaagttaaaaccccgttattctgataacggggtttttcaattaattaatacaagcatactaaatgcttttggattgaatgataaaattagaggtgaagaaatgagtcattattatgatgaacaacctgatgttaaaagtaacccaaaaagaattagttatcaaattaaaaatgtgcaactagaacttactactgatgctggagttttttcaaaagataatgtggattttggatcagacttactaattaaaacttttttgaaagaacatcctccaggcccaagtaaaaccatcgcggatgtaggatgtggatatggtcctatcggtttagcaataggaaaagcatctccacaccatcaaattacaatgttggatattaacaatagagctttggcgttggcagaaatgaataagacaaaaaatcaagtggataatgtaacgattatggaaagcgattgtttgtctgctgtcaatcatcagtgctttgattacattttaactaatccccctattagagctggtaaggacattgttcatcgaatctttgaacaagcgtttgacagactcaaaactacgggtgaactttatgtcgtcattcaaaaaaagcaaggtatgccttcagctaaaaagaaaatagaagaactatttggcaatgtagaaattatagctaagagtaaaggatattatattttgaaaagtataaaaggttga

SEQ ID NO: 1510 - DNA, 1803 bp, Staphylococcus epidermidis
atacaaacgcaatgttgggatttaccaaactacattttcaatagatattggcattttaaaacaacaggaaatgcgattgctatggcatggtatagatatcctaaaggcttcaaattctataggaacactagaaactttgttccgaaacctggtgacatggcagtttggggaaagggctcctttaataacggtgttgggcatactgctgttgtcataggtccatctaccaaaagttactttactagtgtggatcaaaattggattggtgcaaatagttatacaggctcacctggtgcgaaaattaaacatagttataacggtataagtgggttcgtcagacctccctaccacgcagaaactaagaaaccatcgaaaccaagtagtacaccgtccaaaccttctaatgacaacactcctaaaaacacaaaagaacaaacaaaacctataactaaagagattaccaaagtttcctatacatcattcgcatacgatttagacgatgatttggaatatatttatcattacatggttgaagggcaaaagttgatagggaaggtaaaaggtatatatatcaaagagagtacacatatgcgttctgttgaagaattgtatttacaacgtaataaatatgtgaatgaagatgaataccctcatgtatatattgaccgtgagcgtgtatggacacctagacctgattcagaagaagcaccagaacatccaggttggcttgttatggaagtttgcggaggacaaacggatagcaaacgccaattcatgctcaatcaaatcagagcgttaatctacggcgtttggttgttaagttggagtaaggtgaaactttctgaatcgtcaatcaaagcagatcctaacatatggcgttctatgaaagatttaatcaattacgacttaatcaaaaatggtattcctgatgaaagtaaatataaagaagtcgagaagaaaattatcggtttatatttgaaaagagataaattacttacagaaacaattactacaacaactacaaagacaaagataaaaattaaacctaaaacttcggtcgacaatccttcacagaacgataagtcgacaggtaaaacgacaaacagaacttcaaataaacctcgtgtagttgtagagaaaagtaaatatactttccaacaagcgcttaatgcacaaatggctcatggcatgcctcaaaaatcttatagttggggttggggtaatgcttctaggtcacaaacaagtaagtatatgaatcctaacactatatggaatagttcaactcaacgctatcaaatgctagatttaggaaaatatcaaggtatatcagtaagtaagttgaataagatacttaaaggtaaaggcactttatctggacaaggtaaagcttttgcagacggttgtaagaagtacaatgtaaatgaaatttacttaatcgctcacgctttcttagagagtggatatggccgtagtaactttgctagtggacgttatggtatctacaactactttggtattgcagcttacgacaacaaccctaacgcttctataggatacgctagacgtcaagggtggacgagtccacgtaatggtattataggtggcgctaagttcgttaggaaacaatactttaacaaaggtaaaaacacattatacagaatgcgttggaatcctagcaatccaggtcgtatgcaatatgctactgctatcgaatggtgtaatttccaagcatcaaccattagtaaattatacaaaacagttggtacaaaaggtatgtactacattcgagataaatatagataa

SEQ ID NO: 1511 - DNA, 543 bp, Staphylococcus epidermidis
cgaatggcgcagaataaatacattgcagcgttacaaattgctgacaaagatttagcgagcaagctaaaagaagaagatgctattctgttagctagtttagctgagggtggacacacaatcagcaatgacttagctgaaatgattacaggtggcaaaaaagactacggtcgtaactctgtagaagaagaaatcaagttaactgttgaccgtgtacctggcgacaaaggtcaagaagctttaaaagagtcagttaaaaacttcaaacagttacgtttatggatttgggaagttaaaaagcgtgatggtaagcatcatggtacttttgcttatgtaattatagaagaacaagaatggtcatttgatgatgaggatgacaaaatcgaaatcactgcaaaagttaaatttaacagtgctgacggttctgttgactcattaccaccagaatggcttaaccctagtgctgctgctcctacagttgaatttgaaggcatgggtgaatatacaggaacgtatgaagaacgtacacctagcgctggtgcataa

SEQ ID NO: 1512 - DNA, 675 bp, Staphylococcus epidermidis
tataactttaactatgaggtgaacatcatgaattttgatagttatatttttgattttgatggaacgctaattgatacaacaacatgtcacgtcaaagctacgcaaagcgcttttaaaagattaaatttagatgaacctacagaacaagctattttacatacatatcatttaaatttatataacaattttaaagcgctagcttcacatgaactgtctttttatcaaatagaaaaattaatagatgaatacaatcattgttttagcaacgatgaaatacatcaatcaaaagaatataccggaataagtgaagcattaaaatttttacataaccaaaagaaaaaaatatttgtagtgtctaataaagaaatactaacaactcaaaagtatttagattatctcggattaagccgttttataactgattcattaggtgtctgtattaaaaatgaagacaaacttctttgtgaaacgattcaaaatttgatacagaaacatcatttaatgataggtaaaaccgtgtatataggggacacagcacagaatatcaagagtgcgaatcaagctcatgtgcaaacatgcgctgtcacatggggagcacaatctgcacacgaattgttgcatgaaaatcctcattatattgttaatgatccagaagaatttttaacaattttataa

SEQ ID NO: 1513 - DNA, 411 bp, Staphylococcus epidermidis
gaggttattaatgtgatttggataagtttttcatcggtaataattgtgttagtactgtgtatttttgctatatataagtggattaaagcagagaaaagagttaatgagttacaggaagataaacatggattgcaattagataagttacatttagaaagagaggtatcttggttgaaaaataaggataataaaaacaacataggcaaatacgtggttgagttaaaaaaaggagtatatttagtgaaaaaatatataggtagttatggaaacacatgcataatcactgacaatgtatttgaagctttatcttacgacgatttatattcagctaaagaagatgcatgtagttttaacggacgtgtactagaacacaaacctaatttagaggtggtcaaacaatgtggggcgtaa

SEQ ID NO: 1514 - DNA, 1011 bp, Staphylococcus epidermidis
gagagaattaaggaggatattatggctgatttattatctgtattacaagacaaattatccgggaaaaatgtaaaaatagtattacctgaaggtgaagatgaacgagtgctcattgctgcgactcagctacaaaaaactgactatgtttcacctatcgttctaggaaacgaagataatattaaatctcttgcttctaaacacgctttagatttaactcaaattgaaatcatagatccagcaacgagtgaacttaaagatgagcttgtagatgcttttgttgaaagacgtaaaggtaaggcaactaaagaacaagcagttgaattattagataatgtaaattatttcggaacaatgcttgtgtatactggaaaggctgaaggtttagtgagtggtgctgcacattctactggagatacagtcagaccagcattacaaattatcaaaactaaacctggtgtatctagaacatctggtattttctttatgattaaaggcgacgaacaatatatttttggagattgtgcgattaatccagaattagatgctcaaggacttgctgaaattgcagtagagagtgctaaatcagcacaaagctttggaatggaccctaaagtagctatgttaagcttttctacaaaaggttctgctaaatcggatgatgttactaaagtgcaagaagcattgaagttagctcaagaaaaagctgaagcagatcaattagatcatgtagttattgatggagaattccaatttgacgctgctattgttcctagcgtagcagagaagaaagcacctggtgcaaaaattcaaggtgatgcaaatgtatttgttttccctagtctagaagcaggtaatattggttataagattgctcaacgtttaggtggatacgatgcagtaggaccagtcctacaaggattaaactctccagtcaatgatttatctcgtggttgctcaactgaagacgtttataacttatctattattacagctgctcaagctttacaataa

SEQ ID NO: 1515 - DNA, 162 bp, Staphylococcus epidermidis
ttgaaaactaactctaaccttgaatattttatagaaatacaatttgataatgctataatatattatagatttaaaaatattttgaggaatatgaggttaaaagatgaaaaagacaatgttcatcattgcagcaatgatattcggcatcgtatatttcgataa

SEQ ID NO: 1516 - DNA, 195 bp, Staphylococcus epidermidis
gtaatggctaacagagaagaaacaattgaagttgaagcaacaatcaaagtgagatgtaaatatccagtatgggtaaacaatcaaattactgcaagtgatgaaaaggaacgcattttagatttaatcagtaagaaccctgaaaaagagttaatgagcgaagattttgaactagttgaattaatagaggtggagtaa

SEQ ID NO: 1517 - DNA, 816 bp, Staphylococcus epidermidis
aatgaatataaattaattagatttagacagagaaacttttttaacgtatgttttttctgtctttttttatttacacaactaagaataaggagagataaaatgatttatgcgggtatattagcaggtggtattggttctagaatgggaaatgttccattacccaaacaatttttatcattacaaggaaaacctattattattcatacagtagaaaaatttttaatgtataaggactttgatgaaatcatcattgccacgcctcaaaagtggatcaattatatgctcgatttgctaaacaattatcaattagacgataagaaaataaaagtaatacaaggcggagacgaccgaaatcactctataatgaatattatagaaagcattgagcaacataaaaaattaaatgatgaagatataatcgttacccatgatgcagttaggccatttctaacaaatcgaattattagagagaatgtggaatatgccagtcaatatggtgcagtagatacggttgttaatgctgttgatactatcatttcttcaaatgatgcacaatttatttctgggattccaataagaagtgagatgtatcaaggacagacgcctcaaacttttaaaataaaagagttaaaggatagctatttatcgttaactcaatctcaaaaggaaatattaactgacgcgtgtaaaatactcgtagaattgggtaagccagtaaaattagtcaaaggagagttatttaacataaaaataacaacaccatatgatttaaaagttgcgaattcaattattactggagctgttgataatgattaa

SEQ ID NO: 1518 - DNA, 294 bp, Staphylococcus epidermidis
cgtatgtataaagtaatcgaatatttcgaagacttacaagatgacaactacgagtataacgtaggaaaaacgttccctcgtaaaggtttaaatgtaagtgatgagcgattaactgaactatccacaaaagaaaaccgtcagaataagcctcttattgaacgtgtagagagcgataaagacttaaaaggtatgaaagtatctgagttaagagaactcgctaaagaacgtgaaatagagggcttttctagtatgaaaaaagatgaactcgttgaagcattaggaagtgttaagtaa

SEQ ID NO: 1519 - DNA, 1404 bp, Staphylococcus epidermidis
tgtaaacataattatataaagtgtttacaaatggtgatgaagatgaaaaaaataatggaatatttacagcattatattaatcaatacccgcatcgattagctttagtgtttgaagatcgacatctaacgtatggagaattaagtaaagaaatttatcaggctagtatgcgctataaagaagtaaaattaaacaaaaaagtaggtctaatggatgaacatcctgtaaataatattattaactattttgcggtacatcaaagaggtggaattccttgcatttttaatcatcaatggagtaatgaaaggatacatcaacttgtaaaaagttatgacatacaatggttaattaaagataatcatcttacctcaaatcatgataactcaatttataatgatgaggttatcccacgtaatgttatacatataggtttcacgtcaggaactacaggtttacccaaagcgttttatagaaatgaacattcttggatagtttcttttaaggaaaatgagaaattactccagcattgtgaagaaaccattgtagcaccgggtcctttatcacattcactttcattgtacgcatgtatttatgcattaagtactggaaaaacatttataggtcaaaaaaattttaatccactatctcttatgcgtcttattaatcaattgaacaaaacgacagcaatatttgtagtgccaacgatggtacaacaacttatttcaactcaacgacattgttcatcgattaaaagtattttgagtagtggtgctaaacttacattgcaacagtttcaacaaatcagaaatttatatccacaagcaaatttaatagaattttttgggacatctgaagcaagttttataagctacaattttaaccaatcatctcctgctaattctgttggtaaacttttccctcatgtcgagacacgattattaaatcaagatgatgatgcagtaggattattagccgttagaagtgaaatggtgtttagtggttatgttggacaaagcaatcaagagggggcatggattaaaacaggcgacttcgcttatattaaaaatcaacatttgtttttagtaggtagagagagtgatcgtattatagttggggggattaatgtatatccaacagctattgaaagcttaattatggatattgaaggcattgatgaggcccttgtcattggtataccacatgctaaatttggagaaatagcgatattgctttattcaggtaaagtacaattgaattaccgacaaattaaatcttttttaatgaaacatctttcaagacaagaagttccatcaaaattaaagaaaattgaccatatgatttatacagaatcaggaaagattgctagaaaagagatgaaaaataaatttattaatggagagttataa

SEQ ID NO: 1520 - DNA, 198 bp, Staphylococcus epidermidis
gaacattgtaattccgattgccacaattctcacaattcaaaggtactttcttcacaattattcacctttactcattataataccaatatactatacataagtattgtattaaatgtcaaacttatgcgccacgctataatttcctcaccatacagtatactatttgcatattattttcttattcaaaacttcttttaa

SEQ ID NO: 1521 - DNA, 123 bp, Staphylococcus epidermidis
cctataagtaataaagctaaaataatccatgaaattttaaataatcgtgtgtctcgtatagcatttttaggttcaaaaatacttgatatatcaaatgttttagggatggattttctaaagtaa

SEQ ID NO: 1522 - DNA, 489 bp, Staphylococcus epidermidis
tcgatgagtaaattatttgaattaaaagatagttaccaacaagtttacgaccttattgcagaacaagaagatgaacaaattttaaaagatacgctagcaagtattaatgatgctatcgaagataaagcagatggatatgtagcagttattaaatctttagaagcagataacaatgctatagatgaagaaataaaacgtttaagacaacgtaaaacttctaatcaaaacggcgtcaaacgtttaaaagaaagcttacaggaagttatggagcagacaggtaaagaaaagtttaaaactgcgcttaattcgtacagtatcgctaacaatccacctagcttagatgtcacagatgaaagtttgatacctaaacaatactacatcgaacagaaaccaaagttagacaaaaaagagttattgaaagctataaaagacggtttagaactcaaaggagtagaactaaaacaaagtagaagtttgagggtgagatag

SEQ ID NO: 1523 - DNA, 204 bp, Staphylococcus epidermidis
tttaaaatcaatcgactcaattcatcattattcattttcttaagttttggcaagcgaatgataaaaaagattaatcctattaccaaccaaattcctaaagcgatgtatgatggtatcgaaagtgctgcaggagaacctggaataagcaataaacataagaacacaaaggatacaatcgatcctataataccaaaaattttataa

SEQ ID NO: 1524 - DNA, 147 bp, Staphylococcus epidermidis
atatcctccaaagttctgcttgcatcaacctttaatatattaacattatttgttactagtagtcaacaacttatatttgcatttataaataaaatacaaagcacttcaaaatttcatagtaattattacaatatctataatttgtag

SEQ ID NO: 1525 - DNA, 426 bp, Staphylococcus epidermidis
aagagtgtcctattggctaaggttaaatacggtaattgggacttagttaaggaacttgaggagttcgaaaaagaaacgattagatgggctaaaaaaggtatagctaagacaacgacaattattcacaattcaatagttagcaacatgcctgttgacaccggttatcttagagaaagtgtttctatggactttaagaaaggtggattaacaggggttattaatattggtagtgaatacgcagtgtacgtcaactatggcacaggtatatacgtggttggtccaggtggtagtcgtgcaaagaatatcccgtggcgttataaagacgcagacggtcactggcacacaaccaaaggacaacatgcacaacctttttgggagcctgccattgacgaaggtagagcgtttttcaataagtatttttcataa

SEQ ID NO: 1526 - DNA, 954 bp, Staphylococcus epidermidis
atggcgaacaacaaagacaatccaaaaataaccaaccagaatgacatcgacaattacatcgacagacttgttaatcaagctaataaagaaatcgaaactctgtttgctaaacgtttgaaagaaatcaaacagattattgcaaatatgtatgaaaaatacgatagagatgaaccacaagtgacgtggactgaattcaataaatacaacaggctcaacaaagaacttaatcgtataggacaaatgttgtcacaagactatagagaggtcgctaaggctatcaaacagtcgcaacagaacatctatatagaaaagtacatgatgagcctatttttgtatgaagtagcaagtcaaacgtctatgaactttgatataccaaccacacaaacgatacagacagctatagaacaacctatcgagtttattaagctggtacctacattacagaaacatcgtgatgatacattaaagcgtattcgtatgcatatcacacaaggtattatgagtggcgagggctactctaagatagctaaagcgttaagagatgacttagggatggcaaaggcgcaatcagtaagagtagcacgtacagaaacaggacgtgcattgtcacaagcagggttagatagtgcaatggtagctaaagacaatggactcgatatgaagaaacgttggtattctactaaagatacacgcacacgtgatacacacagacacttagacggcacttcagtcgatatcgaagataactttcattctagtggttgtgtaggtcctgcacctaagttgtttgtaggtgtagctagtgcaaaagagaacatcaattgtcgttgtaagcttctttattacatagacgaagatgaattaccaacaacgatgagaactaaagaagatggcgctattccatttactacatatcgtgaatgggagaaagataaacggaaaggtggtgtttga

SEQ ID NO: 1527 - DNA, 180 bp, Staphylococcus epidermidis
ctgaagaacaagcaaatcaaaaattgggggaagcgtaatatggataaagtagtaatcgatttatataagaaaaaattatacactgacgaaactttcaaaaagtttgttagagttggttggattactccggaacaatttaaagaaactacaggtaaagattacgaaccacaagttaaatag

SEQ ID NO: 1528 - DNA, 243 bp, Staphylococcus epidermidis
aaggagttaaaaatgaattcgagagtaataactaaagaaaacaagaaagaaatagctcatagaatcaaacaaataagattacaaagaaattttgatataaacgaattcgctgaaatcttatatgtttctcctttctctataaaacaatgggaagaaggcaaaagaattcccaatatcaagaaaataaaattaatagcattcgttttcaagacaacacctgaatggctattgtacggggagtga

SEQ ID NO: 1529 - DNA, 336 bp, Staphylococcus epidermidis
aagagaataaataaaatcgagtcaacgcaatgcgttggctttttaatttatctaaaaggagatatgagtatgaaaacagatgtaggttcaattgtaagaacaatcgtatttattttagcttgggttaaccaatttttagctacgaaacatatttcacctattccggtagacgaagtgactatcagttctattattactggtgcaatttctttgtggacttggtggaaaaacaataatttctctcacgcagcacaaaaaggacaacaaaaattgcatgaagttaaagcaggtacagaaaacacaaatggtaaagcaccaattggaggtaatgattaa

SEQ ID NO: 1530 - DNA, 378 bp, Staphylococcus epidermidis
aggatggtaaagattaaaaagaaagttgaaatgacattaccagaattgattgagtgggcttggaagaatggtgttaaagaaaaagcgttttatagcaatattgacagaggttctgtgtattttgacatggtgcaaacagtgtcgatagagtattcaatcgttgtagatgaaactttcacagtagaagttgaagaagaagttacggaagaaacaaagataccagaaatgttggaaatatttgtaaatggtggtggagttaaacgggttgaaaaatctatcaatgaactaaaagatgattttagcaaagaattttggttgaaagatggagatacaatgacactcatctggaaagatggcgaattggtcggtgatgagtaa

SEQ ID NO: 1531 - DNA, 165 bp, Staphylococcus epidermidis
cctaaaccaaacaataatgttgcacctattacaatagacgctgtacctactgtgaattttctaattgcatatttattggatttatttgctataggtttctttttagttagtaaattatttttttttaatcataaaaactccttatctttgactatttcaatgtaa

SEQ ID NO: 1532 - DNA, 204 bp, Staphylococcus epidermidis
atttttacaaagataaaaatattacagatgttttggcagatattttacaggaggggtaaaaccatgaaaaattatgatttgattattattggttttggaaaagcaggtaaaacattagcggcacatgctgctagtcacggacaaaaggttgcagtggtagaacgatccacaaagatgtatggcggtacatgcattaatatttaa

SEQ ID NO: 1533 - DNA, 1386 bp, Staphylococcus epidermidis
ttaatgacaaataaaactagaagtcaagcgcatgcttatttagacaggttaaaaggttattggtgggatttcgacggtgtttatggcgcacaatgttttgatttagccaatcaatattggtactacgtaacaggtcatactttaagtggtatgtacgctaaagatataccttttgttaatgattttaacggatacgcgaatgttgtaaaaaattataactcttatattcctaaaaaaggtactttagttgtttttccttacgaatatggtaacggatgtggtcatgttgctattatagaaagtgctactcaaaattatttctatagtttggatcaaaattggtatggcggggcaagaaataatccgccagaggttgctcaaacaatataccacgaatatcaccctgatatgtattttgtagaacctctgtattctaaagaaacaaaagtaagtaaaattaaagcaaaaacaactaaacctaaacctgtaaaaaaagttaaaaaaagaaaagtgatgatcgttgctggtcatgggtataatgatcctggtgctattggtaatggttataacgaacgtgattttataagaaaaaacattgttgataatgtatcaaaatatttgaaagatgcaggacatactgttggtatatatggaaaaaagcaagatatgtatcaggatacagcctatggagtaagagtcggtaatcacagagattatggcttatattgggtaaaatctcaaggatatgatactgttattgaatttcatttagatagtgcaggtcctaaagctacaggtggacatacaatcattccagccggttatcctgctaatataacggataaaaacatccaagcagcactaaaacaaagtgttggtactataagagggataactcaacgtaacgacttattaaactgtaatgttgctaatgatattggtatagaatatagacttgttgaattggggttcattacttcatataaagatatgaagtatattaatgaaaatataaaacctttcacaaagtcaatagcaagcgatattaacggcaagccaattggaggtacaagtgcaggtaaagttaaaagtgtaaaaaaaacatgggattggaaaggtagattttatccgaacacaacaattaaagttagaaaaaaacccaacggcgaaattgtagaaaaaggttcttggttgtacggaaaagacgattgggtagatattgttcaattatacaaagacactaagaaaaaattatggtggggtaaattcaaatatccaaccaatcctagttctggttatttttattgtgctttaggtgaaatcaccgacaaacaagaacgaataaaaaaagaaaagaaattatatggaaagataaagtggcagtga

SEQ ID NO: 1534 - DNA, 213 bp, Staphylococcus epidermidis
gttcatcccctaataaacaatgacattttaatagagtctgatatagttgtcacattgtgtagtgatgcagatgcaaactgtccagttttacctaaaaacgtcactaaagaacattggggatttgatgatcctgctggtaaagattggtcagaatttcaacgtgtaagagatgagattaaagcagcgatcgaaacatttgctcatagagtgtaa

SEQ ID NO: 1535 - DNA, 591 bp, Staphylococcus epidermidis
aagcagcaaaacaatgtagagcagctattgaaggtaaataagatgagtgaatttaataattatcgtcttattcttgaagagttagattctactttatctcaagtagataatacagagtatgaacgttttgctaatgatgttataggtgcagatcgcatatttacagctggtaaaggtcgttcaggttttgttgctaatagttttgcaatgcgcttaaatcaattaggtaaaaatgcctacgttgtaggtgagtcaacaacaccttcaattaaagaacatgatttgtttattattatttcaggttcaggttctacagaacatttaagattattagctgaaaaagcacaatctgagggtgcaaaaattgtcttattaactacaaatgcggaatcgccaatcggtaatcttgcagagacggttgttgaattgcctgcaggtactaaacatgatgttgagggttcgaaacaaccacttggtagtttatttgaacaggcttcacttatattcttagatagtgttgtattacctttaatggatgcatttcacattagtgaaaaaacaatgcaagagaatcatgctaatttagaataa

SEQ ID NO: 1536 - DNA, 696 bp, Staphylococcus epidermidis
atggctaaaaaaggtaaaaagtatcaagaagcagctagtaaagttgaccgcactcaatactatagtgttgaagaagcaatcaaattagctaaagaaactagcgttgctaatttcgacgcttctgttgaagttgcattccgtttaggaattgatacacgtaaaaatgaccaacaaatccgtggtgcagtagtattaccacacggtactggtaaatcacaacgtgtactcgttttcgctaaaggcgataaaatcactgaagctgaagaagcaggtgcagattatgtaggtgaagcagattacgtacaaaaaatccaacaaggttggtttgatttcgacgtagttgtagctacacctgatatgatgggtgaagttggtaaacttggtcgagtattaggacctaaaggtttaatgcctaaccctaaaactggcactgtaacaatggatgttaaaaaagcagttgaagaaatcaaagctggtaaggtagaataccgtgctgaaaaagcaggtattgtacatgcgtcaattggtaaagtgtcattcgatgaagaaaaattagttgataacttcagaactttacaagatgtattagcgaaagctaaaccagcttctgctaagggtacttacttcaaatctgttgctgttacaacaacaatgggtcctggagtaaaagttgatacttcatctttcaaactataa

SEQ ID NO: 1537 - DNA, 2793 bp, Staphylococcus epidermidis
ttaaaaaaaaataatttactaactaaaaagaaacctatagcaaataaatccaataaatatgcaattagaaaattcacagtaggtacagcgtctattgtaataggtgcaacattattgtttggtttaggtcataatgaggccaaagctgaggagaatacagtacaagacgttaaagattcgaatatggatgatgaattatcagatagcaatgatcagtccagtaatgaagaaaagaatgatgtaatcaataatagtcagtcaataaacaccgatgatgataaccaaataaaaaaagaagaaacgaatagcaacgatgccatagaaaatcgctctaaagatataacacagtcaacaacaaatgtagatgaaaacgaagcaacatttttacaaaagacccctcaagataatactcagcttaaagaagaagtggtaaaagaaccctcatcagtcgaatcctcaaattcatcaatggatactgcccaacaaccatctcatacaacaataaatagtgaagcatctattcaaacaagtgataatgaagaaaattcccgcgtatcagattttgctaactctaaaataatagagagtaacactgaatccaataaagaagagaatactatagagcaacctaacaaagtaagagaagattcaataacaagtcaaccgtctagctataaaaatatagatgaaaaaatttcaaatcaagatgagttattaaatttaccaataaatgaatatgaaaataaggttagaccgttatctacaacatctgcccaaccatcgagtaagcgtgtaaccgtaaatcaattagcggcagaacaaggttcgaatgttaatcatttaattaaagttactgatcaaagtattactgaaggatatgatgatagtgatggtattattaaagcacatgatgctgaaaacttaatctatgatgtaacttttgaagtagatgataaggtgaaatctggtgatacgatgacagtgaatatagataagaatacagttccatcagatttaaccgatagttttgcaataccaaaaataaaagataattctggagaaatcatcgctacaggtacttatgacaacacaaataaacaaattacctacacttttacagattatgtagataaatatgaaaatattaaagcgcaccttaaattaacatcatacattgataaatcaaaggttccaaataataacactaagttagatgtagaatataagacggccctttcatcagtaaataaaacaattacggttgaatatcaaaaacctaacgaaaatcggactgctaaccttcaaagtatgttcacaaacatagatacgaaaaaccatacagttgagcaaacgatttatattaaccctcttcgttattcagccaaagaaacaaatgtaaatatttcagggaatggcgatgaaggttcaacaattatcgacgatagtacaatcattaaagtttataaggttggagataatcaaaatttaccagatagtaacagaatttatgattacagtgaatatgaagatgtcacaaatgatgattatgcccaattaggaaataataatgacgtgaatattaattttggtaatatagattcaccatatattattaaagttattagtaaatatgaccctaataaggacgattacacgacgatacagcaaactgtgacaatgcaaacgactataaatgagtatactggtgagtttagaacagcatcctatgataatacaattgctttctctacaagttcaggtcaaggacaaggtgacttgcctcctgaaaaaacttataaaatcggagattacgtatgggaagatgtagataaagatggtattcaaaatacaaatgataatgaaaaaccgcttagtaatgtattggtaactttgacgtatcctgatggaacttcaaaatcagtcagaacagatgaagaggggaaatatcaatttgatgggttaaaaaacggattgacttataaaattacattcgaaacaccggaaggatatacgccgacgcttaaacattcaggaacaaatcctgcactagactcagaaggcaattctgtatgggtaactattaacggacaagacgatatgactattgatagcggattttatcaaacacctaaatatagcttagggaactatgtatggtatgacactaataaagatggtattcaaggtgatgatgaaaaaggaatctctggagtaaaagtgacgttaaaagatgaaaacggaaatatcattagtacaacaacaactgatgaaaatggaaagtatcaatttgataatttaaatagtggtaattatattgttcattttgataaaccttcaggtatgactcaaacaacaacagattctggtgatgatgacgaacaggatgctgatggggaagaagtccatgtaacaattactgatcatgatgactttagtatagataacggatactatgatgacgactcagattcagatagtgattcagactcagatagcgacgactcagactccgatagcgattccgactcagacagcgactcagattccgatagtgattcagattcagacagtgactcagactcagatagtgattcagattcagacagcgattccgactcagacagtgactcaggattagacaatagctcagataagaatacaaaagataaattaccggatacaggagctaatgaagatcatgattctaaaggcacattacttggagctttatttgcaggtttaggagcgttattattagggaagcgtcgcaaaaatagaaaaaataaaaattaa

SEQ ID NO: 1538 - DNA, 300 bp, Staphylococcus epidermidis
tttatgaaaaaaataataatcactggagcacttggtcaaattggtactgaattagttattaagtgtagagaaagatatggaactgaaaatgtattagctactgatataagaaagccagaaccacactctccagttaaaaacggtccttttgaaatcttagatgttacagatagaaatcgtttatttgaaacagtgagatatttcaatgctgatacacttatgcatatggctgcactgctttctgctacagcggaaaagaaaccactagttgcctgggatttgaatatgggggacttataa

SEQ ID NO: 1539 - DNA, 132 bp, Staphylococcus epidermidis
ttaattgaaaaaccccgttatcagaataacggggttttaacttctcaaagaattcaggttgtatttgcattgaaatctatattaaataggttaaacatacattttcaacctaactatttaattagaaagtag

SEQ ID NO: 1540 - DNA, 222 bp, Staphylococcus epidermidis
ggtaaagaaaagtctattttagttccaagtctacttttaaagaagctaattttcgatgagaacacaaatttaattacggaaaaaataggtgatgataataacataacttgtaacttaataaaggtagtgttttacttatactgtatacataataaaattaatatctattttgaatatttagaaaattcattgaatagtagaatcacgattgatataatttag

SEQ ID NO: 1541 - DNA, 495 bp, Staphylococcus epidermidis
aacgtaagaaaccacatttattcacagtgcctcaaaaacaccctcgtagtgaatggtgtacgtaccttatggaaaatgacatcttccctagaaaggttgcgaaatgatatgaatataaaattaataaaagaaaaaatcgacaatgaaaataaaagaatgggaagcgagttggaatacactttcaaatataaaggccataaatgtaaggtgaaacgcattgaagaatatggtcatttgtgtggatatatatatttaaatgtcaaaagaggaagcgaagaatatgaaattatagatgagttggcgcattgcggtgtatcttatcacaaaggtaacttgataggttttgattgcgcgcatgcaggagacttttcactgcgtatgtataatctatttgaaaataaaacttatctaagcgatttagaaacatataaagatcttgaatatgtagaaaataacataaaagaaatcatagactctttgcaaaagggtggttaa

SEQ ID NO: 1542 - DNA, 564 bp, Staphylococcus epidermidis
aatgttggaaaacaaagaaaaatgacatattttaaatggcaagataaacatgtgaaatttctaaaagaaaatgcgaatggtaacaattcagaagatttaacgcaatctttcaacaatagattcgggacaaatcaatctaagtcgtctcttaagtccaaaatgtatcaaattggaattaaattcaataacaatacaggaagatttaaaaaaggtgatcattcttataatacttatgcaattggaactaaaagtattgataaagacggatatgtaattattaaacattcaaattctaagggagactataacaaaaattggaaactctatcatcattacttatgggagcaaaaacatggaaggattccggaaggttatgtagttatttttcttaacggggacaacagagattttagaataaaaaatctttattgtgttgagcgtggagtatggttaaaagttatcaataacgatatgagattcgataatccagaattagttgagtctgctattcatctatcaaaattgatgatcaaacaaaaaaatatagaaaaaaggagacgatga

SEQ ID NO: 1543 - DNA, 579 bp, Staphylococcus epidermidis
gtgaggtgtttaaaattgctttgtgaaaattgccattttaatgaagcggaagttaaacttactgttaaaggtatagatagtacgcatgaaaaatgggtatgttcagtatgtgcccaaggagaaaacccctggttacattctaacgatgataatacgtatcatacacaccaagacgatatagaagaagcatttgtagtgaaacagatacttcaacaccttgctgcaaaacatggtattaattttcatgagatggcatttaaagaagaaaaaaaatgcccaacgtgtcagatgacacttaaggatattgcacatgttggtaagcttgggtgtgctgattgttatgctacgtttaaagaagacatcattgatatagttcaacgtgttcaaggtggtcaatttgaacatgtaggaaaaacaccacaatcatcgtataagaaacttgcaataaaaaagcaaattgaagaaaaatcaaaatatctaaataaattgatagatggtcaagagtttgaagaggcagcgattgttcgtgatgaaattaaagctttaaaaagtgagagcgaggtgtctcatgatgagtaa

SEQ ID NO: 1544 - DNA, 3648 bp, Staphylococcus epidermidis
tctaaattgaaggaggtaggctccttgattgatgtaaataatttccattatatgaaaataggattagcttcacctgaaaaaattcgctcttggtcttatggtgaagttaagaaacctgaaacaataaattaccgtacacttaagcctgaaaaagatggtctattctgtgaaagaattttcggacctactaaagattgggaatgtagttgtggtaagtacaaacgtgtacgctacaaaggtatggtatgtgatagatgtggcgttgaagtaacgaaatcaaaagtgcgtcgtgaaagaatgggtcatattgaattagcagcacccgtatctcacatttggtatttcaaaggaattccaagtcgtatggggctattattagatatgtctcctagagcattagaagaagtaatatacttcgcttcatatgttgtagttgatccaggaccaactggacttgaaaagaaaacattattatctgaagctgaattcagagaatattatgacaagtacccaaatcaatttgttgccaaaatgggtgcagaaggtattaaagacctattagaagaaattgatttagatgaagaattaaaagagttacgtgatgagcttgaatctgcaacaggtcaaagattaacacgtgcgattaaacgtttagaggtagttgagtcatttagaaattctgggaataatccttcttggatgattttagatgtattacctattataccacctgaaattcgtccgatggttcaattagacggtggacgtttcgctacaagtgatttaaatgacttgtatcgtcgtgttatcaaccgtaacaaccgtttgaaacgtttattagaccttggagcaccaggtatcatcgttcaaaatgaaaaacgtatgttacaagaagcagtcgatgctttaattgacaatggtcgtcgtggtcgccctgtaacaggaccaggtaaccgtccattgaaatctctttcacatatgcttaaaggtaagcaaggacgtttccgtcaaaacttactaggtaaacgtgttgactattcaggacgttcagttatcgcagttggaccaagcttgaaaatgtatcaatgtggtttaccaaaagaaatggcgcttgaattatttaaaccattcgttatgaaagagttagttcaacgtgaaattgctacaaacattaaaaatgctaaaagtaaaattgaacgtatggacgatgaagtttgggatgtgcttgaagatgttataactgagcatccagtactattaaaccgtgctccaacattacacagattaggtattcaggcatttgaacctactctagtagaaggtcgtgcaattcgccttcaccctcttgttacaactgcttataatgcagactttgatggtgaccaaatggctgttcacgttccattatcaaaagaagctcaagctgaagcacgtatgcttatgcttgcagcacaaaacatcctaaaccctaaagatggtaagccggttgtaacaccatcacaagatatggttttaggtaactattacctaacattagagcgaaaagatgccgtgaatactggtgcaatctttaacgatactaatgaggttttaaaagcttatgcaaatggttatgtacatctacacactcgtattggtgttcatgctaattcattcaataatccaacgtttactgatgagcaaaatagcaaaattttagctacatcagtaggtaaaattattttcaatgaaattattcctgattcatttgcatacatcaatgaaccaagtcaagctaacctagaaagaacgacacctgataaatactttgttgatcctacgcaattaggtgaaggtggactaaaagaatactttgataatgcagaacttattgaacctttcaacaaaaagttcttaggaaatatcatcgcagaagtattcaatagatttagcattactgatacttcaatgatgcttgatagaatgaaagatttaggattcaaattctcatctaaagctggtattactgttggtgtttctgacattgttgtacttccagataaacaagacattttagatgaacatgaaaaattagttgaacgtgtgactaaacaatataatcgtggtttaatcactgaagacgagcgttacaatgcggttgtagaaatttggactgacgcaaaagaccaaattcaaggcgaattaatgcagtctcttgagaaaactaacccaatattcatgatgagtgattctggtgcccgtggtaatgcatcaaacttcactcaattagctggtatgcgtggtttaatggcagcaccatctggtaagattatagaattaccaatcacatcttcattccgtgaaggtttaacggtattagaatactttatttctacacacggtgcgcgtaaaggtcttgccgatacagcacttaaaacagctgactctggttaccttactcgtcgtcttgttgatgtagcacaagatgttatcgttcgtgaagaagattgtggtacagaccgtggtttattagtttctgatataaaagaaggaactgaaatgattgaaccatttatcgaacgtatcgaaggtcgttattctaaagaaacaattcgccatcctgaaacagacgaagtaattattcgtccagacgaattaataacaccagatattgcaaaacaaatcactgatgcaggtattgagcaaatgtatatacgctcagcatttacatgtaacacacgtcatggtgtatgtgaaaaatgttatggtaaaaaccttgctactggtgaaaaagttgaagtgggtgaagcagttggtacaattgccgctcaatctatcggtgaaccaggtacccaacttacaatgcgtacattccacactggtggggtagcaggaagtgacatcactcaaggtcttcctcgtatccaagaaatctttgaggcacgtaatccaaaaggtcaagctgtgattactgaaatcgaaggtgtagttgatgatattaaattagcaaaagatcgccaacaagaaataattgttaaaggtgctaatgaaactagatcttatctagcatcaggtacttcaagacttaaagttgaaataggtcaatctgttgaacgtggtgaagttctaacagaaggatcaattgaacctaaaaactatttatctgtagcaggcctaaatgcaactgaaagttacctattaaaagaagtacaaaaagtttaccgtatgcaaggtgttgaaattgacgacaaacacgttgaagttatggtaagacaaatgttacgtaaagttcgcatcattgaggctggtgacactaaattattaccaggttcattagttgatattcataactttactgacgctaacagagatgcattcaaacatcgtaaacgtccagctacagctaaaccagtattacttggtattactaaagcttctctggaaactgaaagcttcttatcagcagcttcattccaagaaacaacacgtgtgcttactgatgcagctattaaaggtaaacgtgatgatttacttggtcttaaagagaatgttattattggtaagttaattcctgctggtactggtatgagacgttacagtgatattcaatacgataaagctactgcaccagtaacagaaacaagtgaagaagttgaaacgatagaataa

SEQ ID NO: 1545 - DNA, 657 bp, Staphylococcus epidermidis
aaacgaatgaaatggtcagaggtatttcatgatataacaacgcgccatgattttcaggcgatgcatgactttttagaaaaagaatatacgactcaaaccgtctatccagataaacaaaatatctatcaagcatttgatttaacgccgtttgaagatatcaaggttgttattttagggcaagatccttatcacggtcctaatcaagcacatggtttagcattttcagtgcaacctcatgctaaatttccaccatctttaagaaatatgtatcaagaactagaaaatgatatagggtgtcatagaacttcgcctcatttacaagactgggcaagagaaggtgtcttgttattaaatacggtattgactgttcgacaaggtgaagcacattcacatcgaaatattggatgggaaacattcacggatgaaatcatacaagctgtttctaattatcgtgagcatgttgtttttattctgtggggaagaccggctcaacaaaaggaacgattcattgatacatctaaacacttaatcattaaatcgccacatcctagtccactatcggcttttagaggattttttggttctaaaccttattcaactacaaataactatttaaaatctaaagggaaaacaccagttcagtggtgtgaaagttag

SEQ ID NO: 1546 - DNA, 228 bp, Staphylococcus epidermidis
acgatgatgaaaatgacaactagcacattagaattatcctcaactatcaaccaacgttacaaatacaacacacaaggcaagacacctacccagatacaacaggaattacgacagataggtgttaaaggctttgtggttaaagtagcaggaagcagagtgacgatgaaagttgagaaagaaaatataagaaagaatagggagtgtatgaggaatggcagaagtaactaa

SEQ ID NO: 1547 - DNA, 1383 bp, Staphylococcus epidermidis
ggggtgatgaattatgaacgtagctatttacgttcgtgtcaggtccgtacattagaacaaaaagaagtgggttattctattgaagaacaagaaagaaagctcaaatcattttgcgagataaacgactggagtgtatcagacgtatttatcgacgctggtttctctggcgctaagcgtgacagaccggaattacaacgtatgatgaatgatattaaacggtttgatttagttttagtgtataagttagacaggcttacacgtaatgtgcgtgatctacttgatttattagaggtattcgaacagaataacgtagcattcagaagtgctactgaagtttatgatacatctacagctatgggtagactgtttgttacgttagttggtgctatggcagagtgggaaagagaaaccattagagagcgtgttatgatgggtaaacgcgcagcgattaaacaaggtatgatactcacaccaccacccttttattatgatcgtgtagataacacttacattcctaatgattataaaaaagtagttttatgggcatatgacgaagtgatgaaaggtaatagttcaaaagctatagctagaaaattaaacgattcagatataccacctcctaatggcaaaaggtgggaagatagaacaataacgagagcgctaagaaaccctataacaagaggtcattatacttggggagatgtatttatagaaaactctcacgagcctattattaccgaagaaatgtatcaacaaataaaagaaaggctagaagaacgaatcaatactaaaatagtcagtcacgtatcagtgttcagaggtaaatttatttgcccgagatgtggtggcacattaacaatgaacacagcaacaagaaagagaaagaaagggtatgttacttataaaacatattattgcaacacatgtaagactaaaaaacaaagtttcggtttttcagagaatgaagcattgagagtgtttcgtgattacctatctaaactagacttagataaatatgaagtaaagacaaaacaaaaagacgatgtcgttactattgatatagacaagatcatggaacaacgtaaaaggtatcataaattatatgctaaagggttaatgcaagaagaagaattatttgaattgattaaagaaacagacgaaacaatagcagaatatgaaaagcaaaaagaattagtacccagaaaatcactagatatagataagataaaaaaatttaaaaatgcattattggaatcatggaaaatattctcgttggaagataaagcagattttattaaaatggctattaaatctattgacatagattatgtaaaacttaaaaacaggcattctatcaaaataaatgatatagaattttattaa

SEQ ID NO: 1548 - DNA, 150 bp, Staphylococcus epidermidis
ataattgtgaagaaagtacctttgaattgtgagaattgtggcaatcggaattacaatgttcctaaaaaggaaggctcagcaacgagacttactttaaaaaaatactgtccaagatgtaacgcgcatacagttcataaagaatcgaaataa

SEQ ID NO: 1549 - DNA, 183 bp, Staphylococcus epidermidis
agaaaggtgaaattcatgattactgtattagtcattactatattttttattacagtaactttaataatttggcaaccaaaaggattagatatagggatttctgcagtcatcggcgcgcttttagctatcgttactggagtagtgagtgtctcagatatattagaagtgacaagtatagtttaa

SEQ ID NO: 1550 - DNA, 861 bp, Staphylococcus epidermidis
aagataaagaataataaatggaggatggaaactatgactgaattaaatactaaagaaatgaaattagacgcactattgaaagacatgcagagtgtagtaattgccttctcaggtggagtagatagtagcttgttactgaaaaaagcgattgatattttaggtgttaactatgttaaacctgttgtagtaaaatcagaattatttagaaatgaagagtttgaactagcgcttaaacttggacaaagtctaggtgttgaagtattagaaactgaaatgtctgaacttcaagatgcgaatatcgttaaaaatacgcctgaaagttggtactatagcaagcgcttgatgtatagtcaacttgagaatattaagaataaactaggatttaattatgtgctagatggtatgattatggatgacttagatgattttcgtcccggattaaaagcaagagacgactttggtgttcgtagcgttttacaagaagcaaaactatataaatctgaagttagagaattaagtcatcaacatgacttgcctgtatggaataaaccagccttatgtagtctagcatcaagaataccttatggtgaggaattaagttttacaaaagttaacaaggtcaacgaagcagaaaaattcattttaagcctaggtattaaccacgtacgagtacgctatcatcacaacatagcacgcattgaagtaacagaagatcaattaaataatcttcttaaattgaaagacagtatcatattacatttgaaagaattaggatttgactatgtaacaatggatttagaaggctatcgtacaggtagtatgaatgaaatcattgataccaaatctacaagttttaaataa

SEQ ID NO: 1551 - DNA, 495 bp, Staphylococcus epidermidis
aaaaaggagaaatgtagaatgaaagaaccgccgcataatagacttacatttaaagagagtatgacagaaggcaaatatctgacgacaataactaaagaagataaaattcgttataaaaaattatctgttgaagaaaaaagaaaagtattaaatgatttcaacgcttctacaccgcaaaaggacgacaaagttagcttattcgattatatgaaacgcactatgttaaaacatggtttagacgaagtgacttctattacagaaaatgctgttttaaaaaacgaaccaggcaaacatatcgacagttttatgacgagattgagtagtttttcaacaacaaaagatggaacaactgttttcacatatgagttaatcaatcaaaactttgttgttataaaaatattagatgaacaactgaaacaaaataaaaaaataatagaacaaaataatgaaatcatcagtttactcaaacaaatagctaacagaggagaaatgtag

SEQ ID NO: 1552 - DNA, 903 bp, Staphylococcus epidermidis
aataagtggaaacgaggtcaactaatgataaagctaatagcaactgatatggatggaacattacttaacgctggtcatgaaatcaccactatgaatcaagaagcgataaaatttgcgcaagcgaacggcattacagtagttattgcaactggtagagcattttatgaggcacaaacacctgttgctgaaacagacttaaaagtaccttacatatgtttgaatggtgcagaagttcgtgatgaatcatttaatataatgagtacatcgcatcttaatcatgatttagtacacaaaattactacagcacttaaaaataatcatatttattatcaaatttacacaaaccgtggcatatatacagaagatcctaaacgtgatttagcaatctatatagatattgcagaacgtgcgggtcaaaaagcagatgtagacaagatacgaaataatatacaaaaacgcatagataacggtactttaaaagttgtagataattatgattcaattgaagatattcctggagaacttattatgaaggtgttagcttttgatgcagatttaagtaaaatcgaccaagtaggtcaagcgttagcatcatcaccaaatttagcagtatcttcatcatcaagaggtaatctagaaatcactcattcaaacgctcaaaaaggcattgccttatcagctattgctcatcaattgggtatagatttaacagatgtgatagcaataggagataatttaaatgatatttcaatgctagaacgtgtaggttatccagtagcaatgaataatgctacagacgaagttaaacatattgctaaatatgtcacagacaccaatgaaaatagtggagttggaaaagcaatcatgaaaatattaaaagaagaaaataatttagaggtgtaa

SEQ ID NO: 1553 - DNA, 129 bp, Staphylococcus epidermidis
ttgaggtggaaaattttaaaaactttagtaaaaaatttaacgatgtttacaaaattgtcatttaaggtaaatatatttcatgattttgataactctttaaaagagttttataatattaaagtgttgtga

SEQ ID NO: 1554 - DNA, 132 bp, Staphylococcus epidermidis
aatcaatttgaaatattccacttaaatatagtacctaaattcgtacgatacgtttcacatgaaacccttattctaacaaaaataatctataaaatttcagtcaacaaatttcgcaaaaacaattcttcctga

SEQ ID NO: 1555 - DNA, 147 bp, Staphylococcus epidermidis
ctatcgtctgatgaaccactaccgttaccactattaccacaagcacttagcactatggctaaggctagtgtggctagtagtcctaagaatttcgaactacgtcgttttaacataacgtgtttccccctttttaatattagtctctaa

SEQ ID NO: 1556 - DNA, 498 bp, Staphylococcus epidermidis
agaatgactgaaaatacaatcaatcctattactacattagaattcaacggagaagaagtagaagcaaaagctactttcttatttgataaaactgctaaaaagtttgctaaagatgagcaagataaaaacggtaaaactactaaagtatcaggttttaatgctatttataacggtattttagaacgtgatactaatgcaattgcagatttttgggaatgtgcaacagcttatttaaataagaaagctcctacacgtgagcaaattgaaacttctttaatgcagtttatcgataaaaatggcgacacgcttgaattactacaaggcgctttagacgtaatgaataatagtggttttttcaaacaaaaatcacgtcaattctggacgcaaatgaacatagcaccgtctatggcaaaagaggaagagaaagagtctacgaagaacggtatcgagttcatgaagaacaactacaaagaaatcatgggcgagctaccttactag

SEQ ID NO: 1557 - DNA, 261 bp, Staphylococcus epidermidis
atgtctaatgaaaaagttgcacgctttaacaaacaacaatatgtagttggtcttaaagaaacgcttaaagcgttaaagaaaggtcaagttacatcattgattattgctcaagacgttgaagttcatttgctaactcgcgtgttaagctatatcaatcataaaaatataccagtatcatttttttctagccaacgtgcgttaggaaaatatgtaggtattaatgttaatgcgacaatagttgcattaataagtgagaattag

SEQ ID NO: 1558 - DNA, 1221 bp, Staphylococcus epidermidis
aacaataatgatatactaatatcaataattaagatggaagaagtgatacatgtgtttgattggtttcaattagcaagtaataaagaaaagagaatggtgcaattacgacgatatttgcatcaatacccagaactttcttttgaggaaaaacgtacgcatgattttattgtaaatcaattgagccaattagcatgcaccatagaaacaccagttggacgtaatggtataaaagcaacttttaaaggatctgattcaaatggaccaacgattgcattacgagcagatttcgatgcactacctgttcaagaattaaatgatgtaccctatcgttcaaaaaataaagggtgcatgcatgcttgtggacatgacggacatacagctattttgcttggagtagctgaaattgttcatgagcatcgtcatttattgaaaggtaatgttgtttttatattccaatatggtgaggaaattatgccaggtggttctcaagagatgattgatgatggctgtctacagaatgtcgataaaatatatggcacacacttatggagtggttatccatctgggacaatctattctagacctggagcaataatggcttcaccagatgaatttagtgtgactatatatggaaaaggtggtcacggtgcaaaaccacacgaaacaatagaccctattgtcattatggctgagtttattttaagtgcccaaaaaataatttctcgaacaattgatccagtaaaggaagctgttcttactttcggaatgattcaagcaggatcaacagatagtgttattccagatacagctttttgtaaaggtactgtacgtacttttgacacaaaattacaaagtcatgttcaaaataaaatggataagctcttacaaggtttatctttatcaaacgatattacatatgaattggaatatattaaaggttatttaccagtacacaatcatcaacaatcatatgatgtagtcaaacaagcagctaatgatttacatttaagatttaatgagtcagacttaatgatgattggtgaggacttttcacattaccttaaagtacgacctggtgcattcttcttaactggttgtggtaataaagacaaaggcattactgcacctcatcataatcctcattttgacattgatgaatcttcattaaaatatgcagctagtgaatttttaaaaatattagaaattgaaaatgttttttaa

SEQ ID NO: 1559 - DNA, 498 bp, Staphylococcus epidermidis
aaaaacagtgacttcggaaaatctgtagattgggcaattcaaggcacagacgcacgtaatggcgttatgcaagaaactaaagatgaacttgatagtgacaacttggataaatatagcttgaaagaaagtgctgaccaagaccaattcaagaaaattcaatctgcttttaaacaacaagaacctatcgtcttcacagcaatggaacctagctggttctctaaagaattagacgttaaaatgttgaaagatccagacaacatttatggtaataataatcaacatattgacttagtatttaacaaagactttaaagaagcacatccagctgcatacacagttgcaacacgtatggcagatgattggagtaaatctgacgaagacaaattagctaaaaaaatctttgttgataacaaaaatccagaacaagtagctaaagactatgtggatgataatgataataaagtagatgaatggttagaaggtattgagactatctaa

SEQ ID NO: 1560 - DNA, 564 bp, Staphylococcus epidermidis
gttaggagtgaagacatgtctgaagaagtaggcgctaagcgttggtatgctgtacatacctattctggatatgaaaataaagttaaaaagaatttagaaaaaagagtagaatctatgaatatgactgaacaaattttcagagttgtcataccagaagaggaagaaactcaagttaaggatgggaaagctaaaaagcttgtgaagaaaacatttcctggatatgtattagttgagttaatcatgacagatgagtcgtggtatgtagttagaaatactcctggagtaacaggatttgtcggatctgcaggtgcaggatcaaaacctaaccctctacttcctgaagaagtacgcttcattcttaagcaaatgggtcttaaagagaaaacaatagatgttgaactcgatgttggagaacaagttcgtatccaatcaggtccttttgctaatcaaattggagaagtacaagagattgaagcggataaattcaagcttactgtacttgttgatatgtttggtcgtgaaacacctgtagaagttgaatttgaccaaattgaaaaattataa

SEQ ID NO: 1561 - DNA, 135 bp, Staphylococcus epidermidis
cagctcaacgaactgaaaataatcaaaaaaaattataaaaaagacaatttctatattatttcaatagaaattgtctttttttacttatcttggacctttttgttccagcctctttataaaattgtcacgaaataa

SEQ ID NO: 1562 - DNA, 363 bp, Staphylococcus epidermidis
aaccatttagacgtttacgttggactggttatcatgtttaatccattagacgagtttcctcatacaatcgaattaggctcaagagaagttgtaggagagtatccacgtgaacaagagcgctttaagagcgaaaaaacaatacaaggttttatggatacgcctacttcatctgaacaactaaagttccatcaaatgaaccaatcatacgacagaaacctatatacgccgtacagcctgccaataactaacacaaatttattcaaatacaacggtaaaacttacgaagtagtaggagaacctgtcgatcaaggtggacaacaagaaatcaatcttactcggttgaaagagtgtcctattggctaa

SEQ ID NO: 1563 - DNA, 210 bp, Staphylococcus epidermidis
aaagtcatagagtgtggaggtcttatgatggctaaaaaagaaagtttctttaaaggcgttaagtcagaaatggaaaagacgagttggccaactaaggaagaattatttaaatatacaataatagttgtatcaacagtgatattcttcttagtctttttctatgccttagacataggaattaatgcattaaaacaattatttttaggttag

SEQ ID NO: 1564 - DNA, 882 bp, Staphylococcus epidermidis
aacatgacagaatttgacttatccactagagagggtcgttggaaacatttcggttctgttgaccctgtcaaaggtacgaaaccaactactaaaaatgaaatgaccgatttacaaagtactcataaaaatttcttatttgaaatagaggaagtaggcattaaaaatttaacttatccagttttaattgatcagtaccaaacagctggtttatttagtttttcaacgagtttaaataaaaatgaaaaaggcattaatatgagtcgcatattagaaagcgttgaaaaacattatgataatggcattgaacttgaatttaacacactacatcaattgttgcgtactctacaagataaaatgaatcaaaatgctgcaggtgttgatgtgtcaggtaaatggttctttgatcgttatagtcctgtgactaatattaaagctgtaggccacgcagatgttacttatggtttggctattgaaaatcataccgttacacgcaaagaattaactattcaagccaaagtaacaacactatgtccttgctcaaaagaaattagtgaatattccgcacataatcaacgtggtatcgttacagttaaagcatatttagataaaaataatgatgtcatcgatgattataaagataaaattttagacgctatggaagccaacgctagttctatcttatatccaatcttaaaacgtcctgatgaaaaacgagtaacagaacgcgcttatgaaaatccacgatttgttgaagatttaattcgactaattgcagctgacttagttgaatttgactggattgaagggttcgatattgaatgtcgtaatgaagagtctatccaccagcatgatgctttcgcacgtctgaaatatcgcaaataa

SEQ ID NO: 1565 - DNA, 330 bp, Staphylococcus epidermidis
ggaatggcagaagtaactaaggaacaattattagaattcattagaaacaatgagttagatttagacgaaagctatccacgtagtgattggtggaagtttagaaatgaacgtgacagtttacgtaagcaacgtgatgaactcatcaatgatatggcagaaacgaaaaggaaagcagaggcgtttgatgagatagtaaaagttttagctagtatctcaaaagagatagtggaatatccaggcgataatgataaacaaaaagaggttatctacaaaagatatgatgatttatttgaacctatgaaattattggaggtaaacgatgaaagataa

SEQ ID NO: 1566 - DNA, 252 bp, Staphylococcus epidermidis
tttctacaagaaaacgcagaggttttatggatgaaagtttatgagtatcagcaacttttaggttttatgtatcgagaggattataaagaagatccaatcatagccaaaatattaatcgagtctgggtgggcagttaaaaggctgcttgatactggaaccattaaaccctttgacgattatgaagaagtgaaagagttaatcatgaatgaaacgaagtggaggcaaccagatgggacttatcgacggacttaa

SEQ ID NO: 1567 - DNA, 552 bp, Staphylococcus epidermidis
atgactaaagaactagaaattaaattattaacagaaaatgcgactatgccgaagagagatagattagatgctgggtacgatatctattcggcagaaacagtaatacttgagcctcaagagaaagcaacgattagaacagacattgctgtgaacattccagaggggtatgtagggctattaacgtcaagaagtggtgtaagtagtaaaacacatttagtgattgaaacaggcaagatagacgcaggttttcaaggtaatatgaagattaatattaagaatgatattgaagtagtagatgcagatgaatttatctataaagatataaaaaatgaaataatcgatgacggaagctttaacgaaccaattgaagagcaaagctctaatccgctagatatttttaaaccaagaaacacaagttatgtcattaaaaaaggcgacaaactcgcacaactcgttatcgtacctatttggacaccagagttaaaagaaatagaggagtttagcagtgggtcagaaagaggagagcaaggctttggatcaacaggattctaa

SEQ ID NO: 1568 - DNA, 252 bp, Staphylococcus epidermidis
acgatgaaagataaagattataaaagtttatggataaagttgaaagagaagaaattaaaagaatatgtggaagtacatcgctcagtaaatcaaattataacaccatacaatcaatatcatttatttgagatagctaacgaaatggtaagtgaaaacgaattaaagcgagatttaaaatatatggaccaactagacggaacgcatgagttccaaaatttattaagtgatttggaggcttgcaatggacaatag

SEQ ID NO: 1569 - DNA, 627 bp, Staphylococcus epidermidis
atgactgaagaaacattatttaatcaattaaatcagaaagatgtaaatgatcatgtagaaaagaaaaatggtttaacctacctagcatggtcatacgctcatcaagaattaaagaagatagacagcaactacagtattaaaacacatgaatttgtacaccctgatgtaccactagataactattttgtaccttatttagctactccagagggttacttcgtacaagtgtcagtaactgtaaaaggacaaactgaaacagaatggcttccagtattggattttagaaacaaatctttagcaaagggtagcgcgacaacgttcgatattaataaagctcaaaaacgttgtttcgttaaagctgcagcattacatggtctaggcctttatatatataacggtgaagaagttccaagtgctaacgacaatgacattacagaattagaagaacgtatcaaccagtttgtaactttatctcaagaaaaaggtagagacgcaacgctagacaaaacaatgcgttggttaggtattcaaaacattaacaaagttactaaaaaagatatagcaaatgcacatcaaaaactagatgcaggactaaaacaattagataaggagaattcgaatgactaa

SEQ ID NO: 1570 - DNA, 639 bp, Staphylococcus epidermidis
atttcattggaactacaattagccattgatttattaaataaagaagaagcagcaaaattagctcaaaaagttgaagaatatgtagatattgttgaaattggtacgccaattgtaattaatgaagggttacctgcagttcaacatttaaatgaaaatattaataatgctaaagtattagctgacttgaaaattatggatgcagcagattacgaagtgagccaagcagtaaaatatggtgcagatattgttacaattttaggtgttgctgaagatgcttcaattaaagcagcagttgaagaagcgcataaacatggaaaagcattgcttgttgatatgatagcagtgcaaaacttagaacaacgtgctaaagaactagatgagatgggtgcagactatatcgcagttcatacaggttacgacttacaagctgaaggaaaatctccattagacagcttgcgtacagttaaatctgttatcaaaaactctaaggttgcagtagcaggtggtattaaaccagatactatcaaagatattgttgctgaagatccagatttagttattgttggtggcggtattgcgaatgctgacgatcctgtagaagcagcaaaacaatgtagagcagctattgaaggtaaataa

SEQ ID NO: 1571 - DNA, 351 bp, Staphylococcus epidermidis
tttattcaggagatacttaaaatgagaaataatgatgaaataatcacaataattaaatcagctatgaaagaacaagatatgtcacttagtgaattagctcgtcgtgtaggagttgctaaatctgctgtatcacgttatttaaacttaactagagagtttccgttaaatcgtacagaagattttgcaaaagcacttagtatcagtacagaatacttacttggttttgacaaaagtgaacaacaagatgaacaaccaaaacatcgtgcagcacatcttgaaggggaattgacagatgaagaatggcaacgtgtgctagattatgcagattatataagaagcaaacgcaaataa

SEQ ID NO: 1572 - DNA, 504 bp, Staphylococcus epidermidis
ctaacagaggagaaatgtagaatgaaaaaggttctttttttaatttttgctagtttattagtattaggtgcatgtggacaagatgaggacaaaaacaaagaagatgatgctaaaaaggttgaagttaaaaagacgaaagaaaacaaaaaagataaacaaagtcaatctaaagaacaaaaacaagaaaaaccttataacaatgatgatgaaccaattttaaatgataacagaaatgcaaacgacaacaattcaaatcaacggaacaataaacaaaatcaaaatgtagataaaattgataacaatgcgtacaaccaacagcaaaacggtcaagtaaatcaaaaagaaaatacagaaaatggacttgacccaaacttcgtacgacataatgacaacatggtaaaagaatggcaaaatcaaatgcgagaacacaacgaaaactttaatcctgaatctggtggagatttgtataacgtcgaaaccggtaactacgttgatgatgaataa

SEQ ID NO: 1573 - DNA, 1314 bp, Staphylococcus epidermidis
gataggagggaaagtatgacgctatcatcatatgcaacgagtaaattaacagaagaaaaggtatttaaagatccaattcatcgatttatccacgtacaggatcaattgatttgggacttaattaaaacaaaagaattccaacgcttgagacgtattaaacaactaggtactttgtatttatcatttcatacagccgaacatagtcgttttggacactctttgggtgtttatgaaattgtgcgccgaatgattgatgagacatttataggacaagacgcgtgggataatactgatcggccacttgcgttgtgtgctgcgttgttacatgatttaggtcatggtcctttctctcatagttttgaaaaaatatttaatacagaccatgaagcatttacacaagctattatcacaggagacactgaggttaatggtgtactaagtcgagtctctgataactttcctaaacaagtagctgatgtaattaataaaacgcacgataataagcttgttatttctatgatttcctcacaaattgatgctgatcgaatggactatttacaaagagatgcatattttacaggcgtaacgtatggctcatttgatatggagcgtattttaaggttgatgagaccatctaaagaagaagtgttaattaaagatagtggtatgcatgctgtcgaaaattttattatgagtcgttatcaaatgtattggcaaatatattttcatccagtaagccgtggtggggaagttttattaaacaattgtttaaaacgagctaagcagctttataatgaaggatatgaatttaaaatgtatccaaaagactttataccattctttgaaggaacaatgacgattgaacaatatgtagaacttgatgaagcagttgtattgtattacttgaagaaatggattcatgaaaatgatacaatattaagtgatttatcaagacggtttatcaatcgagatttatttaaatatattcctttcgacggttcaattattaccatttcggaattgcaagaattatttgaagcgggtggtattaatcctgattattactttgtaagtgaagcattttcagatttaccttatgattatgatcgcccaggctcaaatcgcaaaccgattcatttattaaaaagtaatggtggaattacagaaataagtaatcaatcattggtgattaatagtattacagggattaatagagaagaccataaattatattatcctaaagagatgattttaaaaattaaagattatcaaattaaaggttctattattaacttacttaatgaattaaattaa

SEQ ID NO: 1574 - DNA, 660 bp, Staphylococcus epidermidis
actgagggggagacgttcgtgttaaaaagaatgagagacgatataaagatggtgtttgaacaggatcctgcagcgcgctcgactttagaagtaataactacttacgctggattacatgcagtttggagtcacttaattgcccataaattatataaaaatagacgctatgtagcagccagaatgatttctcaactatcacgtttttttaccggaattgaaatacatccaggtgcaaaaatcggtaagcgtttatttatcgaccatggcatgggtgtagttattggagaaacatgtacaattggtgataatgttactatttatcaaggagttactttaggtggtacaggcaaagaaaaaggaaaacgccatcctgatattggtgataatgttttgatagcagctggatctaagatattaggtaatataaaaattgaatcaaatgtgaatattggagctaattccgtagtattacagtctgttcctagttatacaactgtagtaggtataccaggtcacattgttaaacaagaaggtagacgtattggtaaaacatttgatcaccgtaacttacctgatccactttacgaacaaattaaacacttagaaagacagcttgaaaaagctaagaatggagagattcaagatgattacattatataa

SEQ ID NO: 1575 - DNA, 1035 bp, Staphylococcus epidermidis
ggagggctttttatgaaagcagctgtagtaaccaaagatcatagagtaagtattgaagaaaaacgtttaagagaattaagacctggagaagcattagtaaagactgaatattgtggtgtatgtcatactgatttacatgttaaaaatgcagatttcggtgacgtaacaggtgtaacattaggacatgaaggaattggacgtgtcattaaaattgctgataacgtagattcattaaaggtaggggatcgtgtatctatagcatggatgtatgcagcatgtggtaattgtgagtattgcacaactggtagagaaacattatgcagggatgtccttaatgccggatatactgttgatggggcaatggctgaagaagtcattgttgatgcgaattatgcagttaaagttcccgaaaatcttgatccagcggctgcttcatctattacctgtgcaggtgtgacaacatataaagcagtaaaagtgagtggtatcgaaccaggacaatggttaggcgtatttggtgtgggaggattaggtaatttagcattgcaatacgccaaaaacgtaatgggcgcgaaagtcgttgcatttgacattaatgatgataaattaaattttgctaaagagcttggtgctgatgcaatcataaattcaactaatgttgatcctattgaggaagttaatcgtctaacgaataataaaggattagatgcaacggtgattactgctgtagctaaaacaccttttaatcaagcagttgatgttgttaaggcgggtgcacgtgtggtagcagtaggacttccagtagataaaatggatttagatattccacgtttagtgcttgatggaattgaagtcgttggttcattagttggtaccagacaagatttaagagaagcatttcaatttgctgccgaaaataaagttattcctaaaatccaattaagacaattatctgaaattaacgatatttttgatgaaatggaaaaaggaacaattacgggtcgaatggtaattgatatgaaaagcacgcactga

SEQ ID NO: 1576 - DNA, 375 bp, Staphylococcus epidermidis
tggaagagtttatatagaaaggtgggtagcaagatgaaaaataaatttttaatctgtgatgagtgtcaggctgtgaatttaaaatctttgaagcgaaaattagaaaaattagatccggaagctgaaattgaaataggctgtcaatcttattgtggaccaggtcggcgtaaaacatttgcatttgttaataatcgaccacttgctgcattaaccgaagaagaacttatggaaaaggttacaaaacaattaaaaaaaccacgtgatccagaagaagaagagcgactaagaaaacgtaacgaagaacgaaaacgtcgtaaagaagaacaagatcgcaaacttaaggaaaagttaaagaagcacaaagcagagaaataa

SEQ ID NO: 1577 - DNA, 576 bp, Staphylococcus epidermidis
aatgccacacttacctttgtcgcagttatccttatttcattaatccttgatgaaataggattttttgagtggtctgccatacatatggttaaagcatcacaaggacatggattaaaaatgtttgtgtttatcatgatattaggtgcaattattgcagcattttttgctaatgatggagcaaccttaattttgacgcctatcgctttagcgatgataagaaatttaggtttcaataaaaagctagtgtttccttttattatagcttgtgggtttatcgtatattccacatcattaccacttgttgtaagtaatttggttaacattgtatcagcagattactttggtattgaatttgttgaatatttaaagcgtatgtttatacctaatttattttctctattagctagtatcttaatattatggttttactttagaaaatccatccctaaaacatttgatatatcaagtatttttgaacctaaaaatgctatacgagacacacgattatttaaaatttcatggattattttagctttattacttataggttacttagtgagtgagttcatcccctaa

SEQ ID NO: 1578 - DNA, 135 bp, Staphylococcus epidermidis
attcaactttgcaacagaaccatatttaatatgattaatataggtatttggccaatggtcattctagcattattaatcatagctaatagtatttttatggtttacaagacagtagacgttaaaaaacgcaaatga

SEQ ID NO: 1579 - DNA, 852 bp, Staphylococcus epidermidis
ttatcattctgtctttatatattgatttggatgcacaacttttctcatgaaggttgtgcattttttcttatacaaataaaaattattgggggcataaagatgaaaaaaactgcaattatcacgggaagtagtcgtggattaggcgctaaaattgcaataactttactagaaaaaggctacaatgttgttgttaattacaaacaaaataaggataaagctgaaaaattaattagaaattataatcaaagtagggctatagctattcaagctgatgtgacagacagaaacgatgtgaatcgaatgattcaaactgccacacaacattttggaaaaatagatatagtcattaataatgcacttgttggttttaaatttgatccaaatcagcaaaaatcgtttaaagatttaacttgggaagattatcaacaacaacttaatggtactttaaaaggagcatttaatgtgactcaaagcgtcataccacaatttatagaacaacaaagtggatgcattgttagtattggaaccaatttgtatcaaaatccagtcgtaccttatcatgagtatacaacagcaaaggcaggtctcattggctttactcgtaatattgctgcagaacttggacaatatggtattacagcaaatgttgtttctggaggattactcaaaacgactgatgcaagtgcagtcactacacctgaagtatttgatttaattgctcaaactacacctcttagaaaagtaacatcacctcaagatgtagccaatatggtcgtatatctcgcttcagatgaagcacgtggcgtaacaggtcaaaatattaccgttgacggtggtttaacaatgaactaa

SEQ ID NO: 1580 - DNA, 132 bp, Staphylococcus epidermidis
aatttaccatggacaataagtaaagtaactcgtgatataagtcatttagggttcgaggctcaaccgggggtgggactgtgtattcagttccactttcttattttattagtatatggtatgtatgaattttaa

SEQ ID NO: 1581 - DNA, 123 bp, Staphylococcus epidermidis
aaaggtaaatgtacaactataaagttttttttaatatttattataaaattcacctataaatcattattttatctgcttaactctatgaaaatgactttaaataacaagttgcacgtcatgtaa

SEQ ID NO: 1582 - DNA, 228 bp, Staphylococcus epidermidis
acggaaaggtggtgtttgattatggaatttaatgtgaaggttaatgttgatgctgatgaagcaattgagaaattagaacgtatcaaaaaactatacgaagaaattaatcaattaaagaatgatagaccagttgtaaaagtaggaataagcaatgaagccgatgtagaacaaattagaagttatatcaatgagaaaaatgttgaaaatgcaaactttaacttattctag

SEQ ID NO: 1583 - DNA, 507 bp, Staphylococcus epidermidis
cgctcatttcgtcacgaaatgtttaagagtgggagggcaaaactaagccctgtgaccacatcacgatatcaaggagtgcacatcgtggctaaaaaagtagaaaaagtagttaaattgcaaattcctgcaggtaaagcgaatccagcaccaccagttggtccagcattaggtcaagcaggtgtgaacattatgggattctgtaaagaattcaatgctcgtacgcaagaacaagcaggtttaatcattccggtagaaatcagtgtttatgaagaccgttcatttacattcattacaaaaactccgccggctccagtactacttaaaaaagcagctggtgttgaaaaaggttctggtgaacctaataaaactaaagttgcaacagtaactaaagatcaagtacgcgaaattgctcaaacaaaaatgcaagacttaaatgctgcagacgaagaagcggcaatgcgtattattgaaggtactgcacgtagcatgggtatcactgtacaataa

SEQ ID NO: 1584 - DNA, 519 bp, Staphylococcus epidermidis
gaggtatctcgtttgtctgagaaaaaaggtttcaatttcaatattataaaaaatgatccactagatggtcataaaggaaccaatattggttcgattagtttagataatattgccccggtttttatagatgttgaaaatcagaaggcatttgttgatattggtggtatgcacgcacgtgctgaagttgaaaagggtgtcaagtggattactgacaaatcacaagttgaaggtgaggaggctaaagcatactggctatgttgggtgacgaccgaacgtagtgaagaagggccatattatgcgggtgtgactgcatgctatttattagttaacaaaagtattagacgtggttataagagcatgccagaacatgttaatatgatggataagtctatgaaacatcaatttatcatcgaccaaatcggtgatgataacaaacaaattttaaaagaatttctacaaaatcataacgttgaaatgtggaataattctagtgaagaactatatcgagcatttgaatag

SEQ ID NO: 1585 - DNA, 228 bp, Staphylococcus epidermidis
catttgttgctagaggcgctctcgcacggttccactcttcatttaatagcaatactcatatttgatttattactattctcatctcaattatttatttttattaacaaaggtgcattcattaatatttatgatgtgctcacagctaccgcacactctctgacacataaacatttaactactaatcctttgaatcactttatatttataatcatatgttgtcacttgtaa

SEQ ID NO: 1586 - DNA, 474 bp, Staphylococcus epidermidis
attatgcctcgtaaaggatcagtacctaaaagagatgtattaccagatccaattcataactctaagttagttactaaattaattaacaaaattatgttagacggtaaacgtggaacagctcaaagaattctttattctgcatttgatcttgttgaacaacgtagtggtcgtgatgcattagaagtgttcgaagaagcaattaataatatcatgccagtattagaagttaaagctcgtcgtgtaggtggttctaactaccaagtaccagttgaggtgcgcccagaacgtcgtactactcttggattacgttggttagttaactatgcgcgtcttcgtggtgaaaaaactatggaagaccgtttagctaacgaaatcttagatgctgcaaataatacaggtggtgcagtcaaaaaacgtgaagacactcacaaaatggctgaagcgaacaaagcatttgctcactaccgttggtaa

SEQ ID NO: 1587 - DNA, 123 bp, Staphylococcus epidermidis
aaaattattttctattcacatcaactatcactgctaatacgtaaaaaaacctgggacaatcattttgtcccaggcttatcattttatgacttatctatagtgtcacacttgctaaaaatctaa

SEQ ID NO: 1588 - DNA, 2706 bp, Staphylococcus epidermidis
aaacttttacggtttttatggctaaggaggtcaaaaactttgaaattagacaatttaattacgaaacttcactcgtactttagtcaaaagtttgtaagtcaacttgagaataacttcgaacaaataaaatactggactaataaaagtgatgatagctttaacgagcatttaaccactcaaaaaaatgcgcatacaactgatcaaatcaaacacaaaactacaaaaggtaaagatgtcgtattatctaatcatgaaaattatcaagatgaacttattgaacatcttgtgttaggtcataacggtgatggcaataacgaattaaaagctagtcacacatcaatggacgctcaaagtttcgattctttacaccaacgtctatatcacgactttttaagagaaagtaacgctagagaagaactaagagccgacttaactaagaaaatacaacgtattgttaacgttgatgactttggcggagatcctacaggtcaaaaggacagtacgaaagctttccaagacgcattaggtaacggcaatgtacaggtaactatgagtggtggtacttaccttacaacaggtattaaaatgcctaacaactctcgtttggtaggacaaggtaaagacattactacaattaagtttatggacgaaacacctgcagaaaatattggtatcactaacttaaaaatgagtggtggagctgaaaacatttcattagaaagtttttcgttcaacgggaataagtttagacaaaataaaacacttaaagctaccggtggttctcgttcatctaacattagatttgcgggtgtaactaatggatatatctataacgttaaatcatatgacgctttactacactgtatcgatgtaacatatgcaaatgacaattattactacgaaggcgatggaaacagagtgccttacgcattagaaagtaagcatattcatattgataattgtgaggtatatggttgcggagatgatggtatcactacccatcactctcgttacattacaatttctaattgttatgcacatacaccaacaggcggaagtaataacaacggtgtagaaattgacgatggctcacaatatgtgttcttatcaaacaacagaaccaaaggtaacttcggtggtttagaaatcaaagcacacagtaatgcaagtgctgcaagtggtgtgttcgttaacggtcacgtatcaatcgaagatacaagagcttacaacattcgacacatcggtcatcatagagctaaaacggacaataaaagtttgactgcttatgacgtggtgctaaataattgcttagctttaaaccctaaatacaatggtgtgtatccaggctcaacacctagagcattattaatcagtgcttatagaaatgtttctgtaaataactttacagctataggtgatagtgatttcggaaaattagaaggtggaaaactagataaaaaacaaccagcaatagccatccaattcatgtccgaaaacatctcgcttaataatattaatgtgcgtaactttaaaaatgcagaagtagatattagattatttggcggagataatagaccgtctagagtatcactaaataacataaatatttggaattcatctaacaatatcggtatcggtgttggaagtaaaatatacgacactaaaataactaattgtaacttacacggcaatggttcaggtataggattacgtttgacaaataaccacgctatgattagcggcgtcacagctgataattattcaacttctgcatggatagcaggagaaaagtacgacacaccacctacagtaggaaaaggcggcgctagtatagcgtctacaggaagtgctggtgtagcaaacgctagtgcagttattgcatctacaggtggttcgaaagcatacagtaatcgtagctttgtattaggttctggtgctaactccaaatcttatggttcacgtagcggtattatcaattcacttaattctgaaactgataaaaaaggccatacacaactgattatgaatagtaatcgtgttaagtcacctggtaactatcatgttgtcgctggatatggttctagtggtaatgcttctacatctaacattaaatttgatttaagcacttattcaggaaacttaactttagccggtcaacttaaacaagatagtgccgatatcgcagagttatttgagtcacaaaatggattagcaatcgatttaggaactatcgttacattagacggcgataagataagaaaagcgcaacctaatgacacaccaattggcgttatatctggaactgccgcgttggtagcgaacgaaaaaacattccaccataaagatagatttttaaaaaatgagtatggagtaacgattacaaacagaaaacaagttgaatttgtagacgatgaaggaaatgtttctttcgaatggcgtgacataccagtagaaaaccctgaatataacgacaaaatcgattatcaatcacgttcagaacgacctgaatggaatgtagtcggattattaggtcaaatctacacgaacattgaaaaagacgttataccaggcgactatatcaacggtagagcaggtgtaggatataaagataatgtgaatggtaaaggtcgtgtcatgaaaataacttctgaatacactgaagaacgtggatgtgcaatagcattagtattgtggggtgctaaataa

SEQ ID NO: 1589 - DNA, 129 bp, Staphylococcus epidermidis
cttgctattttacgtgatattaatttaatttctttacatattcatcttgatagatgtcacttaaatgtcaattttatcgaatacatttatcatatcgccaataatcaagcgttcattataactatttaa

SEQ ID NO: 1590 - DNA, 126 bp, Staphylococcus epidermidis
accatcggacgaatttcaggtggtataataggtaatacatctaaaatcatccaagaaggattattcccagaatttctaaatgactcaactacctctaaacgtttaatcgcacgtgttaatctttga

SEQ ID NO: 1591 - DNA, 402 bp, Staphylococcus epidermidis
atccatcagcgtggactgatacagattatatttacggtcaatatgaatggacggagtgatgaaatgaaagtagtttatttatggaaaaatggacaagcaattattgttcacaaaaacgaagaagatgaatatgtttatcctgatgaaaaatggacagagaaccaacctcctcaaggtattatcttaccttgctattatgacggtaaacaatgggttggacaaacccaagatgagctagaaaagatgttgcctgaagtagaaattcctgttgatgacaaagatattgctatagctaaattaactagcttagttgtcgatttacaagaagaagttatgagtttgaagcagaacatcgcactaataactgaagaacaagcaaatcaaaaattgggggaagcgtaa

SEQ ID NO: 1592 - DNA, 366 bp, Staphylococcus epidermidis
gaaatgcagctttatttgaaagatggtatggaaattagagaagttcaatttacaaatgaagaagttcaaaattattgcgaattgcttaatataaagtatgaccattatgttcctactcttatgtgtgccaagttatggccacaatttgagttatttcaatctttttcaaagaagcctatcatattaaaagagacacacattaagacacaacatcaacttcaagtcgattgtacgtatgaagcgacattgcataaggtttcacaaaaattaattaaaaatatcattaaatatacatatggactcgaaatcaataaagataaaaaacattgtatgtatataaaacaaatatttatcgaggtaagataa

SEQ ID NO: 1593 - DNA, 507 bp, Staphylococcus epidermidis
ttatctattagaagcaagtatcttgaccttaaaatcattatacgctttaatgtaactaatgaagttacattaaggtgggtaaaaatgaatttagaattcaatattgcagtacatgtactatgttttcttgctcaacacgatcaagaacaattcaatagtaaagaattagctaaattaacatgtctgaaccctgtacaacttagacgcgttctagcatatttaactgaacacaactatatcaaagttcagcgtggtaaagcaggaggctaccaagccaatcaacatactgctcaagtagatttagccaagttatatcaacactttgttttagataaaaataatagccaaagacgatttactggcgcttctgacagtcattgtcaaatttctaagaaaattgctcatacaatgtcacattattattctcaagaacatcaaataatattagatttttacaaagataaaaatattacagatgttttggcagatattttacaggaggggtaa

SEQ ID NO: 1594 - DNA, 129 bp, Staphylococcus epidermidis
aaaatcaatagtaaaatttcatctttgctaactacgctattattatttgttttattttatacattcataacgcttgtttatgtacatccatcacttataaataaaggaatatacttttctaacttataa

SEQ ID NO: 1595 - DNA, 1089 bp, Staphylococcus epidermidis
ggaagagatagaatgattcaggtaaaagcccccggaaaactttatattgcaggcgagtatgcagtaaccgaaccaggatataaatctattcttattgcagtaaatcgctttgtaacggcgacaattgaggcgtcaaataaagttgaaggtagtattcattccaaaacattacattatgaaccagttaaatttgaccgtaatgaagatagaattgaaatctcagatgttcaagctgctaagcaactgaaatatgttgtgacagctatagaagtgtttgaacagtatgtgcgcagttgcaatatgaatttaaagcactttcatttaaccattgatagtaacttagcagataactctggtcagaagtacggattaggttcaagcgccgctgttttagtatctgttgttaaagctttgaatgaattctatggtttggaattatcaaacctttatatttataaattagctgtaattgcaaatatgaaattacaaagtttaagttcatgtggtgatattgcggttagtgtctacagtggttggcttgcatatagtacgttcgaccatgactgggtgaaacagcaaatggaagaaacatcggtgaatgatgttttggaaaaaaattggccaggcttacatatcgaacctttacaagctcccgaaaatatggaagtccttattggatggactgggtccccagcttcttctccacacttagtgagtgaagtcaaacgtttaaaatcagatccaagtttttatggtgattttttagatcaatctcatgcttgtgtagaaagtttaatccaagcttttaaaactaataatatcaaaggtgttcaaaagatgatacgtataaacagacgtattattcaatctatggataacgaagcatcagttgaaattgaaacagataagctaaaaaaattatgtgatgtcggtgaaaagcacggtggcgcttctaaaacttcaggtgctggtggtggcgattgcggcattactattatcaataaggtaattgataaaaatattatttataacgaatggcaaatgaatgatatcaaaccattgaaatttaaaatttaccatggacaataa

SEQ ID NO: 1596 - DNA, 2118 bp, Staphylococcus epidermidis
tacttattcagtaaatactggaaggagaaaaaatacatggcaagagacttttctttgaaaaatactcgtaatatcggtatcatggctcacattgatgctggtaagacaactacgactgaacgtattctttactacacaggtcgtatccataaaattggtgaaacacatgaaggtgcttcacaaatggactggatggaacaagagcaagaccgtggtattactatcacatctgctgctacaactgcacaatggcaaggtcaccgtgtaaacatcattgatactcctggacacgtagacttcacagttgaagttgaacgttcattacgtgtacttgatggtgccgttactgtacttgatgcacaatcaggtgtagaacctcaaactgaaacagtttggcgtcaagcaacaacttatggtgtacctcgtattgtttttgtaaacaaaatggacaaattaggtgcgaactttgaatattcagtaagcactttacatgatcgtttacaagcaaatgcagcacctattcaattacctattggtgcagaagatgaatttgaagcaatcattgacttagtagaaatgaaatgctttaaatatacaaacgacctaggtacagaaatcgatgaaatcgaaattccagaagaccataaagaaagagctgaagaagctcgcgctcaattaattgaagctgttgctgaaaacaacgacgatttaatggagaaatatcttggggatgaagagatttcagttgatgaattaaaagatgctatccgccaagctactactgacgtagaattctacccagtactttgtggtacagcgttcaaaaacaaaggtgttcaattaatgcttaatgcagtaattgattatttaccttcaccattagatgttaaaccaattattggtcatcgtgcgaacaaccctgatgaagaagttgttgctaaaccagatgattcagcagaatttgctgctttggcatttaaagttatgactgacccttatgttggtaaattaacattcttccgtgtatactctggaacattatcttcaggttcatatgtgaagaactcttctaaagataaacgtgaacgtgttggacgtttattacaaatgcacgcgaactcacgtcaagaaattgacactgtttattcaggtgaaattgcagctgcagtaggccttaaagaaacaggtactggtgatactttatgtggagagaaaaatgacattatcttggaatcaatggaattcccagaaccagttatccacttatcagttgaaccaaaatctaaagctgaccaagataaaatgactcaagctttagttaaattacaagaagaagacccaacattccatgcacacacagatgaagaaactggacaagttatcatcggtggtatgggtgaattacacttagatattttagttgaccgtatgaagaaagaattcaacgttgaatgtaacgtaggtgctccaatggtttcttatcgtgaaacatttaaacaacctgcacaagttcaaggtaaattctcacgtcaatctggtggtcgtggtcaatatggtgatgttcatattgaattcactcctaacgaaacaggtggcggtttcgaattcgaaaacgctattgttggtggtgtagttcctcgtgaatacattccatcagttgaacaaggtcttaaagatgctatggaaaatggtgtcttagctggttatccattaattgatgttaaagctaaattatttgatggttcttatcatgatgtcgattcatctgaaatggccttcaaaattgctgcatcattagcgcttaaagaagctgctaaaaaatgtgatccagttatcttagaaccaatgatgaaagttactatcgaaatgcctgaagaatatatgggtgatatcatgggtgacgtgactgctcgtcgtggacgtgtagacggtatggaaccacgtggtaatgctcaagttgttaacgcatatgtaccactttcagaaatgtttggttatgcaacttcattacgttctaacacgcaaggtcgcggtacttacacaatgtactttgaccactatgcagaagttcctaaatcaattgctgaagaaatcatcaagaaaaataaaggtgaataa

SEQ ID NO: 1597 - DNA, 273 bp, Staphylococcus epidermidis
gttatatacagttctcaaaagagaacgaacggaggtgaaaacatggtacttaacttaaaaagattgagagcagaaagaatagcttgcggaataactcaagatgagatggcacaaatgatgggatggaaaacaagaactccatatgctaaaagagaaaacgggattgtggatattggagctaatgagtttattaaaatggctaaaatattaggctacgaaacaaataatttagatatttttttcactcaagtcgttcccaaaaaagaacagtaa

SEQ ID NO: 1598 - DNA, 246 bp, Staphylococcus epidermidis
ctttgcaacagaacctgttttcttatatatctccttaatacacgctattttcaccaacaatttttccaaagtgttgcattttccaacgacgtaaaacttttaatggtaccgaacgtgggtataacttgttacattatcaaatgtaacattttaaatatgcttaatttgaggtatcgatttaatgtaattgctcacaaaacatcagcacactacccatactttaagcgatataaattaatgaaatag

SEQ ID NO: 1599 - DNA, 183 bp, Staphylococcus epidermidis
ggagtgagcaggttgattaaacgaatattaaagatttggtttactatcgcaatgtatgagttgggcaaatggattggcagagaagtttattataagttaactgcaaatgatgaggtggaagtgcctaaggactttgacgagaatgaccacgctcatttaaatggcatatacggaggttattaa

SEQ ID NO: 1600 - DNA, 642 bp, Staphylococcus epidermidis
cgattgataaggagtggtcaaatggacattgtaggaatgcagtttaattatcttaaagttctagagttttatggcagaaataaacataaaaagaaactatataaatgttactgtacgagatgcggtaataaaaaaataatgattggtaccgaagtgaaaaatggttattctaaaagttgtggttgtttgaataaagttagtcattctaaaaaacatggtatgactggaactttaatttataataaatggaaaggtatgaagcaacgatgttacaactctaactatgatttttacagcgcatatggcggtagaggtataaaggtttgtgatgagtggaaagatgactttatgcaattctacaaagatatgggggatgtaccattcgaaggtgctgaattagacagaattaacaacgatgacgattataaaccatcaaattgcagatgggttagtcatgaagaaaatgcaaacaatcgacgaaaatatcataataagacaggatatacaggagtaacttacaaaccacatctaaacaaatatcaagcgcagctttacaaaaacaagaaatttatatacttaggtgtttatgaaactgcagaagaagcacacttagcttataaaaaagctaaaaatgaatattaa

SEQ ID NO: 1601 - DNA, 270 bp, Staphylococcus epidermidis
atgaaacgaagtggaggcaaccagatgggacttatcgacggacttaaaaagcaatacacgttatatcagattgacggttggaagatgtgcagtgtaacgccgttaggggaagatacattcaaactaggtaactatgcaggcatacactttagaaacacattctcaggaacagtaacgaaagatgaactagaaaaactgaaacgcaaacataagcttttcagaaaagaagaactgcaacaacaaatgacaattaacgaattattattttga

SEQ ID NO: 1602 - DNA, 210 bp, Staphylococcus epidermidis
atgaaacgaagttcatacctacgtcgtcaatcaaatttaattatatctatgattattttcgttatttttttaattgtagatatcaatgtacttattaataaacatcaagttgtgcctgtgctattatcaagtatcagtttaattatttttatcatgctatttgtagttgcattgttcaaatgtataactaattataaacatcaatcttag

SEQ ID NO: 1603 - DNA, 783 bp, Staphylococcus epidermidis
gtacctatgagccatagttataattctatagaagaggtgctcaaagctgtaaaatcaaatcaactatctattaatgatgctaaagcccaactcagtcattatgacgaattgggctttgctaaaattgacttacatagagcacagcgtcaaggatttcccgaagttatctttgggcaaggaaaaacaaaagaacaaatcactaaaatcatctctagtttgatatttcataatgaagttattctagtgacacgtgttgatgaaatgaaagcaaaatacattttacaacattatccaaacttggaatatcatcaaactgcacagttaattagcactccactaaaagatataccacaatctaaatactatgtttctgtactttgtgctggaacttctgatttacctattgcagaagaagctgcattaaccgctgaaatcatgggagtaagtgtaaaacgattttatgatgtcggggtttcaggtattcatcgcttattatccaacattcatgatatacgcagagggaaagtttctatcgttatagctggaatggaaggcgctttagcaagtgttgttggaggattagtcaaccaccctgtatatgcagtaccaacgagtgtaggttatggagcaaacttgaatggggttaccaccctattatcaatgataaatagttgcgcacccggaaccagcgtattaaatatcaataatggatttggtggcggttacaacgctgcacagattattcatatgctagaaaataaagagagtgaggtatctttatga

SEQ ID NO: 1604 - DNA, 198 bp, Staphylococcus epidermidis
gtgatttggaggcttgcaatggacaatagagagtttatccaacgctgcatagtatcatctacagcttttacaggacacgatgggtgtttactaatcaaagagcttaacgaagtatatcgcaaggcagagttgtacgacaaaatagtggaaaataattcaaagagtttagtagaaaatggaggaacaataaatgactaa

SEQ ID NO: 1605 - DNA, 3123 bp, Staphylococcus epidermidis
tcaaagaggaggttagccatgaacaaaaactttatggctcgtatatcggcgattattacagattttcaacggaatatcagaaaagctcaacgtatggcaaaaactgaaatacccgatgaaattgaaacacaagtcgacgccaacataagtaaatttaaacgagccttaaatactgctaaagcaatggctcaacgttggcgagaacataccgttgatatagacggaaacgccaaccctgttaaacgagcaattgcagtagttagagaaaaactacaacagttaagagataaagaagtagacatcaaagggaataacaatcccttaaaacgttctgtactaggtgctaaagctatgcttgcaaccttacatgataaaacagtacacgttaactttgacacaagaggtatgacgagagcacaagtgctgacaagagcgttaggtcaatcgttagatgaatacggcgataaaatggacgccttagcaactaagataagaacattcggtactgtattcggacaacaaatcaaaggtatgttaattgcgagttttcaagggcttattcctatcatagctggattagtacctgcaatcatggcagtagctaacgcattaggtgtagttgctggtggtgcattaggagtagctggtgcatttggtattgctgcgagtggtgcgttcgcatttggtgctatggcagtaagtgcaattaaaatgttgaatgacggaacattacaagctactgcgcaaacaagaagataccaagcgtctttagaacaagttaaatcaacgtgggaaggcattatcaaacaaaatcaagctcaaatattcaatacgttatctaacgctttagatactgttaacgtagctttaggacgtatgaaaccattcttagcaggtatctctaaaggaatggaacaagcgtcacagagcgtcttaaaatgggctcaaaacagtcaaactgcgagtaagttctttaacatgatgaatacaacaggtgttaagacgtttaacacattattaagtgctgcaggacgttttggcgatggacttataaatgtgtttacacagttaggtccattattcttatggactgctaaaggtttagataatttaggtaagaagtttcaaaactgggctaacagtgtagcaggtcaaaatgctattaaatcattcattgaatacacacagactaatttacctaaaataggccaaatattcggcaatgtattcatgggtattggcaacttgatgaaagcatttgctcaaaacagttctaatatttttgattggttagttaaaatgactgccaagtttagagaatggtctgaacaagttggtaaatcagagggctttaaaaagtttgtacagtatgtacaagagaacggaccggttattatggatctaatcggtaatatcgtaagagtgttagttgcgtttggtactgctatggcaccaatagcaagtgtgatattaaaagtagtaacggcgttagctggtttcatcgctaagttgttcgaaacacaccctgctatagcgcgtatggttggtataggtatgatactcggtggtatgttgtgggctttattagctccaatcatcgcagtgagtacagtgttatctaatgtgtttggtgtaggtttaatccaagctatcggtaaaatgttagcttttgctagaaacactcaaatacttagaagtgcattaaacttagtgaaaatagccttcaggctccttatgagccctattagtacaattatgcgtatcttacctatgttaagtggtgctttccaagcattaggagtagctataggtgcgatttcatggcctgtattagctattataggcgttattgtcgctttaataggtattattgtttggttatggaaaacaaacgagaatttcagaaaaacttgcattgaagcttggaacacgattaaagatacgataatgaacgctgtaaaatcagtgattaactggtttaatcagttcagagcgtctatacaacaaacattgcaacctattattcctatcttacaaatgttaggtcaagtagctaaccaagttttaggcttcttattcatcagtcttattaacggtgtagtaatggcgttccaatatctatggactatcgtttcagtagtattcactgcgataggtggaattctacaagctgcgtcacaattattcattggattagctacagcatggatacaacttttatcaggcgacatacctggagcgtggcagacattacaaactatgacgcaaaacgtgatgaataccatttggaataccatattgtcaatctggaaccaaatttctaacttcatattcaacgttttaaacagaatactcggtactaacatcacaagttggaaccaaatttggtctgcgatttcaggtgcagttactagaatttggaatactgtagcaagttggttttcacgtgtagtttcaacagttgctcaaaaaatgatgcaagcgctcagtcgtattatttctggtggtgcacaatgggtttcaagcatcatttctgcaatgagtagatttttacaagcagtagttagtggtttcttcagagtggtcggcgctgttggaaatggcatgagaaacgcattaaatcgagcgcgcagttttattggtcatttctatcaagtaggcgttgatatgatagctggaatgataagaggtatcgttcaaaaagctaaagatttagcagcagctgcatggaacgctgcaaaaggtgcattgaacgctgcgaaaagcgctttagatagtcattctccttctcgtaaattcatacaactaggtaatgatagtatgactggattaggtatgggtatctctgaatatgcaggaaaagctgcaagagaaagtaaattagcggcattaaaagttatggatgccttcaacgcagacttaaaaccggactttttagaagaaggattggctggtttaggaaattctttcgatgcacatatgagtaaagacgtacgccatagcatgcaagagaacaataaacctatcgtcaacgtgactgttcgcaatgagtcagatataccagctattaaatcatacattgaagattccaactcaaaagacgcaagtttcggattattttaa

SEQ ID NO: 1606 - DNA, 1506 bp, Staphylococcus epidermidis
ttaatatttggctatttattatccacacaattaatagtaggagtgaaaataatgagtgaacgtatcagagtaagatatgcgccaagtccaacaggatatttgcatattggtaatgcaagaacagcattattcaattatttatttgctaaacattataatggtgattttgttgttcgcatcgaagatacagatagtaaacgtaatttagaagatggtgaatcttcacaattcgataatctaaaatggttaggtttggattgggatgaatctgtcgataaagataaaggttttggaccttatcgtcaatctgaacgtgcagaaatctataatccactaattcaacagctattagaggaagacaaagcatataaatgttatatgactgaagaagagttagaagcagagcgtgaagctcaaattgctcgtggagagatgccaagatatggtggacaacatgcgcacttaacagaagaacagcgtcaacagtacgaagcggaggggcgtaaaccatcaattcgtttccgtgtgcctaaagatcaaacatatactttcaatgacatggttaaaggagaaatttcctttgaatctgacaatatcggagactgggtaattgtaaaaaaagatggtgttccgacttataattttgcagttgccgtagatgatcattatatgcaaatatcagatgttatacgtggtgatgaccatgtttcaaatacacctaagcagttaatgatatatgaagcatttggatgggaagcacctcgttttggtcatatgtcactcattgttaatgaagagcgtaaaaaattaagcaagcgagatggtcaaatcctacaatttatcgagcaatatcgtgacttaggatatcttccagaagcattatttaactttattacattgttaggttggtcacctgaaggtgaagaggaaatcttttctaaagaagaatttataaagatttttgatgaaaaacgcttgtctaagtctccagctatgttcgatagacaaaaacttgcttgggttaacaatcagtatatgaaaacaaaagatacagaaacagtattcgaacttgcattacctcatttaatcaaggctaatcttatacctgaaaacccatcagaaaaggatagagaatggggacgtaaattaatagcgttgtatcaaaaagaaatgagttacgctggtgaaattgttccattatcagaaatgttcttccatgaaatgccggaacttggaaaagatgaacaagaggtattacaaggagaacaagtgccagaactaatgaaccatttatatggtaaattagaatctttagaatcgtttgaggcaactgaaattaagaaaatgattaaagaagttcaaaaagaaactggtattaaaggtaaacaattatttatgcctattcgtgttgctgttactggacaaatgcatggtcctgaattacctaacacaattgaagtattaggcaaagataaagtattgtcacgcttaaaaaaccttgtttaa

SEQ ID NO: 1607 - DNA, 141 bp, Staphylococcus epidermidis
aaattaaatggcttcatatattcgaatttgcaacttaattatgtactactaacatcaaaaccacccgcgacaatcattcatgtctcaggtggttttgatttatttatttctctgctttgtgcttctttaacttttccttaa

SEQ ID NO: 1608 - DNA, 159 bp, Staphylococcus epidermidis
tttagaggtggtcaaacaatgtggggcgtaatagcaatcattatattagttttactactatttggctcattgcttgaacagaatgatctaaaacatcagttagaagtgaaagagtatgagattaagactttgaaagataagttggagaatggagggtaa

SEQ ID NO: 1609 - DNA, 387 bp, Staphylococcus epidermidis
gaagaaacaggaactattaggaggttagacattatgtcaatgactgaactagaagcaattgaaatcttagagttaataaataatgtctacgatatgaaattcaatgaaattaaatacaacctttgggtagaacaactcacacaatatggggatttcgatagaacactacacaaaacaaagaaatatgttagagaaagtcgttacaaacctacgatttcacaaattattgatcgcaaaccaccagaaatggaaagcgcagtaataccggaagaacagactgataaatacagaatgcagcacgataaagaatttagagagaaaaggcaacaattaagaaaacaatggcaaaagatgaaagaagattgggggttagatgatgagtattga

SEQ ID NO: 1610 - DNA, 771 bp, Staphylococcus epidermidis
tggatgaaaggtagtgtgaatgtggaagatatagtgatagtaggtagacacgcagttaaagaagcaattatatcaggtcacgccataaataagattttgattcaagacggtataaaaaagcaacaaattaacgacattttaaaaaatgcaaaatcacaaaaattaattgtacaaacggtaccaaaatctaaattagattttttagcaaatgcacctcaccagggtgtggctgctttagtagccccatatgaatatgcaaacttcgatgaatttttacaaaaacaaaagaaaaaagcccgttattcaactgttatcattttagatggtttagaagacccgcataatcttggctctatattaagaacagcagatgcttctggtgttgatgcggttattatacctaaaagacgatcagttgcgctaacacagaccgttgcaaaagcttctacaggagcgattcagcatgttccggttataagggttactaatctttcgaaaactatcgacgaattaaaagacaacggcttttggattgcggggacagaagctaataatgcaacggattatagagatttacaagcagatatgtcactaggtattgtaataggtagtgaggggcaaggtatgagtcgtttagtgagtgataagtgtgattttcatattaagattccaatggttggacatgtcaatagcttgaacgcgtctgtggctgcaagtttaatgatgtatgaagtatatcgtaaacgtcatcagttagaggaaaagtcatga

SEQ ID NO: 1611 - DNA, 699 bp, Staphylococcus epidermidis
gaagtgggagggttaaatgtgatttacatgtacgaaccatttactcacacggtgactaagacagacttatctcatctgcacaatattacaggtattcccctcaacacactgtggtaccaaaaagaacgtggcacatataacgataagttgaagtgcttctttaccgacacaatgccgagagtgaataagaaacaggtgttcaacgaaagtgttgtagcaaaagatgaaatttggaagtatagcgagaagtatgatctatacgtaagtaacttaggcagaatgaaaagacctgatggaaaatacaagtttgcgaatggatgtaacggtatttccacagtcatttataagaataagaagtatcgtgcagcagatattgtatatgaaacatttatcggcaatttgagaacagggtatcacgcttatcctaaggacagtagatacaacaatcttatggcagataacttattccaatctacattgcaaaaatatagagtgtatcgcagaaataaaggcatatctaagccagtatatcttgtcgataacaacaaccgaattgttgaagaattcgcaagtacagtagaagctcaaaaattattattcatagacagacgcaacatcgcaaggaagtgtaaccgtaaacatgtaagtgacggattgatgtatatgtgggcagacgaatacgaggagttaaacgcataa

SEQ ID NO: 1612 - DNA, 204 bp, Staphylococcus epidermidis
agaggcaagggaggtataaacaacatgattatctacagaagaaatatagaaaatggaacacccatttatgaaatcataactaaaactttcaagacaattactataaagtgtgatgaaacttttaataagtatgaaatctatcaattgctctctctactagagaatgacgttgacaacatgccgacaagttactcatatcgttaa

SEQ ID NO: 1613 - DNA, 144 bp, Staphylococcus epidermidis
aagagttttataatattaaagtgttgtgaaaacttaaacaaaaagttattatgcccttttgttgttattttacttttaaatagttataatgaacgcttgattattggcgatatgataaatgtattcgataaaattgacatttaa

SEQ ID NO: 1614 - DNA, 1197 bp, Staphylococcus epidermidis
ggtatctttatgacaaaagcattatatttagattgccacgcaggtattgccggagatatgctactttctgctttagttgatttaggagcaaaccctgaagacattgaatcagaactaaaaaaattacctttagatcaatttaagctacattttcaaaaaagagtaaaacaaggtattcatgcaatgacattaaacattgatgttaaagaagcaaatcatcatcgtcacgttaatgatatatttaaaatgatagatgacagtacacttccggaaagggttaaatatcgcagtaagaaaatttttgaaatcattggtcaagcagaagctaaaattcatggcatgtcgtttgaagaagttcactttcatgaagtgggggcaatggactctattatagatattattggtgggtgtattgcactagaacaactagggattaacacattatactgttcagctattccaacaggtcatggtaaaatcaatattgctcatggcatttatccaatccctgcaccagctactgctgaaattcttaaaggtataccaatcgcacattttgatgttcaaagtgaactcacaacccctactggtgctgcatttgctaagggacttgtttcatcgtttgggccatttccttcagcaacaatacaacatataggctatggcgccggcagtaaggattttgatttccctaatatattaagggttattcaatttgaatctgaattcgagcaacaagatagcgtccaagtaatagagtgtcaaatagatgatatgacacctgaagcattaggttattttatgaataatgcgttagagcaaggtgctttagatgcttactatacgcctatatttatgaaaaaaagtcgcccaagcacgcagttaacgttaatatgtaaattacatgataagacatatttcgaacaacttatcttacaagaaacaagttctttaggcgtcagaagtacttctgttaatagaaagaccttgaaccgcgcattcaaaattctttctacacaacacggcactgtttccattaaatttggcctacaaaatggaaaaattatgaaaatgaaacccgagtatgaagatttgaagaaaatagctaaaactacaaaacaaccgtttcaagtaattcataacgaggtattacaacaactctatcaaacatatcatataggaaatatacttcaataa

SEQ ID NO: 1615 - DNA, 1500 bp, Staphylococcus epidermidis
gttttatttatggaaaataaaaataacaatgtagatagaggtaaccttaagcagaatctttccgagaaatttgtatgggctattgcatatggttcgtgtatcggatggggcgcttttatattaccaggagattggattaaacaatcagggcctattgcttcttcaataggtatagtaatcggtgcgttattgatgattcttattgctgtaagttatggcgcactcgttgaaaaatttcctgtttctggtggcgcatttgcttttagttttttaagttttggaagatatgtaagctttttctcttcatggtttttaacatttggctatgtttgtgttgttgcgttaaatgcgacagcattcagtttgttgattaaatttttattaccaaatgttttgaacaacggtaagttatatacagtagctggttgggatgtttacataactgaaattgttatcgcaactgtgctacttatagtgtttatgttgattactattagaggtgccagtgtgtctggttcgttacaatattacttctgtgttgcaatggtccttgtagttgcacttatgtttataggttctttctttagcagtcactttagtttgagtcatttagagccattagcgagtgtagataaaggatggtttcaatcaatcattatgattgtctctattgcaccatgggcgtacgtagggtttgataatataccgcaaactgctgaagaatttaacttttctcctaacaagacgtttaaacttattgtttatagtttactagctgcgtcactcacttatgtagtgatgttactttacacaggctggctaagtacacaagcaacaagtttaaatggtaacttatggcttacaggtgcagtgactcaagatgcattcggttttattggccttgcagtattagcagtggcaattattatggggatttttactggattaaatggatttttaatgagttcgagtcgcttattattttcaatggggcgctctggcattatgccaacagtatttagtaaattacacagtaaacataaaacaccatatgtcgctattatcttcctagtagctgtatctttaattgctccttggttaggtagaacggcattaacatggattgtagatatgtcatctacaggtgtttcaattgcatattttattacttgtttatctgctacgaaattatttagttttaataaacagagtaatacgtatgcaccagtttataaaatttttggtattataggatcgattgtatcctttgtgttcttatgtttattgcttattccaggttctcctgcagcactttcgataccatcatacatcgctttaggaatttggttggtaataggattaatcttttttatcattcgcttgccaaaacttaagaaaatgaataatgatgaattgagtcgattgattttaaatcattctgaagacgaagttttagagatggttcatgaacctggtcaatctaattcaacgaataaatag

SEQ ID NO: 1616 - DNA, 168 bp, Staphylococcus epidermidis
gcgaaaattatgagccataaaattctagtacagaaattttcagacgaaaatatttgtgccagagttatcattcaagagtgggacgatgcgtttagtttaatttatgtcccactcttttcttttttgctacaaattatagatattgtaataattactatgaaattttga

SEQ ID NO: 1617 - DNA, 1164 bp, Staphylococcus epidermidis
tggagagttataaaaatgaaacaacctgttattattgcagcaaaacgtatagctttcggtaagtatggtggccgattgaggcatttagaacctgaatcattactagaacctttatttaatcattttacagatcagtatccaaaagtaatgtctcttttggatgacgtcattttaggtaatacggtaggtaatggggggaatttagctagaaaatcattacttgaagcgggattagattttaaaatacctggtataacaattgatcgtcaatgtggctcaggtcttgaagccgttatacaagcctgtaggatggtacaaagtggtgctggaacaatatatattgcaggtggtgttgagagtaccagtagagcaccttggaaaatcaaacgtccgcagtcagtttatgaatctgagtttccacaattttttgaacgggcgccttttgcaagagaaggagaagacccttcaatgattgaagcagccgaaaatgtagcgaagaaatatcatatcagtagaaatgaacaagatgactttgcgtatcgcagtcatcagttggcatcaaaaaatatgaataacggtaatatttcccaagaaattttaccgttcaaagtgaaaggtgaatattttaatcaagatgaaagtattaaacctcaacttactctcagaacacttggcagacttaaaccacttttaaatgaaggaacagtcacagtaggaaatagttgtaagaaaaatgatggtgcagtattactgattgttatggaagaaaatcgggcacgtcaattaggattcacagaagggattaagtttgtgaatagtgcaactgtaggtgttcaaccacagtatttaggagtaggtccagtgccagcagtaaatcaattattagctcaagaacgattaactataaatgatataaatgcagtagaattaaatgaagcatttagctctcaagttattgcgagccaacaacagcttaacattcctttgaataagttgaattgttggggaggagcaattgctacagggcatccatatggtgcaagtggagcagcgttagtcacacgtttattttatatgaaacatcaatttagaactatagcaactatgggaataggtggagggataggaaatgcagctttatttgaaagatggtatggaaattag

SEQ ID NO: 1618 - DNA, 1245 bp, Staphylococcus epidermidis
tatagaattttattaacttatgtacggaagtatagacactcgattaatatcggatgtataccgactaaaacattaattcatgatggtattgaaggtagttcattcaaagaggctattactagaaaaaaagaagtcgtacaggcattgaataacaagaactatcaaggcttaaattcaaaggacaatatagatgttctaaattataaagctaattttatttctaacgaggtaatagaactacaagataataatggaacaattcaagaaacaattacagcagataagatagtaatcaacactggttcacgtgcaaatatcccagatatcaaagggatagatacagctcaaaatatatatgattctactggattactaaatattgactatcaacctcaagaacttgttattattggtggtggttatatcgctctcgaattcgcttcaatgtttgcaaattttggaacacatgtaacaattcttgagcgtggtgatgctatcatgacaaatgaagatcaagacattgcaaatcttattgtcaaagatttacaagataaaggtgtgactataaacactaatactagtactattgcattttcaaacaataaagatcaaactatcatacacacaaatcatggagaaatatcagctgatactgtgctcttagccacaggtcgtaagccaaatacaaatcacttaggtcttgaaaatacagatgtaaaaatcggaaaacaaggtgaagtaattgtaaatacacatttgcaaagtacagtgaaacacatatacgctgcaggtgatgttaaaggtggattgcaatttacgtatatttcactcgatgattatagaatcattaaatcacatctatttggtgatggttctagaacaactgaaaatcgtggtgcaataccttatacggtctttattgatcctcctctatctagagtaggactaattgcaagtgaggcgaaattacaaggatacgatattctagaaaataaagtctttgtcagtaacataccccgtcacaaaatcaataatgattccagaggtttatttaaagcagtaattaataaagatacaaaagaaattttaggagcgtcattatatggcaaagaatcagaagaactgattagcttaatcaaacttgctatagatcaacatattccttacacagtattaagagataatatatacacacatccgacaatgaccgaatcctttaatgacttgtttttagaaccactttga

SEQ ID NO: 1619 - DNA, 501 bp, Staphylococcus epidermidis
atgtctgctatcattgaagcaaaaaaacaacaagtcgatactatcgctgaacaacttaaaaattcagtttcaacagttatcgttgactaccgtggtttaactgtagcagaagttactgaattacgttcacaattacgtgaagcaggtgttgagtataaagtatacaaaaacactatggttcgtcgtgctgctgaacaagcaggtatcgaaggcttggatgaattcttaacaggtcctacagcaatcgcaacttctactgaagatgttgttgcaccagcaaaagttattgcaggatttgcaaaagaacatgaagctttagaagttaaaacaggcgttatggaaggtaacgttatctctgctgaagaagttaaaacagttggttcattaccttcacacgatggtcttgtatctatgcttttatctgtattacaagcacctgtacgcaacttcgcttatgcagttaaagctgttggagaacaaaaagaagaaagcgctgaataa

SEQ ID NO: 1620 - DNA, 183 bp, Staphylococcus epidermidis
ctattgattttagtctgtaattttttgttgactttttatactaaagcagttatattaatacttgtgattattttacctaagacagtagcagttattaataacttaaaacagtatcctaccgaggctaaaattgacttgaacgtgatgattaatgatctttcaagcactttttgccgtgggtag

SEQ ID NO: 1621 - DNA, 126 bp, Staphylococcus epidermidis
tcacttcatataatcatgttacaatatgacaatctttacaatttaatggtaaaagttcatgagttaattcactcaccttttagggtatactatactctcgaggtgagttttatttatggaaaataa

SEQ ID NO: 1622 - DNA, 129 bp, Staphylococcus epidermidis
tttattcatatattttattttttaactatatatatatatcatgtcagtgaaaagtcatcgctcttaatcacaccttataattttggggatgaaggtgtttattttaaaaatcttaattggaggggataa

SEQ ID NO: 1623 - DNA, 843 bp, Staphylococcus epidermidis
ggtgttcatatgacaaataatcactttcttaacataggtgtgttactgtatggatgtggtcatcatcaagcggcatggcgtatgaaagattctaatattgaggatatcggcaacatatcttattatcagcatttagctcaaatagctgaaaaaggtcttttggatatcgtcttttttgcagataatcaagcctttaatgcaagtgataatactactatgcccgctttttggtttgatcctataattaacttatcagctattgcacaagttacatcacatataggattagtgccaacaatatcgagtacattttcaaatccattcaccgcttctcgtcaattattaagtctagactacttatctcatggccgtgtgggttggaatttagtcacatccatgacagatattgaagcccaaaatcacagtcttcaatacttaccagaaagacatgagcgctacaaaaaagcagatgaatttgcatcggtaatgaatcagctattcacttcttggtcaactgcatcttatgtaccagataaaaacaacaacaaaattattgagtctaaagatattaaacctttttatcatgagggagactattttcaagtacgaggaccacatacaacaccacaaagtcctcaaggtaaaccagtatctatgcaagccggtgcgtcaaaagaaggtattgcattagcagcaaaatatgctgatgctgtttactctgtttcatgggatatcaagcaagcacgtagttataaaaagaaattgtctgatgctatttctaaaactcaacatccagatagaaaaattaaaattttccctggtttaagtaacttatgtaggtga

SEQ ID NO: 1624 - DNA, 447 bp, Staphylococcus epidermidis
atcatgagtattaaagatttgaatagaggcgatagaatcagaatgcaagaagttaatggtgttgaaattacagtgcaaataaaaaatgtttatcgtttagttcagtcaagtcttgatatggataaatgggttgctgatgtagaagcaattgacgggagaacttggactattgatgattgttatgatttttactcattacctaatggaaatgaaggaactaaaaagacattagatgacaaggttaaccacccgtcgcattacacgtatggagatatggaaattatagatttcatagagcaggtcactaaagattacaaaccagagttagcatttgcgattggtaatgcaatcaagtatataagtcgtgctaatcgtaagaacggtaaagaagatttagacaaggcgcgttggtacctgaatagagcatttgagaagtgggagggttaa

SEQ ID NO: 1625 - DNA, 1251 bp, Staphylococcus epidermidis
atgatgagtattgatgtattgagtaccgaagaatctataatatctaacctcatgcgtaatccagaattactaggtaaattcagattaaagcctgaaatgtttactgacgagaaattaagagtgttcattgagtatgtgttagagcaaggcaaagtcgatgtaaatcaaatctactttaaaagtcgtgatgataatgaatttatatctactgaccgattaggtcgtttatacaattcagacggcactgacaaggcgttttttatggacgaccaattgaatctattacaagaatacgtcttgtcacaggctcgtgagaagctcacagagtatcaatcaatgccaagtaaagaaaattttaattatttggtagaggaattagagaaattaaaaggtatgacaataaaaaaatcagacgctaccgatagttttttagctgaagttgtagaaaatattctatctgatgaaccaaaacaatttattaaaactggtattgcttctatagataacaaaatcattggctttgaaccaggtcagttgaatgtattaggtgcaagaccttcgttaggtaaaacttctcttgcattaacaatgatgtggaatatcgcgcagcgtggatatcctacaacgttctttagtttagaaactggaggtaacaatatcgttgagagattagttgcaacaataacaaatattccactatctaaaatcaagcaaggtaacggattaaatgatgatgaagtttcatcggtaatgtctgctatagatcaaattaaaaaatgtaattctttgaagattgaggaccaagcacaaatgacaccacaagacgttcgagaagttgcttcacagaaagcagataagcctcacgttatatttattgattatcttacactcatgcaatcagatgtacctcaacgtgatagacgattagaagttgaaaagatttctcgtgatttaaaaattatagctaaagaaacaggttgtatcattatcgcactatctcaattaagtagaggtgtagaaagtcgtagtgataagcgtccgatgatgtctgatttaagagaagcaggaggaattgagcaagacgcgaatatgattttcttcttataccgtgacgattattacgaccaagaccaacaagacaacattacaggcaagtcggaaattgaattcattatttctaaaaataaagacggagaaacaggggtagcacaccttgatttctacaagaaaacgcagaggttttatggatga

SEQ ID NO: 1626 - DNA, 1245 bp, Staphylococcus epidermidis
gaaactatcatgagagataaatttgaaataacttttattaagaataggagagatttaataatggcaaaagaaaaatttgatcgctcaaaagaacatgccaatattggtactatcggtcacgttgaccatggtaaaacaactttaacagctgctatcgcaactgtattagctaaaaatggtgacactgttgcacaatcatacgatatgattgacaacgctccagaagaaaaagaacgtggtattacaatcaatactgcacatatcgaataccaaactgacaaacgtcactatgctcacgttgactgcccaggacacgctgactatgttaaaaacatgatcactggtgcagctcaaatggacggcggtatcttagttgtatctgctgctgacggtccaatgccacaaactcgtgaacacatcttattatcacgtaacgttggtgtaccagcattagttgtattcttaaacaaagttgacatggtagacgacgaagaattattagaattagttgaaatggaagttcgtgacttattaagcgaatatgacttcccaggtgacgatgtacctgtaatcgctggttctgcattaaaagcattagaaggcgatgctgaatacgaacaaaaaatcttagacttaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtatgcacgaaacttctaaaacaactgttactggtgtagaaatgttccgtaaattattagactacgctgaagctggtgacaacatcggtgctttattacgtggtgttgcacgtgaagacgtacaacgtggtcaagtattagctgctcctggttctattacaccacacacaaaattcaaagctgaagtatacgtattatctaaagatgaaggtggacgtcacactccattcttcactaactatcgcccacaattctatttccgtactactgacgtaactggtgttgtaaacttaccagaaggtacagaaatggttatgcctggcgacaacgttgaaatgacagttgaattaatcgctccaatcgctatcgaagacggaactcgtttctcaattcgtgaaggtggacgtactgttggatcaggcgttgtaactgaaatctttgaataa

SEQ ID NO: 1627 - DNA, 135 bp, Staphylococcus epidermidis
tatctaatcatcagaaatcaaagtatagagtggagcgcaggagaaggattcacctgcataagaaccactaatgatcagagatcaaagtatagagtggaacgcaggagaaggattcacctgcataagaaccactaa

SEQ ID NO: 1628 - DNA, 477 bp, Staphylococcus epidermidis
gtgaaacccatgaaaaaagcattatcaaaaaaagcagaacttgatcaaaaattacccattgaagatgctttaaagcaactcagtttttttgttcaacaagattgttcagattgggaattagatgaaccagttcctcccttacctcctgctaaaaatttcaaaggtccgattggtcgatatgaaacagttttagccattataaaagataaacaaccgactgtaagagaattattaggttacttaagtgccggtggtggtcatcttactcttataggtacacctgaggagatagtggatgagatggagcagtggtttaatgaaggcgttgcagacggctttaatctgatgccaccttcattaccccatagccttgaagattttttaaaatacattataccagaactacaacgtcgtgctttatttaaaaattcttataatcaatctacactacgtacattattaaatctcgactcataa

SEQ ID NO: 1629 - DNA, 690 bp, Staphylococcus epidermidis
aaaggagtcttttgtatgaactatttcagatataaacaatttaacaaggatgttatcactgtagccgttggctactatctaagatatgcattgagttatcgtgatatatctgaaatattaagggaacgtggtgtaaacgttcatcattcaacggtctatcgttgggttcaagaatatgccccgattttatatcagatttggaagaaaaagcataaaaaagcttatgacaaatggcgtattgatgagacgtacatcaatataaaaggaaaatggaactatttatatcgtgccattgatgcagagggacatacattagatatttggttgcgtaagcaacgagataatcattcagcatatgtatttatcaaacgtctcattaaacaatttggtaaatctcaaaaggtaattacagatcaggcaccttcaacgaaggtcgcaatggctaaagtcattaaagcttttaaacttaaacctgactgtcattgtacatcgaaatatctgaataatctcattgagcaagatcaccgtcatattaaagtaagaaagacaagatatcaaagtatcaatacggcaaagaatactttaaaaggtattgaatgtatttacgctctatataaaaagaaccgcaggtctcttcagatctacggattttccccatgccacgaaattagcatcatgctagcaagttaa

SEQ ID NO: 1630 - DNA, 537 bp, Staphylococcus epidermidis
cctttaataattgaagggtggtttctaatgttaataaatgtacttaatttaaatgactcacaagacggcaatcgcattaaacaaggtgacttatcgcacatgcgatacatcttgtctgacaataacaacgaagacttaaaattagaaggattgcctgcaaaagtttttctcactgacagtacaggtgtcaaatatatctacgacactacagttaggcaatatgacaatgcctatgtgtgtgatgttgtaatcaatcaaattatccctgcaaacacgtattcattagaaatatgggtggataacaagtatgtattcccgtccgacaataaagcgaaaattcaagtaacagagagtgtgattggtaggcaattgatcaatacacaaaatcatgatttatggcaagaaatgattgaatacggtgtaaaaaacggattaattaagaatcaaactgaaagcgaagaaaattttgttattggagagaacgcccctaatgacacaactaaaatttggattgatactactggaggtaatgaataa

SEQ ID NO: 1631 - DNA, 369 bp, Staphylococcus epidermidis
gtgagaataatgaacaaagaacagattctacaattgattgagcaagaattgatacaagcagatgaagctcagacagatacggaatttgaaaagcatatgtatgctatacacatgctcacatctcttgttagttctcatcaaagtcgttctacaatagagaaattaaatcattctaaaccaatgaatagtaatatcaaagatgattatgagatgaaacaacagtcttcacaaaaacatcatgtaactgcagctgaaatagaagcaatgggtggtaaagtaccacaatcaatgaaaaagcatcatacttctaataatatgatgattacagatgatcaagttggtaatggtgaatctatttttgatttttaa

SEQ ID NO: 1632 - DNA, 711 bp, Staphylococcus epidermidis
gcgcatgtaatcatgattttttttcatatgtgttggaatacctcacttatggtacaatactcattgtctatcttaacatttggagaagtgattatgaataaaccatttattgcaatcgaaggacctataggtgttggtaaatcctctcttgctcaccgattaagcaagacgtttggtttttatgaagagaaagaaattgttgatgaaaatccatttctatctgatttttatgatgatatagaaaagtggagttttcaaactgaaatgttctttttatgtaacagatataaacagattagagatattgagtcgctaaatcaaggtatagttagcgattatcatattcataaaaataaaatttttgctaaaaatactttagatgctaaagaatttgataaattcagtcgtatttttgatattttaactgaagatatcgaaatgccaaatacaattatctttttagatgctgatttagatgtattaaaatctagaattgcacaacgtaatcgtagctttgaatctcaaatagaagatgactatttacttactttaaaaaaagattatcttgcttattatgaatcattaaagaatgacggtgcaaatgtcattcgaattgatacatctcaacaagatttcgttaaaaatgattacgattaccaaaatattttaaatttagtaaaacctatgattggagaaaataaagatgaataa

SEQ ID NO: 1633 - DNA, 609 bp, Staphylococcus epidermidis
ggagtagtaataatgaaaagagaatttttacgtggtttaggtgtcgaagaagatgctattcaaaagattatcgacgaacatcatgaaggtttgcaatcttataaagaaaaagtagagaaagttgactcactaaaagaacagttggaaactgctaacgaagaaattaaaaatcgtgataatcaaatcgaagaactcaaaaacaatgttggcgataacgatgaacttaaacaagagttagagaaatataaagaacaaaacgccaactacgatcaaaaactcaaagatgttcagttgaacaaagctatcgaagtatctttagctaaagagaaagcaattaaacctgaacaagtaatcaaactaatcgataaagataatttagaagttgatgacaatggaaatgtcaaaggattagacgattacatgagtgagttcaaaaaagagaatgagcatttgtttgaacaatctaaaccaagtggacgcacaccagatgacggtaaaaacgtaaatggtgggattacacaagaagaatttaacaatatgagtgtcgcagagagaactaatctattcgttaacgatagaaaaacttacgacactctaataaacaattag

SEQ ID NO: 1634 - DNA, 687 bp, Staphylococcus epidermidis
atggtagtaataaaaaactacattacagaagatgacggtacaacaactgtagtcatcaaaggagtagaactagataacaaaacatcattacttttagacaatggttacgaagttgaagtggatgtaagggtagttgatccattcaaaattacagataagcaacgtagaaaagtgtttgctctttgtaacgatatagaatgtgcaacgggccaaccccgtgactatatgaggtatatgttcatggattacgtagaagtcctctacggctacgaaaaacgcctctctttgagcaattgtactagagaacaagctagtcaaattatagaggtcattattgactgggtgtttcataacaatatcccactcaactataaaacaagcgacttacttaagaatgataaggcgtttctttactggtcgacagtcaatcgtaagtgtgtaatatgcggtaaacctggagaattggcacatcataaagcgattggcagaggtgctaatcgtaagaaaatggatcattacggatatgaagtgttggcgctgtgtcgtgaacatcatcaatcgcagcatgatatgggtgtagaaacctttgataaattacatcaccttgaaaattcgtggctttcagtagatgagcgcttaaacaaaatgttgaaaggagttaaaaatgaattcgagagtaataactaa

SEQ ID NO: 1635 - DNA, 579 bp, Staphylococcus epidermidis
aggtgtaaaataatgaaaggtttaattattatagggagtgctcaagtagggtctcatacgaacgctttatcaaaatatttaaaaggtcaactcggcgaacatgatgttgaggtggaaatctttgacctagctgagaaacccattcatcaattggattttgctggtacaacacaagcagttgatgaaattaaaaacaatgtcaaatctttacagagtaaagcaatggaagcagatttcttaattttaggaacgccaaattatcatggatcgttttcaggtattcttaaaaatgcacttgaccaccttaatatggaccatttcaaaatgaaacccgtgggactcatttgcaatagtggaggaatagtaagttctgagccattatcacacttaagagtcatcgtacgtagtttacttggtattgctgtaccaacgcaaattgctacacatgactctgattatgctaaattagaagatggtaccttatacttagaagataatgaatttcaactacgtgcaaaattgtttgttgatcaaattgtatccttcgtaacaaatagtccatatgaacacttaaaataa

SEQ ID NO: 1636 - DNA, 183 bp, Staphylococcus epidermidis
tataaaaaaatcactttaaaagacggactgctttttaaaaaaatgtttattgagacagaggattttatgtttaactatagtacatctaaagctcttttaagtgattttcaaaataataattttaattactttattcaaaataaaaaagagcgtgttatatttgaagatgggcatttcctctaa

SEQ ID NO: 1637 - DNA, 678 bp, Staphylococcus epidermidis
ttggagaaaataaagatgaataattatggtattcctcaaaatgcagtaataaccattgctggcactgtaggggttggtaaatctacgttaacacaagcacttgctgacaagttaaattttaaaacttcctttgagaatgtagaccataatccttatttagataaattttatcataattttgaacgttggagctttcatcttcaaatttactttcttgctgaacgttttaaggaacaaaaacgcatgtttgagtatggtggcggattcgttcaagatcgttcaatttatgaagatgtggatatttttgcaaaaatgcacgaagaacaaggaacaatgagtgctgacgactaccacacgtattacgaattatttaatgcaatggttatgacaccttattttccaaagcctgatgttctgatttatctagaatgtgattatgatgaagtaattgatcgtattcaacagcggggacgtgacatggaaatcaatacagatccagaatattggaaaaaactatttaaacggtatgaaaattggattaacaattttaatgcatgtcctgttgttcgacttaatattaatgaatatgacatacacgaagacgtagactcccttgattcagtcattgataaaattgctcaagttattaaagcataccgacaagtggatacaagataa

SEQ ID NO: 1638 - DNA, 2706 bp, Staphylococcus epidermidis
attaatgaaatagggggaaatgtcttggcaaagctattatacaaactaggaaaatttatagctaagaacaaatggctaagtgttataggatggcttgttatactaggtgttattatcacgccattaatgataaactcaccgaagtttgacagtgacatcactatgaacggccttaagtcattagacacaaacgataaaatcagtaaagaatttcatcaggacagtgagaaagcctcgatgaaaatagtcttccattctaataagaatgatggactcaataataaagatacgaagaaagatattgaagatgctttagacaatatcagacaaaatgatgattatatccaaaatatctctaatccatatgacagtggacaagttaatgatgaaggcgatactgctatcgctaacgtaagttatgtagttccacaaactggattaaaagattcttctaaacatatcatcgacaaagaattaaaagatgtaactgacaaccataatgtgcaaattgaaaaaactcaaggtggcgctatgaattccgaacctggtggtacatcagaaattgtcggtatcatcgtagcattcgtaatcttacttattacctttggttcacttatcgcagctggtatgccaattattagtgcaatcatcggtttaggttcaagtgttggtatcatcgcattattaacatatatctttgatattccaaacttcactcttacactagctgtaatgataggtttagctgttggtattgactactcactctttattctatttagatttaaagaacttaagaaaaaaggtgtcgatactgtagaagctattgcaacagcagtgggtacagcaggcagtgctgtaatattcgctggtcttacagttatgattgctgtttgtggtttatcacttgtaggaatcgacttcttagcggttatgggattcgcttcagcgattagtgtgttatttgcagtattagcagcattaacactattacctgccctaatcagtatcttccataaaagtattaaaattaaagataaaccaactaaaagtaaagaccctaaagatcattcttgggcaaaatttattgttggtaagccagttatcgctgttattgtaagtttaattattttaattttagctgctataccagtcagtggcatgcgtttaggtattccagatgatagtttaaaaccaactgactcatcagaatacaaagcctataaattaatctcagataattttggcgaaggttataacggacaaattgtcatgttagtaaatacaaaagatggtggaagtaaaagcactatcgaacgtgatttaaataatatgcgtagtgatttagaagacattgataatgttgatacagtttcaaaagcacaactaactgacaacaacaattacgcattattcacaatcattcctgaaaaaggaccgaactcacagtcaacagaaaatctagtatatgatttacgtgattatcatagccaagcgcaagaaaaatatgactatggcactgaaatttcaggacaaagtgttattaacatcgatatgtcagaaaaactaaacaacgctattccagtatttgcaggcgttattgttgtattagcattcttcttattaatgattgtgttccgttcgatcttagttccattaaaagcagtactaggctttatcctttcattaatggctacattaggtttcacaacattagtcattcaacatggctttatgggtagcttatttggtattgaaaacacaggaccattacttgcattccttccagtaatcacaattggattgttattcggacttgccatcgactacgagctcttcttaatgacacgtgtacatgaagaatacagtaagactggcgataatgatcattcaatccgtgtaggtatcaaagaaagtggacctgttatcgtagctgctgcacttattatgttcagtgtattcatcgcattcgtcttccaagatgacagtgcaattaagtcaatgggtatcgcattaggtttcggtgtgttattcgacgcattcgtcgtacgtatgacattaattccagcattgacgaaactctttggtaaagcttcatggtaccttcctaaatggttaggtgcagtattgccaaacgttgacgttgaaggtaaagctttagaagaagataatcatcacgacacatcttctgaaaaaggtcatgtcaacgataaaaatagtgaatactctagacaagacaaagataactatgtttatcaaaatgacaaacgtaactacaatcgcaattataatgacgaagattataaccgttctgtgcatttaaataatcatcatgaccagcatcatcgccaacatcaatatgataatcaacgtgatgatatcgactatgaatcactttatactcaagatggcgaccatactcatcatgatgaacgtaattataatgatcgacactatcaagacaattacgatagaaatgatgattatcgtcacaacaatcatgatcatcaaaatgataaccatgattatcatgattcaaattttgataaaacaacaaacttatacaaagaattaactgatagcaatattgatcaagatgtattattcaaagcattaatgttatacgctcgtgaaaacaacaaaggtgtttacgatagatataaccgatcatctcaacatcgtcatgatgacgaacttagagactaa

SEQ ID NO: 1639 - DNA, 510 bp, Staphylococcus epidermidis
gtggaggaaataagaccaataacctatcaagataaagaggcatactattattatattcaagagtggtatgaaaatgaggaaaaagtggtaccagggaatacagatattgccaattatagttcatttaacaatatggttgatcggcttaattgtagtgaagttgatgagggttttgtaccgactacaacactattttattttaaagattcaattattataggtgctgttgatatcagacatcaattaaatgataaactatctaatattggtggtcatgtgggatacggtgtagctaaatcttatagagggaaaggttacgctactatccttctagaaaaggctttagatgaacttaagacattaaatgtagaggtcgtacttatgacttgtaatccacttaattttgcttctcaaacagtgatgaagaaatgtggtggatatcaaattgaatcctatattaaaaaaaatggtaaacctgttcatcgatatcatatacctaatacaaaataa

SEQ ID NO: 1640 - DNA, 1068 bp, Staphylococcus epidermidis
aagttgcgaattcaattattactggagctgttgataatgattaatcaagtatatcaattagtaagtccacgacaatttgaagcaacatttaaaactattgatttacataatcataatagcaaagttattgttcgacccttatatttgtcaatttgtgcagccgacttgagatattattgtggaaatagagatagcaaaattttatctaagaaattacctatgtcattgattcatgaaagtgtaggtgaaattgtatacgactctgaacatcgactgaaaaatggaactaaggttgttatgattcccaatacaccgtctaaatcgcataatattattgcagaaaattatttaacttctagtcattttaagtcaagtggttatgatggttttatgcaagattatatagtaatgaaacctgatagagtagtcactttaccacaagaaattgatttgagtgtagcgtcgtatactgaattagttacagttagtgttcatgcaatagatcgttttcaatcaaaagcaataccacaatttgaatcattggggatatggggagacggtaatttagggtatatcactgcagttttactaaaaaaactatatcctactacaaaaataatagtttttggaaaaacattatataaattaagccgtttttcatttgtagatgaaattattcaaattgacaatattcctcaacatatcaaaattgatcatgcatttgaatgcgtgggtggtaaaggaagtcagcaggctattgaacaaattattaatattattaatcctgaagggagtatcgctttattaggagtgagcgaactgcctatacaagtgaatacaagaatggttttagaaaaaggtttaactataattggtagtagcagaagtggtttaaaggattttgaaaaaactattgaattgtatcgtaaatatcctgaagttcttaatcaattagcattacttaaaggtaaagaatttgaaataaataccatagaagatctcattacagcgttcgaatatgatatttctaacgcatggggaaaaacagttttaaaatggaatatttaa

SEQ ID NO: 1641 - DNA, 444 bp, Staphylococcus epidermidis
ataaggagaattcgaatgactaatttaactattttaacaggacgtatcactaaagatttagaacttaaacaagcaggacaaacacaagtaactaacttctctatggcagtggacaatccattcaaaaaagatgacacatcattctttgacatcgtagcgtttggcaaaactgcacaactattaaacgactattgcggtaagggaagcaaagttttaatcgaaggcaacttgaagcaagaccgtttccaagataaagaaggacacaatcgttcagtagtacgagtaattgctaacagaattgaatttttagatagcaaaggtagtaaccaacaaaacaaccaacctcaaaagcaacaagaacaaactactgaaacaaaaagcaaaaatccgttcgcaaatgcaagtggccctattgacattactgatgatatgttgcctttctga

SEQ ID NO: 1642 - DNA, 744 bp, Staphylococcus epidermidis
aggtgtttgatattgaaaattattaatttagattcaaaaaatcttgcgtcattttatgtagcatgcgagttgtttaaacaaatacagcagcaccctcatgccaaactcggtttagcaactggtggaactatgactgacgtatatcattacttagtaaatttattaatcaaaaataaagttgatgtgtcgcaggttgaaacatttaatttagatgaatatgtaggtttaaaagcaagtcatcaacaaagttaccatacctacatgaataaagtgctatttgagcaatatcctcattttgttaaaaatcacattcatattcctgatggcttatcagaaaatctagaagcagaagcggaacgatataacaatttattagatgaaagagggccaatcgatattcaaattttaggaattggagaaaatggtcacattggttttaatgaaccagggactgacttcaatagtgaaacacatgtggtgaacttaacagaaagcaccataaaagcaaatagtcgattttttgacaatgaaaaggatgttcctagacaagcagtttcaatgggggtaaaaagtattttaaaagcaaaaaggattatcctactcgcatttggtccaaagaaaaaagaggctataagtaaactgttaaatgaacaggttaccgaagatgtacctgcgaccattttacacacacaccctaatgttgaagtttatgtagacgatgaagcagcgccagattgtttataa

SEQ ID NO: 1643 - DNA, 810 bp, Staphylococcus epidermidis
ctgtttgtgatagaatttgatatgaatccaataaaaattttgaaaaaggagcgaataataatgagtgaagcagcagaaactttagatggttggtatagcttacatttattttatgcagtagactggacaacttttcgtttaattgctgaagatgatcgtgaagcaatgattactgaattggaaacatttattaaagataaaacagttgctagagaatcacatcaaggtgatcatgcaatttataacattacaggtcaaaaagcggaccttttactatggtttttacgtccagaaatgaaagagttaaatcaaattgaaaatgagtttaataaattacgtatcgcagactatctcattccaacttattcctatgtgtcagtgatagaattaagtaattatttagcaggcaaatctgatgaggatccttatgaaaatccccacgttaaggcacgattataccctgaattaccacattctgaatatatatgtttctatccaatggataaacgacgcaatgaaacttataactggtatatgttacctatcgaagaccgtaaaactttaatgtataaccatgggatgataggtcgtaaatatgctggtaaaatcaaacagtttattacaggttcagtaggttttgatgactatgagtggggtgttacattattttcaaatgatgtacttcaattcaaaaaaattgtctatgaaatgcgttttgatgaaacgactgctcgttatggcgaatttggtagtttctatattggtcacattctaaacatcgaagacttcaaacaattttttagtatataa

SEQ ID NO: 1644 - DNA, 582 bp, Staphylococcus epidermidis
gagaatcagataatgccgtcagcaaatcaaaagcgtatgattaaacatattcatgaaacagtgtttatacttttacatgattatcattttgatgaaatcacggttcaaaaaatatgtgatattgcagaaatcaaccgcagtacgttctatagatacttccaagataaatatgaattactctacactttacctgactttattacacaacaaattatagctaaaagtgacacatcagcagacattacaacccctgaatcatttgaagactttatctattacattggtaataataaaaagatttttaagcatctattagtttcgtctcgacaggcagatgtatttagaagtttaacgaatgtgagtcgcgaaatgatgttaaataacccaactcgtaagcgtgcccccttagcgcaaaagattagagaaagtaaacatcctgaaattgtagctgatttttacagtagtggcgtaatagaagtactaagacgttgggtagaaaatgactataactatacagttgaagaagtgtttgtaacattaaataatgtgcttgaaacgtcattatattgttatgataaataa

SEQ ID NO: 1645 - DNA, 1314 bp, Staphylococcus epidermidis
tgtggacagataaacaacaaatcgaaacgactgcgatggtgcatttcgatgatgatatcaattaaattatccgaactgttacctaaacactttcatagcttgtggaaagcgactaaagatagagagaagcttaacatagtagcaaaaggtggacgtggtagtggtaagtcgtctgatatatctattatcattacacagttaatcatgcgctatcctatgaatgcagttgtagtacgtaagactgataatacattagctacatcagtatttgagcaaatcaagtgggcgatagaagaacaaaaggtgtcacacctgtttaaagttaaagtgtcgccaatggaaataacatatgtacctagagggaatcggattatcttcagaggggcgcagaaccctgaacgattaaagtcgttaaaagatagtcggttccctttttctatcatgtggatagaggagttagcagaatttaagacagaagatgaagttacgacaattactaactctatgttacgtggtgaattagatgacggattattttataagtttttctttagttataacccacctaagagaaaacaatcgtgggttaataaaaaatatgaaacctcattccaaccagataacacattcgtacatcattcaacgtacttagataacccttttatctctaaacagtttatacaagaggcagagagtgctaaagaacgtaacgaacaacgttatcgttgggagtatatgggggaagcgatagggagtggcgttgtgccgtttaacaatttacaaatagagaagataccagatgagttgtacgataatttcgataatataagaaatggtgccgattttggttatgctgctgacccgttagcatttactaggtggcattacgataaaaagaaacgcattttatacgctatggatgaaatatatggtgtacaaatgagtaacagagaattcgctaaagaattatggaaacgcggttatcaatcagatgaaatatattgtgactccgcagaaccgaagtcaattgatgaattaaaaaaagaacatgggattaagcgtgtcaaaggtgttaagaaaggccctgacagtgttgaatacggggaacaatggttaaatgatttagacgctattgttattgaccctaacagaacacctaacatagcaagagagtttgaaaatatcgactatgaaacggacaaagacggtaacgttaaaccgagattagaagataaagacaatcacagtatcgattcctgcaggtacgcgctctctagagacatgaggcagaataaacttagcatacttacgtaa

SEQ ID NO: 1646 - DNA, 1284 bp, Staphylococcus epidermidis
ttggaggggataaaagtgaagacgcaagttttgtacggaaaatctgaaattgaaatcaatgtgcctgatgatagcacaatcatagagcctcaaaacatcgacgctattcaagattatgaatcaacaattaaaaatgtattaagaaaccccacaaattctaaacctttaaaagaaatggtaaacagtaatgatattgtttctattgttattagtgatattacacgtccaacgcccaaccatattcttgtacctttactaattgaggaattaaatcatgttcctcgtgagaatttcgtaattattaatggtacagggactcatcgagatcaaacgcgagatgaattgattcaaatgttaggtgaagatattgtaaattcagtaaaaatcgttcacaatcattgctcagaaaaagaaagtctagctaaagtgggacacagtcaatatggatgtgatgtttatttaaacaaagcatatgtagaatccgattttaaaattgtaacaggttttattgaaccacactttttcgccggattttcaggtggacctaaagggataatgcctggaattgcaggtttagaaacaattcaaacatttcataatgcaaaaatgattggcgatccgagatcaacgtggggaaatttagaagacaatccagttcaagatatggcacgggaagttaaccgtatgtgtaaacctgactttttacttaatgttgcattgaataaaagtaaagaaattactgcagcatttgctggtgaaatcttagatacacacaaagaaggatgcgcatatgtaaaagatcatgcaatgtttaaatgtgagcaacgctttgatattgttatcgcatcaaattctggctatcctttagatcaaaatttatatcaaacagttaaagggatgagtgcagcgagtaaagttgttaaaaaagacggtcatattattatggtatctgagtgtgcagatggctttcctgatcatggtaagtttgccgaaattttcaaaatggcagacacacctcaaggtattttagaacttattcacaatccaaactttaaggaagttgaccaatggcaagtacaaaaacaagcaagtattcaaacttttgccaatgtgcatgtttattcagaacttactgaccaacaacttaaagactcgatgttaatcccaacctctaacattgaacatacaatacaagaattagaacatcgatatggccgtaaattaaccattggtgttatgccacaaggtcctttaacaataccgtacgtagaagataaagaataa

SEQ ID NO: 1647 - DNA, 336 bp, Staphylococcus epidermidis
cttgtggtttttattttaagtgaagtaggtgtttatatgacagaaagtagccaaagaggggattacgaaagacgtataaaaagattggaagataacgacgaaaaaatcttcaactctttggaacagataaaagacggacaacacaatcaaaatttgattaatcaaaaaatgaatttcactttggactctatcaacagagagagagaattagaatctcaaaacaaaaaagaaaatcaaaaaaacatcaaagacattaaaatgtgggttttaggattggttggcactatagctggttctttaatcgtagcagtattaagaatgtttttcggtgtttaa

SEQ ID NO: 1648 - DNA, 345 bp, Staphylococcus epidermidis
caaatgaacttcaaacaaatgcatcaattcaattataggttacctgagctattgacaaactatttacatttaatacattcgactagtgaaccaagaatgtgtcatgctatgaagaaaggtgaaattcatgattactgtattagtcattactatattttttattacagtaactttaataatttggcaaccaaaaggattagatatagggatttctgcagtcatcggcgcgcttttagctatcgttactggagtagtgagtgtctcagatatattagaagtgacaagtatagtttaaaatgccacacttacctttgtcgcagttatccttatttcattaatccttga

SEQ ID NO: 1649 - DNA, 258 bp, Staphylococcus epidermidis
tttgtgaatgtaaaaaaggaagggctaattatgcgatttaaattaaaagaagatgaaattttagaatttttagatttaaattttccacaacaaacatttgaaaaaggtcgtctccttattgggcaaaataagagacaaccattacacgtttattattttggaaaaaaattcttggctcttttaaatgtaaattttaacacttttgaatatattaaagtagatgaagtcgattataatgatataaaaaaatcactttaa

SEQ ID NO: 1650 - DNA, 1389 bp, Staphylococcus epidermidis
atcggaggtgtctcaatggccaagaaaaaagtaatattcgaatgtatggcatgtggctatcaatctcctaagtggatgggcaagtgccctaactgcggtgcgtggaatcaaatggaagaaatagtagaaaaggttgctcatcctaaacatggtgtaaaaacaaaagaaacagcaggtaaggtacaaaagttaaatagtgttaagcatgaagctacccctagattacttacagaatcaaaggaatttaaccgtgttttaggtggaggtattgtaagtggttcgttagtactaataggtggagacccaggtattggtaagtcgactttattgctacaaatttgtgctgcgctgtcacaaaataagaatgttttatatattactggtgaggaatctattaatcaaactaagttgcgcgctgatcgtttagaagaagattctagtcatcttaatgttttagctgaaactgatttagaagtgatacatcaaactgtaaaagaagagagacctgacttacttgttgttgattcgattcaaacaatctatcatccggaaattagttccgcacctggatcggtatcacaagtaagagagagtacgcagagtttaatgaacattgctaaacaaatgaatattgccacatttattgtgggacacgtaacaaaagaaggacaaatcgccggaccaagattattggaacatatggttgatacagttctttattttgaaggagatgagcatcacgcatatcgtatccttagagcagtaaaaaatagatttggttctacaaatgagatggggattttcgaaatgaagcaaagtggattaaaaggcgtacttaatccttctgaaatgtttttagaagaacgttctacaaatgttccgggctctacaatcgtccccactatggaaggaacaagaccactactcattgaagtccaagcgcttgttacaccaacaacatttaataatcctagacgaatggctacaggtatagatcataatcgattaagtttacttatggcggttctagaaaaaaaggaaaactatttactccaacaacaagatgcctatattaaagtagcaggtggcgtcaaattaacagaacctgctgttgatttaagcattattgttgcgacagcttcaagttttaaagatcaagctgttgatggattagattgttttgtgggtgaagttggattaacaggtgaagtacgcagagtatctcgcatagagcaacgtgttcaagaagcggccaaactagggtttaaaagagctattattccacagacaaatattggaggttggacattcccagaaggcatccaagtcgttggtgtttcatcagtacatgaagctttgaaatatgcattacattcaaaacagcgataa

SEQ ID NO: 1651 - DNA, 147 bp, Staphylococcus epidermidis
ttatttttcgtttttcagtataaatattacatgatttttaactttgcaacagaaccctatttattattgcgtaaaaaatacctgagacaacaaatgatgtctcaggttcttaatctatctcttaagttattttttaattgggaataa

SEQ ID NO: 1652 - DNA, 210 bp, Staphylococcus epidermidis
aagttttacgtcgttggaaaatgcaacactttggaaaaattgttggtgaaaatagcgtgtattaaggagatatataagaaaacaggttctgttgcaaagttaaaattatatgcacatctatacaaaactataaaagcaaatattgttttaacagtaaagagctttattagtattaattatttttcgtttttcagtataaatattacatga

SEQ ID NO: 1653 - DNA, 1455 bp, Staphylococcus epidermidis
catacttacgtaaacgaggtgattagcattaattggccatgggataaaccatatcacgaacaagtggtagaacagattaaaccgaagtatgaaacgcaagaagaaatgatattgcgcttagttagagagcataaagagaatatagacaatatcacaatgggtgaaagatattataatcatcacccagatatattagacgctcctttcaaaagagatgtgaacggcgactatgacgaaactaaaccagactggcgcatgtatactaactaccatcaaaacttagtagaccagaaagtagcttatgcagttgctaatcctgtgacatttggtgtagataatgacaaagcattaaaacaaatacaacacacacttaatcacaagtgggatgacaaattagtagatatattaactgctgcaagtaataaaggtatcgaatgggttcaaccatatgtagatgaagagggagaatttaaaacgtttcgtgtacctgcagaacaagctgtacctatttggactaataaggaaagagatgaactgcaagcgtttatacgtgtatatgaattagacggagcagaacgtgttgagtattggactaaagatgatgtgacattctatgagttgaaagaaggacaacttatccctgatttctatcgtagtgaagatcatatacaacctcattattatcaaggtaataaattgatgagttggggacgtgttccttttattccgttcaagaacaacccacaagaagtatctgacttattcatgtacaaaacaatcatagacgcgttagataagcgattatcagacacacaaaacacttttgacgaatcagtagagttaatctatatcttaaaaggttatgaaggtgaagatatgaaagacttcatgcataaccttaaatactacaaagcaattagtgttgcaggggaaagtggttccggtgtggatactatcaaagtagaagttcctatagactctgttaaggaatacacgaaaatgttgcgcgattacattatagagtttgggcaaggtgtagacttccaacaagataagtttggtaatagtcctagtggtattgcgcttaaatttatgtacagcaacttagacttaaaagctaataaattgaagaacaaaacacttactgcgttacaagagttgttacagtacattattgatttctatagattagatgtgaaagtgcaagacatcgagattacattcaacttcaatgtaatggtaaatgagttagaaaactctcaaattgctatgaattctacagggttattatctaaagaaactattctttctaatcatgcttgggttgaagatcctgtagctgaaatggaaagaatagaacaagaaaacatagaactcaatcaacaactccctgacattgaggagggattgaatggcgaacaacaaagacaatccaaaaataaccaaccagaatga

SEQ ID NO: 1654 - DNA, 408 bp, Staphylococcus epidermidis
gatttaaacgtggctaaacatatgaacgtaaaacttcttaatcctttaacattggcatatatgggtgatgcagtacttgatcaacatgtgcgtgaatatatcgtgctaaaattacaaagtaaacctcatcgtttgcaccaagtatcgaaaagttacgtttcagcgaaaagtcaagctaagactttagagtatttgttagatattgactggtttacagaggaagagctaagtgttttaaaacgaggacgtaacgctaaaagttatacaaaagctaaaaatactgacattcaaacttatcgtaaaagttcagcgttagaagctgttatcggatttttatatttagaccatcaatcagaacgattagaaaacttattagaaacaattgttaggatagtggatgaaaggtag

SEQ ID NO: 1655 - DNA, 1440 bp, Staphylococcus epidermidis
aaagacagcttgaaaaagctaagaatggagagattcaagatgattacattatataataccttaacacgtcggaaagagacgtttgagcccattgaaccaggtaaggtcaaaatgtatgtatgtgggccaacagtttacaattatattcatattggaaatgcacgaccagctattaattatgatgtagtcagaagatatttcgaatataagggatatgaagtcatctatgtttctaatttcacagacgttgatgataaactcattaatcgctctaaagaacttaatgaaagtgttcctgaaattgctgaaaagtatattaaagctttttatgaggacgttggtgctttgaatgtgaaaaaggctacatctaatccgcgtgtgatgcatcatatgggtgaaattattgattttattaaagaattagtagatgaaggttatgcatatgaaagtgacggtgatgtctattttagaacacgtcaatttgatggatatggtaaattaagtcatcaatcattagatgatttgaaagttggcgctcgtattgaagctggagaacaaaaagaagatgcgctagattttactttatggaagaaagctaaaccaggtgaaattagttggaatagtccatttggtaaaggtagaccaggttggcacattgaatgttcagtaatggcttatcatgaactagggtctacaatagatattcacgcaggtggttcagatttacaatttccgcatcatgaaaatgaaattgctcaatcagaggctcataatcatgcacctttcgcaaattattggatgcataatggttttattaatattgataatgagaaaatgagtaagtctctaggaaatttcattttagttcacgatatcattaaagaagtcgatccagacgtattacgattctttatgattagtgtgcattatcgtagcccaataaactacaatttagaattagtaggtgcggcgcgaagtggtcttgaacgtatacgtaatagctacaagttaattgaggaaagagaacaaattgcctcagatttggaagaacaatcagaatatatacaacaaatagataaaatactaaatcaatttgaaacggtaatggatgatgactttaatactgctaatgcagtaactgcatggtatgacttagctaaacttgcaaataaatatgtattagaaaatacaacttcaacaaaagttttaaatagatttaaagaagtgtacagcatttttagtgacgtccttggtgtaccacttaagagtaaagaaactgaagagttactagatgaagacattgaacaattgattgaggagcgtaatgaagcacgtaaaaataaagatttcgctcgagcagatgaaattagagatatgttaaaagcacgtcatatcattttagaagataccccccaaggtgtaagatttaaacgtggctaa

SEQ ID NO: 1656 - DNA, 552 bp, Staphylococcus epidermidis
acgtcatcagttagaggaaaagtcatgaagaaaagatacttaattatagatggttacaatatgattggccaatcctcaacacttagcactgttgctaaagagaatttagaagaagctagagagcaattattagacacaattgccaactacaatgcattaatagcagatgaaattgtctgtgtatttgatgcctatgaacagtcagggatagaaagggaatacttctatcatggtgtcaaaacaatctttactaaagaaaaagaaactgcagatagttttatagaacgctacgtgtatgaattatataataaacacacgacacacattaccgttgtaacaagtgatatgagtgaacaacatgctatttttggttcaggtgcatatcgtatttcttcaagagaaatgtggcgtgaattaaaagaaaatgaggttgttgttaacaagtcacttgatgattttagcgaaaagaaaccaagaattagaattccgttatctaatgagatacttgaagaatttgaaaagattagacgtggcaatcagaaaaaagactaa

SEQ ID NO: 1657 - DNA, 1089 bp, Staphylococcus epidermidis
gaggcaacagtcatgtcagaaaaagtaaaattcgaaaaaagagagtctttaaaagaaaaacctgatacagcaaacttaggatttggacaatatttcacagactatatgttaagtgttgattatgacgctgatcaaggatggcatgatatgaagattgtgccgtacgcaccatttgaaatttcaccagcagcgcaagggttacattatggtcaggcagtttttgaaggccttaaagcctataaacataatggagaagttgtattattccgcccagatcaaaacttcaaacgtattaataattctttagcacgtttagaaatgccagaagttgatgaagaagcattattagaagggttgaagcagcttatcgacgttgaacgagattgggtacctgaaggcgaaggtcaatcgttatatattcgtccttttgtatttgctactgaaggtgttttgggtgtacgttcttcacatcaatataaattactaattattttatctccgtcaggcgcttattatggtggtgacacattaaagtcaactaaaatttatgtcgaagatgaatatgtacgtgcagtacgtggaggtgtaggtttcgctaaagttgcaggtaactatgctgccagcttactcgcacaaacaaacgctaataaattaggttatgaccaagtattgtggcttgatggtgttgaacaaaaatatgttgaagaagttggtagtatgaatattttcttcgtagaaaatggaaaagtagttacgccagcattaaacggtagtatcttgcctggtatcactagaaagtcaattattcaattagctgaagatttaggttatgaagttgaagagagaagagtttctatagaagagctgtttaacgcatatgataaaggtgaacttacagaagtatttggttcaggtacagcagctgttatctctcctgtaggtacacttcgctatgaagatagagaaattgttattaataacaatgaacctggtaaaatcactcaaaaattatatgacacatatactggtattcaaagtggcaaattagaagataaatacggatggagagtagaagttcctaagtattaa

SEQ ID NO: 1658 - DNA, 378 bp, Staphylococcus epidermidis
tttaagggagtgaacgtgttggaaccaattaaagaacaagaagtgctagatttattaacttcttactcaaatcagcctgtttacctacacgttgaaacaacaaatggtgcttatgcaaatcatttcgatcaacgcgtatttaacgctggaacatttttaagaaatattgtcgtgacttttgaacatgcacaacttaaaggcggcgacaaagatccatatcgtgtaggtcttaaattaaaagatggtggctgggtttacgtgcaaggacttacgcactatgaagttaatgagaataacgaatttttaattgcaggttttaattatgaaggacaattggctgctacaatagaaataagtaaacagccatttactatataa

SEQ ID NO: 1659 - DNA, 126 bp, Staphylococcus epidermidis
gaaactttggtaatctctttagttataggttttgtttgttcttttgtgtttttaggagtgttgtcattagaaggtttggacggtgtactacttggtttcgatggtttcttagtttctgcgtggtag

SEQ ID NO: 1660 - DNA, 945 bp, Staphylococcus epidermidis
cttttaatggtaaaacaagtacgattaggtaaatctgatgtcaatgtttttcctatcgcattaggtacaaatgcagtaggtggtcataatttatatcctaatttggatgaagagcaagggaaagaagttgtacgtcaagctattgataatggtataacattattagatacagcatatatctacgggcctgaacgttctgaagaattagttggacaagttgtaaaagaatatccacgcgagaaagtgcaaattgcaacaaaaggttcgcatgttattaaagaaaatgaagaagttgttcaaaataacgatccagaatatttaaaacagcaagttgaaaatagtttggaacgtcttcaagtggattatattgatttgtattatattcattttcctgatgacgatacaccaaaagataaagcggtggcggctcttaaagagcttaaagatgaaggtaaaattaaagcaataggtgtatctaatttctctttagaacaattaaaagaagcgaataaagatggatatgttgatgttgttcaattagaatacaatttattacatcgtgaaaatgaagaagtaatggcatatgctgcagaaaataatattacatttgttccttacttcccacttgcttcaggtatactagctggcaagtacgatgaaaatcaaacatttgaggatcatcgtgcagaacgtcctgattttcaaccagacgtattcaaagataatgtgcgtcgtgtaaaagcattaactgatattgcagaggcacatgatacaacgattgccaatgtcgtattagcattttatcttacacgtccatcactagatgttgtcatccctggtgcaaaacgtgcagagcaagttgttgaaaatattgatgctgcaaatattgaattatcgcaaggtgaaatagacaaaattgatagtttattcccaattaaaaaataa

SEQ ID NO: 1661 - DNA, 126 bp, Staphylococcus epidermidis
aacaccgcggttatttatatttttatcattcgaaatagtttggtgacaatttttttgatgaatatagtaataatttcaactatttatgttattagaattttaagaaatgtagagcgaattaattaa

SEQ ID NO: 1662 - DNA, 150 bp, Staphylococcus epidermidis
cgagaagcggtgaatggatttgaaaatgtactcgatattgttggcactaatcctatatgtgatgtaacttgtgcaatagctgataagttaattataggatcaaaccaaaaagcgggcatagtagtattatcacttgcattaaaggcttga

SEQ ID NO: 1663 - DNA, 492 bp, Staphylococcus epidermidis
tcaaagaaggtcaaaaaagaggtgatatctatgcacaatatgtccgacatcatagaacaatacattaagcggttatttgaagaagcagatgaagatgttgtagaaatacaacgcgctcatattgctcaacgtttcgattgtgttccttctcaacttaactatgttattaagacacgttttactaatgaacatggttatgaaatagaaagtaaacgtggtggcggtggttacattcgaatcactaaaattgaaaataaagatgctacaggttatattaatcacttactacaattaataggtccatctatttctcaacaacaagggtattatgtcatagatggtttgttagataaaggtttgatcaatgaaagagaagctaaaatgatacagaccattattgatagagaaactttaaaaatggatgttgttgcacgcgatattattagagctaatatcttaaaacgattactaccagttattaattattactag

SEQ ID NO: 1664 - DNA, 441 bp, Staphylococcus epidermidis
gatatgtgggtatcagtagaacgatatctgtttaacaagatatacaacaaattaaaaagcaaccctatcatcaacaaacaacttgatggtagggtttttgattgcgttcaaaaagacgctgtttacccatatatcgttgtgggtgaaacaaacgtcactaataaagaaacaacgacaagtatgtttgaagatgtgggcgttacattgcatgtttatagccaagctagaaatagagatgaggcctcacaaatcatccaatacttaggttttgtacttaactctgaaatagaaataaataactattcatttataaaaagtcgaattgatacacaagaagtgataactgacattgatcagtacacgaagcacggtatcattcggcttgtttttaaatacagacacaatactttacaaaggagtgtaacgaatggcgcagaataa

SEQ ID NO: 1665 - DNA, 171 bp, Staphylococcus epidermidis
tggtatttattaaattatacgaaagcaccttatttttcaaagtattttaatataaaattacatataaacacaaagtattttggcgagactcttgagggaacaggacaagctgaagactacaggctgaagctgtcacctaagaaagcgagccaacaatacgaattattttaa

SEQ ID NO: 1666 - DNA, 165 bp, Staphylococcus epidermidis
ttaagtttattttacaaacattgtaacataataaaaacttataatattaataaaactaataaacatttaaaaataatttatacgaaaatacatactactaactatatttacctctttataatcaaaaaatttaaaataacgagtcacttacaaacgagcttataa

SEQ ID NO: 1667 - DNA, 477 bp, Staphylococcus epidermidis
agactaatattaaaaagggggaaacacgttatgttaaaacgacgtagttcgaaattcttaggactactagccacactagccttagccatagtgctaagtgcttgtggtaatagtggtaacggtagtggttcatcagacgatagtcaaacatcacttggtaataaagaaatcgaaatatcttatatcgcgagtgataattcaacaccacgttcactagttatagcagaagtattgaaaaaagcaggttatgatgtaacaactacaccagtaacagcaagtggcccgttatatgctgctgtatcagagaactctgattcattccatgcatcaggtatattccctactactgataaaagttactacgataagttcaaaagtaaattaacaatttatgatgataaacatttaattgataacgcaaaagtaggtttagccgtacctaagtacgtgcaagatgtcgactcaattagtgactga

SEQ ID NO: 1668 - DNA, 1857 bp, Staphylococcus epidermidis
ttgccaatattattaaaaacgttacagggcattgggcaatccctacctgtagaaacaaaattaaacgagaaattaaatgaagatggctccttagaaatagaaatggtagaaaacaaagctacattcgacgctataggggctattactaaaatgtggacgattacaggtgttggtggtgcagatgaccttaatgaataccgtatcgttatgttagataaaacgactgtaggacaaaaagaaaagttaacaatcaaagcacgtcctgttgaattagatgacctaaacaatttaagagtgtatgaagtatataacggtagttttacaggaaaaaggtactttgatttagtttttaaagatacgggttataagtatgaattacacgctaaagtttcatcgtctaaatttgaaaatctaggtaaccatgatacaaacttagaactattcaaaaaaggtttagaacgttacgacctagagtacgaatacgaacctaaaacaaagacttttcacttgttcgatgttgttcaacgtaaggctgactattatatcaaagcaggcgttaacgctaacaatgtaaaggtgcaagaggacgcttctaaatgttatacctacatcagaggttatggtggttttgacgatcaacaaacttttaacgaagctagcttgcaatatgagtacacacaccccttagctgaccttataggtaaacgacatgcgccacctgttgtagatggacgtatgacaaagggtgatacactcaaaaaagctatggagctagttatacaagaaagtttaaaaacatctgtaaccctagacttcatatctttacaaaaacattttaaagaagcagtacctagagttggagatattgtgaatgtagttgacgatttaatagggttaaatgaatttgttagaattatcgaaattactactcatagagatatttacaataaaattatcaaacaagacgtagtgcttggggaatttagattacaagatagatacatgaaagcagtaaacactgctgcaaattatgttaaagctattaagtctaacaaatctgatcctgcgaaagatttacggtcaatgcaagcacaaacacaagctaacactaaaacaacacaagatttacaaaagaaaaccgatgacattaaaaagagattagaaagcgcacatgctaaaagtgttacaactgcaaatggtacgattgttcacgactttacacctaagtctaaaattaggaaagttaaaacaataggtactattggagattcagtagctaaaggtactggtgctaaaactaactttacgcaaatgttagctaagaagataaaagctaaatcaacaaacttagctgttagtggtgcgacaataagcacaaacaaagataatagcatttatgaacaagcaactaaaattaaaggagatttaatcattgttcaaggtacagatgatgattggacaaatgatattaagataggcactgataaaacggacattaaaacgttttacggtgccttttatagtgccatttctaaaattaagagtaataaccctaaatcaaaaataatcgtcatgacacctacaaaacagtgttatataaaagacggtaaggttgtccgaaaagacaccactaagaacgatttaggttacacgttagctgactatgtagacgttcaaatagacgcttgtaatgagttagatatacctgtgtatgacgcttatcactcaacacaattcaaacccaatataccttcatacagaaaatcgagcatgcctgacggtgtacaccctaacgaaaaagggcacgaagtcattatgtatgaactagttaaaaacttttacggtttttatggctaa

SEQ ID NO: 1669 - DNA, 1725 bp, Staphylococcus epidermidis
aatggaatatttaaagaaaaggaaacaactatgacaaagcaaaatatatttatagatgacatttattgggaacgtgtccaactcttcgtcaaaggacattttgaaggagtaaaacctacaagaaatttccttcttagaaatctaacagaaacaaaactattaaatgccaatcatgttaatattcaagggtcaacttttgaggcaagatttaatattgctattttagaaaaaggtaattttttaggtacaggcaattatatattaatcaaccgacaagaagatgaatatgtctgccaaattaaccccaaatttttgaatgataaaaaaaatcagatgactttagaggagttaagagattacaactcacttgagacccaatcgttacaaaaaagttatttattaaaaaagtatggtaaaagtttccaaagatataataacaaagagattaaatcttacgtcattgttccggcaatatcccaagaaattaatgagtttatttttaaagttcaatataaatctgaaataaagaaaataagtaaacttaagcaattatcatacatattacataaagctttgaggaaaattagcttcaatgtgagagataaaatatatttgtcggtatttaacatttccaaaacagtatataagaataataaaaatcatgttttgtttacatcagattctagagcaaatatgtcaggaaattttaaatttatatacgaagaaatgcttaaacaacaattggacaaaaaacttgtcattcattctatttttaaacctaatatagcaaataggagatcgtttattgataaattaaaatttccatattttttaggaaaatctaaatatatcttggttgatgattatcatccgatgatatataaacttcaatttagagaaaaccaagaaatagttcaagtatggcatgctgtgggtgcttttaagactgtaggatttagtagaactgggaaaaaaggaggacctttcatagactctattggacataggaattatagtaaagcttatgtttcgtcaaataatgatattctttactatgctgaagcttttggaattgaagaacatagggttattccaacaggtgttccacgtacggatgttttgttcgatgaatcttataaaacacgcattaaacaaagtttagaaacaaaattaccaattataaaaaataaaaaagtcattctttttgcacctacatttagaggaaatggacatcgcacagcacactatcctttctttaaaattaattttgcaagattagctagttattgtgaagaacatcaagctactgttctgtttaaaatgcatccttttgttagaaataaattaaatatcccagcaatttatagtaaatattttttagatatttcaaattaccgcgaagtaaatgatgtattgttcattacggatattttaatctctgattattcttctttaatctatgaattttcagtttttaaaaaaccaatgcttttttatgcttttgatttggaagattatatttacacgagagatttttatgaaccttatgaaacctttgttcctggtaaaatagtgaaaacttttgatgagcttattttagctttagaaaataatgattttgaattagaaaaggtgaagccgtttttaaataaaaattttaaatataaagatggtaaatcaagtgaacgattagttaaagatttatttaacaaattttttcagtaa

SEQ ID NO: 1670 - DNA, 285 bp, Staphylococcus epidermidis
ttttgcgtatttctcactataaccagccctgattgccgattgataagcagtacctgtcttaatgtactcatcaacaaatgcttgttgtttaaggttcagtttcgtcatcgtatattaccacctactctcacggttaagcacctttatttgacgtataaaaaaaagacactgcataaacagtgcctaatgattatgttttgttatttatttgagtttatgtactcatgtcacatctctatgtcacatcaatacataaaaaagttacccgtgtgttctcacggataa

SEQ ID NO: 1671 - DNA, 387 bp, Staphylococcus epidermidis
aggagtacattcaaaatgatgaaagtttttattattttaggtgcattaaatgcaatgatggctgtcggtactggcgcatttggagcacatgggttggaagataaattatcagataaatacatgtcaatatgggaaaaagcaacaacttatcaaatgtatcatggattaggtctgttagttataggtttaataagtggtacaatatcaattaatgtaaattgggctggttggttattattctttggtattgtctttttcagtggttccttgtatttcttagccttaacacaagttcgtattttaggtgcaattacgccaataggtggtgttctatttataattggttggcttgttcttgtgattgctacacttaaattcgctgggtaa

SEQ ID NO: 1672 - DNA, 924 bp, Staphylococcus epidermidis
aaaatcaaattcaagcatatcaaacgcaatataaattcagatattctagtcaaaaatatgaatagcgatgttgttcaaaagtcagtagacaatgctgttaaagataatctaagtcataaagttgttaaagatgctatgagcatcataagaaacattatgaagtacattcagcgcaaatataaacttacagatattagttatttagatgatattgttattcccaaaaaggctactacaagagaagaagtaaaagctaagcgtgaaaattatcttgaaatggatgaagtaaaagcaattgtagacaatttacatgaaatagctaattcaaagcgtgctgattatatgaaacgttctttcatcatgactgcttatattatggaatttcaagcacttaacggtatgcgtataggtgaattactagccatacaacctaataacattgatttcgacaaaaagacactagaaatagatggcactattcattggcgtaatgaaggtaacgcagtaggttttaaagatacaactaaaactgaatcatcttatagaacaatctctttaactacacgtagttgcgatatattaagaaaagttatgttagaaaacaaaaaggctattcaatgggaatctatgtatcaagatagaggcttcatattcactaactatcgtggcaatcctatgtcacttagcaccattaatagaaatatgcaacaatctgcaaacaatgtaggaattacaaagcacataacaagccatactatgcgtcatagccatatatctttattatcacaattaggcatatcacttaaagccattatgcaacgtgtaggacatacagaccataaaacgaccttgcagatatacagtcatgtaactgatcaaatggataaagatatgatgaataaattagaaaaggtaggtaactaa

SEQ ID NO: 1673 - DNA, 804 bp, Staphylococcus epidermidis
atatttttttcactcaagtcgttcccaaaaaagaacagtaaacaaattaaggagggattaaaagtgaacgaattacaaacattcaattttgaagatttaccagtaagaacgctatccatagacgacgagccttactttgtaggaaaagatgtggctgacatcttaggttactcaagaggagcaaaagcgatacaagatcatatcgataaagaggatattcgtgtagtcccaattcaggaccgcaccggaagatatcaaaaagcttctttaataaacgaatctggtttatacacattagttatcgacgcagttcgacaaagcaataacagagatattaagaaaaaagcgaaagcttttaaacgttggataactaatgaagtattgccatctattcgtaaaacaggttcttatcaagttcctgataatccaatggacgcattaaaacttatgttcgacgcacaaaaacaaactaaagaagaaatcgcaacagtgaaagcagatgtgatcgatttaagagaaaaccaaaaattagatacaggagattacaacttgttgtctagaacgattaatcaacgagttgctcacattcaaaagatacatgcaattacaaatcaaaaacagcgcagtgaattattccgagatatcaattcggaagttaaaaagatgacaggcgcaacatcaagaacaaacgtaagacaaaaacactttgatgatgttatctcaatggttgctaactggttcccgtcacaagctacgttatacagaatcaaacaattagaaagcaatttagaaaaaggacaataa

SEQ ID NO: 1674 - DNA, 180 bp, Staphylococcus epidermidis
ccaagaaaatttcacatagaaattcaacaaaataggcaagtgttattcgaggttaaaagaggacaacaaattcaatttgaattcaatcttactactattttgtttaataaaaatacctttcaaacaaaagttaagatgactttgttagaaaatgatatatattctatcacaaatttgtag

SEQ ID NO: 1675 - DNA, 264 bp, Staphylococcus epidermidis
attatgaaatttacaatagaaatggtgaatgaatatttaactatagttaatgatgagaatccgatccatcgttccattgtaccaggacaactcatatgtgaaaaagtattttctgaacttaatgtgaattggatgaattacaaaattaagtacttaaaacctataaatatagatgaagaagtacaatttttaataaaagaaaatgatgaaattgtagtttttaaaacatatgatgataccaaactaacaattactagaagttga

SEQ ID NO: 1676 - DNA, 789 bp, Staphylococcus epidermidis
agttcagtttcctataattgtcatgtaatctataatacaatagtttatgtaactataattaatataaaaatcattttcaggagagaattaaaattggaatggatattatttgataaagatggtacattgattgagtttgacagtagttgggaaaaaattggcgtacgtctcgttgatcaacttttagaaacctttccagtacatgataaggaagcggcacatcgccaattaggcattatcgataaaaaaattaagccagattctgttatgggatcgggttcattaggtgaaattatagagtcttttaatggtgtaacaggtaaagaaacatcagattggacaaaggatacgagtcaggaactcattgattcaagagtgcctgaaaacaattggattgatggtgtacaagaaactattcaagctcttagaaatgaaggatatcacataggtatagtaacaagtgatactaaaaaaggagtcgatcaatttctggaggaaacgcaaactagaaatctctttgatttagtaatttctacagaaacacacgcagaagaaaagccacatcctaaagttttagatccactatttaatgcttttgatgttaaaccagaaaaggtagcaatagtaggagatacggccaacgatatgaaaaccgcgattaatgctcatttaggattagctatcggtgtgctaacaggcgtggctaaaaaagaggaactctacgacgcagatgtcatcattaatagtgcaaaagatgttaaacaagttatagagcaatacggaaaataa

SEQ ID NO: 1677 - DNA, 216 bp, Staphylococcus epidermidis
tcaagttattcatcaaggtatactttagggtatctttatcgtttgaataacttttttaaaattaaaccacttacaataaactaccgcatttatttgcatattttgatagtggtcatagttatcattttattgatgtataatttgcaaagtattttaattaatatttggctatttattatccacacaattaatagtaggagtgaaaataatgagtga

SEQ ID NO: 1678 - DNA, 309 bp, Staphylococcus epidermidis
gtctgctattcatctatcaaaattgatgatcaaacaaaaaaatatagaaaaaaggagacgatgataatggattttgtagaacaagcagttaaagaaattaaagaaaaaataggaaaagaattagatttagaaaaagaaacatatttactacaaactccatctgcttatatgcaaattggattagaagaagatgatgacgatgaaagaaaattaaatgtacaagtaactggtggtaatattacttgtttaaaaacagacaaagatatattcaaagacttatatgtaaacgatgatgaaaatgacaactag

SEQ ID NO: 1679 - DNA, 1536 bp, Staphylococcus epidermidis
ataatggaattagaaaaagtaggtaaacttgatttaaacgaagaaccatatttacaaccgatatctaatagaggtatcggtttttataatctcgataaaaacactgctaaatttcaatttgtagtacaaaaagacaacaaacctttgttaatcagcgataagaatgttaaaggttatgctttctttaaagctgcgaacggaacagaagaaaaacgacctagtacatcaggtgtattagacgtagaattcattgatccaatgaaaggattaataggtgttacggtacctcaatggtttctgaaaaacgttgtcgattctgaagtgttgggtgaaatttacttatcactcaacgatgtaaacaacgtaggaaaagacgacactgttgtgttaggcacttttaaattcacggtacgcgacagtcttatcaatcaaatcgaaagtgatatcaaagtatcttatattcgaatgtttgatgaattgcgttcggaattagaaaagaaagtgcaacaacttaagcaagatataggcgatacacaaacgttgattgaatctattaagcaaacagctgaagaatacctcattaaaataaacaaggctcaagcagacgctattgtttcaattacagacgcgttaatatcgtctaaccaaagcattgacctagagagagaagaagctttaagacaaattgatgctaaacgtgacgctatcaaaacggattatgatttagcttcagatacattccaaaaaacttatgatagcaatgtggacgcttttaattcaaatgttaatcaagctaacacaacaattgatgaaaagctacaaatatttaatgaaacccttgaaagagatggctttactactcctgaatatgtagaaagtaagtttacagaaaaggattggcaaaaatttaaattaacaaatgatgatggtactaatttttatgatgccaacctacaaatagatttcgacaataacgaacaattaatgtctttaccgataggaactagatatgttgttcttactttgaacaatccagctggaacaaataataatgggtggttaacaaagtacaaaagaaatggagatgctgttctaatacaataccaaccttacaattcaactgtaatctaccaaaaaagattttataagagttggagcaaatgggaacgtgttggttcagatgttgtagatactggttggattgatttacaactagtgaacagtgcgtcgcctcataacgacttagtttccaaaggtggatttactagtgcgtacagaacaatcacacagaatggagttactaagaaaatgttacgcattaatgctacaactatcaaacatggacagactattgcacttttacctaaagaattcgtcaaaaacttaatgtttttctcaataagtgcacctagaaacaaaaacagcggacgtatttcgttgaacacatcaggaacagtgaattttgacgctactgtagatccatcagcgtggactgatacagattatatttacggtcaatatgaatggacggagtga

SEQ ID NO: 1680 - DNA, 402 bp, Staphylococcus epidermidis
tcgagtgggcattacaacaaattgaaaataatttcgattttgaagaggagaaataataaaatgagtaatttagaacaaaatattaaacaaatgaaaaatgaagtgatagaggcagaattaaatacaaaaataaatacagttataacaatgattggtgaacacatggatagtaatgaacgatttaaatctcatttagatgcacaaggtaaagtaatggaatcatatatgttaaaagaatactatcagaactattatgtattgatggcagtgcttaactcgatattgaaagatgtaaattttatgaatgatgagattactacatttcatgatagagcattagacgaattagacaaaacaaaagcgtctagtgagaactttggcgaggaatcactaaacgcataa

SEQ ID NO: 1681 - DNA, 159 bp, Staphylococcus epidermidis
aatcattgttttatcaacttttataagttttttccatatactatcacacactatgataaaagaacgtatgttctgttaaatttgcgttttaaccccctcacgaaaattaagcacttagctttttttagtttttatataggagccacacactacatgtga

SEQ ID NO: 1682 - DNA, 210 bp, Staphylococcus epidermidis
atgaataataatcagtttaaagtaatcaaagaaatttataatactttacaaaaaacaattgaagataaatcaactgagtataaacacaaaataaaagatggtaacaatgaatggattgaaacagtaaatcgtgaagaacacttgcaagcgttaatcgagtgggcattacaacaaattgaaaataatttcgattttgaagaggagaaataa

SEQ ID NO: 1683 - DNA, 183 bp, Staphylococcus epidermidis
aaactttcaaaaaaccgtttgataatcttttataatttgccatgcatgttgttattattcatcagtagtgaggaaggaataaccccgttcattttatttaaaggtaaatcctatagggtaactataatcatcaatcaattttgtaatagcaattcttacccattttttcataaaatgaagtaa

SEQ ID NO: 1684 - DNA, 648 bp, Staphylococcus epidermidis
atgaatatgaatatagaaatcatcgcaaatcaatttgaaacaagagcagctacgttattaaggtactacacaggattgttagagagcagtagagataaccacttcgcttttaaaatatataatgatccatttgatatggtttatgtgatgatgaacgggaagttattcggtcatgtatatattaaagattgcaaagtaagaaattcattcgaattagcgtctagtaagcacacagagggtcaaataagaagtattgagggatattataacggttttgaaatacacgatgataagcacctatctattagtgatatgatggcaagacaattattcgaagatgaatatttcatgtatggattggagacattcgcagaaagtaataacacagatatgttcacttatattgagggtggattaaatgttgaagaacttgagggcgttcagtctagtaatgctgatgtgataggtaatatcgaaatattatatcaattagctactgggattaatgaacctgcaagtgagctagttgagagcttgaaattggttactgcatttgtacaagatgagaacgctacacaagacgattacaagacgttagagcgtaagttaagtgagttgaaaacatcctattacagtgtgagtaaatag

SEQ ID NO: 1685 - DNA, 876 bp, Staphylococcus epidermidis
aaattgagtgaaattaaattagaatatgatactcaagtttctgtaatttggtatggaactttggattcaagatcgtttaaacagttttcgcagcctaaatggagcgagttagttaatagattatctataccacaaaacaatactaacaaatatgctcgaggtgttgctgtttatggtgatatgaaagacgatactgacgaaaatggtaatgagtataaaaaatatcgtaaagacggaaacgtgatttatcgtgatgtcctagtgctggactacgacgacattcctaagttgagactactacacgatgcaattacggagactttaaaaggtgtttcctggatgtaccacactacatttaaccatcggacagaaagccctagaatacgtttgtatatcgctttgagtgagcgaataagtgcagatgattatcgcaaatatacaaaagtgttagcaaataagataggtcatctagtagatgaggggagttttcaacctagtagagcgatggctttgccagtttatataaaaggtaaacatccgttcttacatcaatataatgatgctcccattttgaatgttgaaatgcttgaaaaatggtcaaaagaaacaaatatacaaacagatcaaccaagtaaaactaactttaataagcgtgatgatacttattggcgtgatattagtttttcagttactaagggcaatcgtaataattctttagcaagtctaataggacatttgttcagccgacatgttaatgaatatattgtatactcgtatgctttgctatggggacaaaatgcgtgtaatccaccattaaacgaacgggaaataaacgctacatttcaatccattttaaagaagcatcgtaataagtag

SEQ ID NO: 1686 - DNA, 165 bp, Staphylococcus epidermidis
tccccagtgagtccccacttaatttttatatctgggtactctcaaactcttgttactgctgcatttaatgaatttagtacccgttgtacccgtattttttataataggaaacctgtattatatgaatactcttataaacaactcactttaattaaatgtcattaa

SEQ ID NO: 1687 - DNA, 438 bp, Staphylococcus epidermidis
aaattaagtggggactcactggggactagtacccactttgaaaaaatattaaaaaagttttggaggttacacatggataaagagcaacttaaacagcatatgtacgattatgtaaaagaacataaggaaattcctatttatcagttagaagatttatttaaagagttagatcatgactataaaggtaaagcgagtgttacaaatgagcatgataaaaatatcgttttttggagtggttggaataagctcacaatgtatgcgttgattgagttagttaagggagaacatcttgatctaatttatagagctagctatgtcatgcgctatttgttagatggtagagttccaagtttaccattagctattacttacccagaatatggacaacaaactgaagtaccttcatgggtacctatgttactgagagtgactaaataa

SEQ ID NO: 1688 - DNA, 1728 bp, Staphylococcus epidermidis
gtagaaagggggaagtatatggaattaactaaagatgatattcttcacgaaattgagaaaactaagcaagaaaaagatgctattcatgaagttattcccaaaggttatgaaattgagcaacatcaaaatggtgtggcactctatcaaattattcctagtaaaaaagatggagagccagataaaaagatattcattactaatacgattccccaaattactgaacgttttgaagatattgagagtaatgaagtaagttacaacatgcttttttatgataatcaaataccggtgaatctaggagtaagcgctgaagagatagctgatagtcgtcaattactgaagttggttaatagaaagtttgatgtaacttctaccacttcaactaggttggttgattatataaataaatctaaaaggcacaatccaccagtaaacattaaagtagctactcgattaggtcatgttaaagggtacttcatttatccttataaagaagaaatgaaaaatagaaatattaagttgtttaataatgacaaaggctttcaaaagttaattgattcttttcagagtaaaggaacactagaaagctattccgagcatgtattttcaaaaattaaaagtttgccaatggttatggtcatgttatatgcatcattaggttccgtactattgcgtgaatttgaattgcagccttttattgtagagatatcaggcagtacatctacgggaaaaacgttcacacttaatttagtttcaagtgtgtgggggacaagtaatcttattactacttggagttcaactaataatagtattgaggcaatggcatcattcttaaattcgtttccaatgtttaaagatgatacacgcaatacacaccccaaattcgtagctaatgcaacttacaatttctcgagtggtgaaagtaaatcaagaagtaatatcaatttaacacttaatgccaaaaaggaatggcggaacatcttactttctacaggcgaggcatctatttctaatatggcagatgaaaaagctggtgtttctgcccgtgtcgtaacgttacaggatcaaccatacccagataattttgatttcactacattagataaggcatttcgagataattatggaacgctaggaaaagtattcatcaaacaatatcaatctaagcaagaatcatataaaaatgcatttgaaagttatcaacgttactttaatcaaaaagggagtaacgaaatcatgcaacgactaggacatgcattcgcgttgttacaggttagtggtgaaatactaaatgatattgagggatttgaacacgatcattttaaaatcattgaacaagcttataatagcatggttagaaataataaaacgattgataaacctaagcaactgttagaggaattacttcaatatttagatgcgaatagaaataatattgccggtgaaggttatagttcagtcaaaaacggtgatatcaaagctatatataaacgtgattatttatgtatcttgggtgaaacagtaaaagagaagttgagatatgaaatgcagactattacagggcagtgggataaaaaaggttatttaataaaaggtgaaaaagatagattacaaaagcaggttaaacatgaaacagtgaagtataggggttttgctataagacaagaagtactagaagaattgggctttgatttttctaattcatataatcctaattctgattattga

SEQ ID NO: 1689 - DNA, 180 bp, Staphylococcus epidermidis
ttattattcatctattcaacctccaaaaataatccatatgccgacgctaaaataaaaattgcaaaggctataaaaacatcaaatattaaagcaactgacaaagtcattaaaataataatcccaatatatagaaaatgtaacttcatattctccactcctttttacatccaatctttatga

SEQ ID NO: 1690 - DNA, 162 bp, Staphylococcus epidermidis
ctatattattctaaatttacacttaaaacacaaacttatgttcttgttttaactcattttattttatgcttaacaacccttaaaatcattgttttatcaacttttataagttttttccatatactatcacacactatgataaaagaacgtatgttctgttaa

SEQ ID NO: 1691 - DNA, 138 bp, Staphylococcus epidermidis
ccttcctgttctaacttagagataattgaatcaatagaatcacgagatatattggcgcgcacggttgtggttacaggctctaaaaaagatcgtgcaatgttttcagttttttctactccaaaatgtgtaacccaatga

SEQ ID NO: 1692 - DNA, 186 bp, Staphylococcus epidermidis
gatttaatctctgttgaattatattattgtactttagaaaataaaaaaggagcctcattcaatgagactcctttttgttatagcgtcctgggagggattcgaacccccgaccgatggcttagaaggccattgctctatccagctgagctaccaggacattttcaacacaagaattattatatctaa

SEQ ID NO: 1693 - DNA, 147 bp, Staphylococcus epidermidis
gagacaatctctccggcctctaaattacgctttaatccgcccaaagtggaagcacaaaacgtacaaccaattctacatcctacttgtgttgttacacagacagaatttccatattcatgtctcattaaaacagtttcaatagtataa

SEQ ID NO: 1694 - DNA, 663 bp, Staphylococcus epidermidis
aactcatcctcactacaaaccttcaaaatatttaaaagcagtatttgtaacaataaaacattaattttctataaatatgggtataaatcactgttgaagttttatttgaaaggatgtcattatatgggaattagaagtaaactaactaataatattacaaataaagtagggaactcattattgaacatagaggaaattaaagagaaaggtgatttgccaactacacaggaagaacttagacaacgcagagaaagagctgaaactctagttaaaaagaaatcgctactttcctccggtgctagtattgtccctattccaggacttgattttggagtagatcttaaattaatgagagatattatagaggatgtaaataaaatttatggtttagatcacgatcaagttaattcattgagtgatcaagtgaaagaaagaattatgtctgcagcggcaattcaaggaagtcaatttattggacgtaaggtatctgaggcgttgcttaaagttgtgattaaagatgtagctaaacgagcagctgccaaacaaacaaaatggttcccgtttgttgggcaagctgtatctgcatccattagctattattttatgagcaaattaggtaaagatcatattaataaatgtgaaaaagttatcaataacttatag

SEQ ID NO: 1695 - DNA, 144 bp, Staphylococcus epidermidis
aaattcacctctttaataggatttctgtttacacaaatgttttaccccgttattctattaataaacgtttgtaggactatagatgtatttcatgatattttaaagacaattaaacgatcttcatatataataattttgaggtga

SEQ ID NO: 1696 - DNA, 183 bp, Staphylococcus epidermidis
atcaatgactccaataggtttattcatacttcttcacccttatttttacaattaccttacattgtatcacagtatcatataactgtagatatttacgtttatagttcttgtaaagtgatattcctatctttattctacaatcatcaaaaaatgaccaaggcaaggttgccttggtcactataa

SEQ ID NO: 1697 - DNA, 1074 bp, Staphylococcus epidermidis
atgaagcgattttttcaacttatcatttctgctatagttattggtattttatgtttaatgattagtcattggtttaaatcaaaagataatacccactcaaatgagaaattatatgtttacaattggggagaatatattgatcctagcttaattaagaagtttgaaaaagaaacaggtatacaagtcgtatatgaaacctttgattcaaatgaagcaatggaagcgaaaattcgaaatggaggcacacactatgatgtagcttttccaagtgaatatactgttcaaaaattaaaaaaagctaaactgcttgagactttaaatcatgacaaaattccaaatatcagaaatttagacaatgattatatgaacttgtcatatgacccaaacaatcgatattcaattccatatttctttggtaccgtaggaattttatatgataaagagaaatatcctaatgaaacgttcgatagttgggacgatttgtatcattctcaattcaaaaatgatattttattagtagacggtgcacgcgagataattggaatgggattaaataaattagggtatagtcttaatgacaaaaatccgacccatatttatcaagcagaaaaagatttgcataatttagcacctcaagttagagggatagtaggcgacgaaattactatgatgcttcaacaaaacgaaggacatgttgcagtagtttggagtggcgttgctgcaccacttgtacaggaaaatactcgttataattacgtgatacctaaagaaggctctaacctatggtttgataatatggtgatacctaaaactgcacaaaataaagaaggtgcgtataagtttatgaatttcttactagacgcgcaaaatagtgcccagaatacggaatgggtagggtatgcaacacctaataaagcagctcgaagtaagttgcctaaaaaggtaagaaatgattatagattttatccatcaaatcaagaacagcaacggttagaagtctataaagatttaggtcaaacgtctctcagtgaatataatgaaagctttttaaattttaaaatgtctttaaaatag

SEQ ID NO: 1698 - DNA, 957 bp, Staphylococcus epidermidis
tttactatatcattatattatatgagaaatttaaggaggggaattatgaacaaagatcaaactttgtcacatactacgggccgtgtatccttcaaagaattacaacaaattattaaaatggcccttgttcaaggtaatttaatacctgcttttgcaggcgcatggcttgcaatagtaatgacaaaccattccttcctatcttccattccacaaatactattgatgctagttggctctacgctaattatggggggcgcttgtgctttaaataattattatgatcaagatattgatcgcattatgcctagtaagcaaagtagaccaacagtaaatgatagaatatctgatagaaacttattaatgttaagttttgggatgatgttaataggtgaagcatgtttattcttattaaatataccttctggtgttttaggattaattggtattgttggatatgtatcttactattcaatttggtctaagcgccatacaacttggaatactgttgttggaagttttcctggagctgtaccaccattaattggttgggtagctatcgatggatcattaagtttagcagcagtagcactctttttagttgtcttttgttggcaacctatccatttctacgctctagcaattaaacgtagtgatgagtatgcgcttgcaaatattcctatgttaccatcagtgaaaggtttcaaacggacaagagtaagcatgtttatttggttagtgttattattaccattgccattcttattatctaatttaggtgtaacttttgttgttattgctacactacttaatttaggatggttagctttaggttttacaacgttcagaaaagaatctaatcaaactaaatgggcaacgcaaatgttcgtttattcattgaactacttagtagtattctttgcactcgttgtagttgtttcattaatcaagatgatataa

SEQ ID NO: 1699 - DNA, 1374 bp, Staphylococcus epidermidis
gtttatggattggagtgcattaaattgctaaattacactgaattagaaaataaaaatgttttagtagtaggcttagcaaaaagtggatatgaagcggcgaaacttctccttaaattaggggctaacgttaaagtcaatgatggaaaggatctttcacaggatgcacatgctaaagatttagaatctatgggcattgaggtaattagcggtagtcatcctttttctttattagatgatgatcctatcattgtgaaaaacccaggtattccatatactgtatcaattattaaagaagcagcaaatagaggccttaaaatcttaacagaggttgaacttagctatttaatttctgaggcaccaatcatagcagttactggaactaacggtaaaactactgtcacttcactaatcggtgatatgttccaaaaaagcgtgttgactggacgactttctgggaatattggttatgtagcctcaaaagttgcacaagaagttaaatcagatgagtatttaataacagaattatcatcttttcaattattaggcattgaggaatataaaccacatatcgctatcattactaatatttattctgcacatttggattaccatgaaacgttagagaactatcaaaatgctaaaaagcaaatatataaaaatcaaactaaagacgattatctcatttgtaattatcatcaaaggcacctaattgaatcagaaaatctagaagcgaaaacattttatttttcaacacagcaagaagttgatgggatatacattaaagatggtttcattgtttttaacggcattcgcattattaacactaaagacttagtgctaccgggagaacataacctggaaaatattttagcagctgttctagcatcaatcattgctggagtgccagtcaaagctattgtagatagtcttgttactttttccggtattgatcatagacttcagtatattggtacaaatcgcacaaataaatattataatgattcaaaagcaactaatactttagctactcaatttgcgcttaactcttttgatcaaccaattatttggttgtgtggtggattagatcgtggtaatgaattcgatgaacttattccttatatggaaaatgtacgtgtgatggttgtttttggagaaacacaagataaatttgctaaattgggaaatagtcaaggtaagtatgtgattaaagcaacagatgtagaggatgctgttgataaaattcaagatatagtcgagcccaatgatgttgttctattatcaccagcttgtgcaagttgggatcagtatcatacatttgaagaacgtggtgagaagtttatcgatagattccgagcgcacttgccatcatactaa

SEQ ID NO: 1700 - DNA, 183 bp, Staphylococcus epidermidis
gttttaaaatctttaggtaaccccattacttcatttatttcatatacaatattattttgggctaatgttttctttattacgtttttaaatgccttaagagaaaatgcacttgaattcgtacataatagtaatgtacctcctggcgataaaatgttaagggctccttcaattaataaattataa

SEQ ID NO: 1701 - DNA, 1242 bp, Staphylococcus epidermidis
gtaaagtttttagcttctcaattattcaaaggaggtttttttatcgattacttaggtgttgatattagtaaaagaagtagtgtagttgcacattataaaaatggaaaattccaaaaagagtttttcatccaaaataataaaaatggttacaattatttactcaagtatttgaatgacttacaccacccacaactcatttttgaatctacaggtatctattcaagaggtatgcaacgattttgttgtgtaaatcaaattaactatattcaaatgaatccgttagaagccaaatttaaaacgagcactctaagatcatggaaaactgatcaggcagatgctcataagcttgcttgtttaggaccgacgcttaaacaaacaggcaacttacctatacatgagttaatattctttgaattaagagaacgcgtccgttttcatctagaaatcgagaatgaacaaaatcgacttaaatttcagatccttgaattactccatcaaacattccctggtttagaaagattatttagtagtcgatattcaatcattgcactcaacatcgcagaaatctttactcatccagacatggttcttgatatcgacaaggatgtactgattacacatatattcaattctacagataagggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 1702 - DNA, 1725 bp, Staphylococcus epidermidis
ataattatgtctaaattaattaaagggattgctgcatcagatggtgtggcaatcgcaaaagcttacttaattgtagagccagacttatcctatgacagtaacgaaaaagttactgacatagaaagtgaagttgaaaagtttaatgacgctatcgaagcttcaaaaatcgaattaactaaaataagaaataatgccgaagctcaattaggtgctgataaagcagcgatttttgatgcacatttacttgttttagatgatccagaattaatacaacccattcaagacaaaattagaaatgacaaagtcaatgctgcaactggtttggatgaagtaacgacacaatttatttctatttttgagtcaatggataatgaatacatgaaagaacgtgcagctgatatcagagatgtttctaaacgtgtattggctcatattctaggtgtagatttacctaatcctagtttaatcaatgaaagtgctgtcattgtaggtaatgacctcacaccttcagatacagcacagttaaataaagaatttgttcaaggttttgtaactaatatcggtggtagaacaagccactctgcaattatgagtcgttcattagagattgcagctgttgtcggtactaaatctatcactgaagaagttaaacaaggtgatatgattattgtagatggtatgtccggagatgttatcatagatcctacagaagatgagttaattgcttatcaaaataaacgtgagcgtttctttgaagataagaaagaacttcaaaaattgcgcgatgctgatacagtaacagttgacggtgttcatgctgaactagctgctaatattggtactccagatgacttatcaggagttattgataacggtgcacaagggataggtttataccgtacagaattcttgtacatgggtagagatcaaatgcctactgaggaagaacaattcgaggcttataaaaaggtacttgaaactatggacggtaaacgtgtagttgtacgtactttagatattggcggagataaggagcttccatacttagatttgcctaaagaaatgaatccattcttaggttatcgtgcgatacgtttatgtttagcacagccggaaatctttagaccacaattacgtgcattactacgtgcttcagtctatgggaaattgaatattatgttcccaatggtagcaacaattaaagaattccgtgacgctaaatcaatgcttcttgaagagaaagaaaatcttcttcgcgaaggttacgaagtttcagatgatattgaattaggtattatggttgaaattccagctaccgcggcacttgctgatgtatttgctaaagaagtagatttctttagtataggaacgaatgacttaattcaatacacattagctgctgaccgtatgtctgaacgagtttcatacttatatcaaccatataatccttcaattttacgattagttaaacaagttattgaagcttctcataaagaaggtaaatggactggtatgtgtggtgaaatggctggagatcaaacagctgtgcctttattattaggtttaggtttagatgagttctcaatgagtgcgacttctatcctaaaagctagaagacaaatcaatggtttaagtaaaaatgaaatggctgaactcgctaatagagctgttgaatgctcaacgcaagaggaagtcgttgatttagttaaccaattagctaaataa

SEQ ID NO: 1703 - DNA, 2055 bp, Staphylococcus epidermidis
ttcatcatgtcaaaagttcatcttattgagagcccatatgcattagataaaattaaaggtataggtccgaaacgtttagcgttgttagaagaattaaatattaaatcagttgaagatttagtattatatttaccaacacgttatgaagataatactgttattgacttaaatcaagcagacgatcaagcaactgtaacagtgcaaggtgaggtttattccagtccaactgttgctttttttggtcgtaataaatcgaaactaactgtccatcttatgataaatcatatcgctgttaaatgcgtattttttaatcaaccttatttaaaaaagaaacttgaactaaatagtattgtcactataaaagggaaatggaatcgtaataaacaagagattaatggtaatcgtatattttttaaagatcaaaaaaatcaagaggatactcatttagaaccaatatataggattaaagaaggaataaagcaaaagcagttacgcgataatattagacaggcgcttagtgatgttacaattcatgaatggttaactgatgacctcagagaaaagtataaattagaaactttagcttatacaatacaaacactacatcatcctattaataaacaaaatttgctaagagctagacggacttatgcatttacagagctatttatgtttgagctacgtatgcaatggttaaatcgcttagaaaagacatcagatgaggctattgaaattaattacgatataaataaagtaaaacaatttattgatagtttgccatttgagttaactgacgctcaaaaagttagtgtcaatgaaatatttcgtgatttaaaggcgcctattcgtatgcatcggttgttacaaggtgatgttggatctggcaaaactgtggtagcagcaatttgtatgtacgccttaaaaactgcaggctatcaatctgcattaatggttcccacggagattttagctgaacagcacgctgaaagtttaatacaactatttggtaatacaatgaacgtagctttattaactggttctgttaaagggaaaaaaagacgacttcttttagagcaattagaaaatggaactatcgattgtttgattggtacacacgccttgattcaagatgatgtagtcttcaataatgttggattagtcattacagatgaacagcaccgatttggtattaaccaacgacaaattctaagagaaaaaggtgcaatgacaaatgtattgtttatgacagcgacaccaatccctagaacactcgctatttctgttttcggtgaaatggatgtatcttcaattaaacaattaccaaaagggagaaaacctataaaaacaagttgggccaaacatgaacaatatgatcaagtacttgcacaaatgtcgaatgaattaaaaaaaggtagacaagcctatgtcatctgtccattaattgagagctctgagcatttagaagatgtacaaaatgttgtggcactttatgaatccttacaaagtgattatggtaatgaaaaagttggattattacatgggaaaatgtctgcagaagataaagatcaagtcatgcaaaaattcagtgaacatgaaatagatattttagtttctactactgtagttgaggtaggtgtaaatgtacctaatgcaacgtttatgatgatttatgatgcagatcgattcggtttatctacattacatcaattacgtgggcgtgttggtcgtagtgaacatcaaagttattgtgtattaattgcatctcccaagactgaaacaggtattgaacgtatgaccattatgactcaaactactgatggattcgaattaagtgaaagagatttagaaatgagaggtccaggggatttctttggagtaaaacaaagcggtcttccagactttcttgtagcaaatgtagtagaagattatcgtatgcttgaagttgctagagatgaagcagcagaacttatacaatctggccaatttttcgaacaacaatatagtcatttaagagagtttattaaacaaaacttacgccatattcgtttcgattag

SEQ ID NO: 1704 - DNA, 1053 bp, Staphylococcus epidermidis
atatatttgttctttattgattcatttccaccttactatgtaaagagcctgagacttaaaagtctcaggctctttttatttcgttatcgtaacaatcccataccatgttatgctttaattattatgaaatacggagatgatgatatgtctattcccattataattgatactgatcctggtatagatgatgctacagcaattagtatcgcactttcacaccctcaatttgacgttaaaatgatatcaactgtgaatggtaatgtaggtattgagaaaacgacagcaaatgcattaaagctaaaaaggttttttaatagttctgttcctgtacatagaggggcatcccaaccattgattaatgacatctttgaagctacatcaattcatggtgagtctggtatggatggttacgagtttccacaaataaatcaagatgatttaacatcaattcatgcagttgaagcaatgagaaatctattagtaaatactcaagaacctttaaccttgattgccataggtccactaacaaatatcgctattcttttaactagttatcccgaagttcaaccatttattaaggaaattgttttaatgggtggtagtaccggtagaggtaatgtaacgcctttagctgaatttaatatatattgtgatccagaagctgctcaaattgtatttaactctggattacctttgactatgattggtcttgatttggctcgtgaagcattgtttactcaccattttgtaaaagacttcaaagatacaaatgcaacttcaaacatgttatataatttatttcagcactataagagtgaagattttgaaataggatttaaattatacgatgtattcactatattatatttgttggatccagaagcctttaatgtcaaggaggcgtatactcaaatagaattaaatggcaactttacaaggggagccacagtggtagactttaatatggagcatcccaattgtacagttgttttaagtcctgttgaaagacagtatgaggatttattcttaaacgccctttcttattgtaaataa

SEQ ID NO: 1705 - DNA, 705 bp, Staphylococcus epidermidis
gtgtcattgttatatgaaggtaaagctaaaagagtattcacgacaaatattgatggacaattacgagttgaatataaagatgaggtaacagcaggaaacggtgcaaaaaaagatactatgattggcaagggtaagttaaataatcaaattacttctattatatttgattatttaactcataatcatattgacaatcactttattaaacaactttcacaaacagaacaactcgtccaacaagttgatattatacctttagaagttgttgttagaaacattgccactggttcgatcacaaaacgtcttggttttaaaaaggggcatacatttgaagaacctctagtagaattcttctacaaaaaagatgaacttaatgatccgcttattactgatgaccatgtaaaattactcggcatagcgaacgatgaagaaataaaacaacttaaacaaatggcaaaagatattaatcaagtactgattcaattgatgaatgaaatgagtttgagacttgtagattttaaggttgaatttggtaaaaccaatggtggaaaaattttacttgcagatgaaatctctcctgacacttgtagaatatgggataaaaatacggatactaactttgataaagatgtatatagaaacaacactggctcgttgattgaaacttatcaaacatttttaaataaattggaggatcttaaataa

SEQ ID NO: 1706 - DNA, 222 bp, Staphylococcus epidermidis
agccaattgtttttacgatatttctttttcacactgaacccaacaccaaatgttgcaatgagaagtataaatgttaaaatcatcaatggaacattagcaacacctaatgcgaaactaaataaagttaaaaaaatgacagccaatattgagaagatccagaaaatacctttagattttttttgttgcatcccataccccaccttttacttatcttttcaataa

SEQ ID NO: 1707 - DNA, 207 bp, Staphylococcus epidermidis
aatatgtctccatcttcaaaagtttataattctattgtaagtgaatatatatcattttcaaagtcaataatgatgtattctttaaaattgatatatcctttgaaaattaatcaaatttgtatttcttttatttcagcgattttaattttaaaacgtatgattattgttttgaaaacagaaaaaatattcaataattattttatatag

SEQ ID NO: 1708 - DNA, 750 bp, Staphylococcus epidermidis
agacatatgttaaacgcacaatttttcactgatactgggcaacatcgtgagaaaaacgaggacgctggcggtatattttacaatcaaacacagcaacaaatgctagtattatgcgatggcatgggtggacatcaagctggagaaatagctagtcagtttgttacttatgaacttcaaaagcgttttgaagaagaaaatctaattgaaataaatcgtgctgaatcgtggttgcgttcgaacattaaagaaatcaattttcagctgtacaactatgctcaagaaaatgaagattacagaggtatgggtacaacgctcgtttgtgccatcatttatgacaaacaagttgttgtagcaaatgtaggagattcgcgcgcttatgtaattaatcagagacagatggatcaaattacgagcgaccattcatttgttaatcacttagtaatgactggacaaattactaaagatgaagcatttcatcatccacaacgtaatattattactaaagtcatgggaacagataaacgtgtttctccagatttatttatcaagagaactcatttttatgattatcttcttttgaactctgacggacttactgattatgtcagagattatgaaatccaagaactactaagttcaaataattcattagacgtccatggtaatgagttattggacttagcgcttgcccatgattcaaaagataatgtcagctttatccttttaaagttagaaggtgataaagtatga

SEQ ID NO: 1709 - DNA, 540 bp, Staphylococcus epidermidis
gatataatgttaagtgttgctttagatgacattaaaaagaatggaggcacttctttgaaaaagaaatactatattagcatctctttacttatgacaatcattgtattagttttcgatcaagtttctaaatggcttattacaatctcaatgaaggttggagattcatatgaaattatccctaactttttaaatattacatcccatagaaacaacggtgcagcatgggggattttgagtggtaaaatgctatttttctatattattactatcattattttaatcgttttagttattttttatattaaagaagcacaatttaatttgtttatgcaagttgcaataagcctattatttgctggagctttaggaaattttattgatcgcgtattacatggcgaagttgtggattttattgatacaaatatattcggatacgattttcctatctttaatattgcggattcaagcttaacaattggagttatattcgtaatcatcgcactcattaaagatgcaatcataaataagaaggaggtctag

SEQ ID NO: 1710 - DNA, 2409 bp, Staphylococcus epidermidis
acaataatgttaatttcaaatgaatggctaaaagattatgtgaatgttgaccagtcagttcaagcgttagcagagagaattacaagaactggaattgaagtcgatgatattattgactatacaaaagatattaaaaaattagtagttggacatgtcttgtcgaagacgccacatccagatgctgataaattaaatatttgtcaagtagacttaggtgaagaagaaccagttcaaattgtttgtggtgcaccaaatgtagatgaagggcaacacgtgattgttgctaaagttggtggtcgtttacctggtggaattaaaattaaacgtgccaaattacgtggcgaacgctctgaaggtatgatttgctcattacaagaaataggtatttcaagtcatgtaactcctaaaaattatgagtcaggtatatatgtatttccagaagcagttaaacctggaacagatgcgttagaagcaatatatcttaatgaccaagtgatggaatttgatttaacacctaatcgtgctgatgcattaagcatggtaggtactgcgtatgaagtcgcagctttatatcaaactaaaatgaataaacctcagttaacaagcaatgaaagtcaagaatctgctaaagatgaactaacaatagaagttaaaaatgaagataaagtaccttactatagtacacgtgttgttcatgacgtgactattggtccttctccagtatggatgcagttccgattaattaaagcgggaatacgtccaattaataatgtggtagatatttcaaattatgtacttttagaatatggccaacctctacacatgtttgatcaagaacaaattggttcgcaatctatagaagttagacaagctaaaaaagatgagacaatgagaactttagatggtgaagaacgtcgattgttagatactgatattgtcattacaaatggcaaagaccctattgcattaggaggtgttatgggaggggatttctctgaagtcactgaacaaacacgacatgttgtagtagaaggggctatctttgatcctgtatctattcgacatacatcacgccgtttaaatttaagaagcgaatcatcgagtcgatttgaaaaggggattgcaactgaatttgtcgatgaagctgtagatagagcttgttatttacttgaaagatatgcttcaggaacagttttaaaagaccgagtttcgcatggagatttaggatcatttgtgaccccaatagaaatcactgctgacaaagttaaccgtacaattggttttaatttaactgatgaagaaatcattgatatttttgagcaattaggatttgacactgaaaataaaaatggtgaaattaccgtgaatgttccatcaagacgtaaagacatttctattaaagaagacttaatagaagaagtagcacgtatatatggatacgatgaaataccatcaacgctacctgtatttaaagatgttacaagtggagaactaacagatcgacagtttaaaacgcgtactgttaaagaaacgcttgagggcgctgggctagaccaagctattacttattcattggtatcaaaaaatcatgctaccgattttgcactacaaaatcgtcctacaattgaattacttatgcctatgagtgaagcacattccacattacgtcaaagtttattaccgcatttaattgatgcagtatcatacaatgttgctcgtaaaaatacaaatgttaagttatatgaaatcggacgtgtcttctttggtaacggtgaaggtgagttaccagatgaagtagaatatttgagtggtatattaactggagactttgtaaataacacttggcaaggtaagaaagagtcagttgatttctatttaactaagggtgttgttgaacgtattgctgaaaagcttaatcttcaattcgattttagagctggtcaaatagatgggttacatccaggaagaacagcaattgtgtcacttaatggtaaagatattggtttcataggtgagctacaccctacgttagctgcaaacaatgatttaaagcgtacgtatgtatttgaacttaattatgatgcaatgatggaagtttctgtgggatatattaattatgagcctatacctagatttccaggtgtaacacgtgatattgcattagaagttaatcatgaagttacttcatctgaattgttatccattattcatgagaatggtgaagatattttaaatgatacactcgtatttgacgtatacgagggtgaacatttagaaaaagggaaaaaatctattgcaattagacttagttatctagatacagaaaacacacttaccgatgaacgtgtaaatgctgtgcatgataaaattttagaagcacttaaaaagcatggtgcaattattagataa

SEQ ID NO: 1711 - DNA, 240 bp, Staphylococcus epidermidis
aaaaatgttactggaggtcaaaaaataatgttaaatccaccgttaaaccaacttactgcaaaagtgaattcaaaatatcttattgccactacggcggctaaaagagcacgtgaattagatgaaaaacgcgaaacagcgcttttagatcagtaccattcagctaaacctgttggaaaagctttagaagaaattgctgatggtaaaatagaacctgttgtaccgaaagagtatttaggataa

SEQ ID NO: 1712 - DNA, 135 bp, Staphylococcus epidermidis
tacaaatctacgttattatttaaccttttttatttcacagttgacatttatgtaaaattcagcagaatatttatttatccaaaagaaattacacaacaattttacgactactttttcgaaagatttgcgtcatag

SEQ ID NO: 1713 - DNA, 564 bp, Staphylococcus epidermidis
agatatgagtttttttatattaaaagaggtgaaacaatgtctgaacgaattattttagatgaggcagcgatacaacgtacaattacacgaattgctcatgaaattctagaatataacaagggaactaaagatttagttctattaggcattaaaacaagaggtgcttttttagcacatcgtatacaagataaaataaattcaatagaacaacaattagtaccaacaggtactatcgatatcacgcattttcgagatgatgttgataaggtagtgcaacaagctgatcaatacgcttttgatattaatgtagatattaataacaaagtggttgttatcattgacgatgttttgtataccggacgtacagtaagagcctcattagatgcgattttattacatacaagacctattaaaatagggcttgcagcacttgtggatcgtggtcatcgtgaactccctatacgcgcagattttgtaggaaaaaatatacctacagcacgagatgaatctgtttcagtttatttagaagaaattgacgatagaaatgcagtcgtcattgaataa

SEQ ID NO: 1714 - DNA, 135 bp, Staphylococcus epidermidis
ctgcttgctactggcccttttgcattaaaaacttctatatttgaacaaccactaagtaaaattagtgtgccaaataatagaagcaaagacttaaattttgacactttttttgacctcctaatactacaaatgtag

SEQ ID NO: 1715 - DNA, 234 bp, Staphylococcus epidermidis
gaggacaatacaacaatggcagtatttaaagtattttatcaacataataaagatgaagtcatcgttcgtgaaaatactcaaacaatttatgttgagggacaaactgaggaacaagtgagacgttatttgaaagaccgaaattttaatattgaatttattactaaattagagggcgcacacttagaatatgaaaaagaacattcaacacactttaatgtggagaacgccgaataa

SEQ ID NO: 1716 - DNA, 294 bp, Staphylococcus epidermidis
cggatgaatacaatcgtaaaacatacagtaggttttattgcttctatcgtactaacgcttttagcagtttttgtaactctatacactaatatgacattccatgctaaggtaactatcatctttggttttgctttcattcaagctgcccttcaattattaatgttcatgcatttaactgaaggtaaagatggacgtttacaatcgttcaaagttatctttgcaattatcattactttagtaactgttatcggaacatactgggtaatgcaaggtggacactcttctcacttataa

SEQ ID NO: 1717 - DNA, 123 bp, Staphylococcus epidermidis
agtgtgtgtaccccaacattattgttgggtacgatggttatgattccttttactcatgatcattttaagatagataagtttaaagtcatagagtttcaatataacttttatcatttaggttaa

SEQ ID NO: 1718 - DNA, 240 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattctagagactgaattcagacatcatcgtgatgcaatatcataccatccaaaaataatgttaaaagtagttttatatgcctatacccaatctgtgttttcaggacgtagatag

SEQ ID NO: 1719 - DNA, 126 bp, Staphylococcus epidermidis
actgagccaacacttgtaatgataaattctacaagtgttggctcaacttatacttcttcaattgtctttatctcttctattcactcaacaatgcgaatcatttctgataaatcattaatgatataa

SEQ ID NO: 1720 - DNA, 1905 bp, Staphylococcus epidermidis
tataataaaacagttgcaattaaaagtgggagtatacacaagaaaggaatttataaaatgactaatttaagagaagatgttcgtaatatagcgattattgcgcatgtcgaccatggtaaaacaacattagtagaccagttgcttaaacaatcaggtatatttcgtgaaaacgaacatgtcgacgagcgtgcaatggactctaatgatttagaaagagaacgtggtattacgattcttgctaagaatacagcgatagattataaaggaacgcgtatcaatatattagacacacctggccacgccgattttggtggtgaagttgaacgtatcatgaaaatggttgacggtgtcgtactagtggttgacgcatatgaaggtacaatgcctcaaactcgttttgttcttaaaaaagctttagaacaaaacttaaaaccggttgtagttgtgaataaaattgataaaccagctgctagacctgagggagttgtagatgaagtattagacttattcattgaattggaagcgaatgatgagcaattagacttcccagttgtttatgcttcagctgtgaatggaacagcaagtttagactctgaaaagcaagacgaaaatatgcaatccctatacgagacgattattgactatgtaccggcaccagtagataattcagatgaaccattacaattccaaattgctttactagattataatgattatgtaggtcgtataggcgttggacgtgtgttcagaggtaaaatgcgtgtaggtgataatgtatcactaattaaattagatggtacagttaagaactttcgtgtgacgaaaatatttggttactttggtcttaaacgtgaagaaattgaagaagcacaagcaggagacttaatagctgtttcaggtatggaagatattaacgttggtgaaacagttacaccacatgatcatcgtgacccattaccggtgttacgtattgatgaaccaaccctagaaatgacttttaaagtaaataactctccgtttgctggacgtgaaggtgattatgtaacagctcgacaaattcaagaaagattagatcaacaacttgaaacagatgtttctttaaaagttacacctactgatcaaccagattcatgggttgttgctggtcgtggtgaactacacttgtctattcttattgaaaacatgagacgtgaaggctttgaattacaggtttctaaacctcaagttattttaagagaaatcgatggtgtgttaagtgaaccatttgagcgtgtacaatgtgaagtgccttctgaaaatgccggggcagtgattgagtcattaggtgcacgaaaaggtgaaatgttagatatgatgacgacagacaatggtttgacgcgtttaatctttatggtacctgcacgcggtatgattggttatactactgaatttatgtctatgacacgaggttatggaattattaaccatacatttgaagaatttagacctcgcgttaaagctcaaatcggtggtagacgtaacggtgcattgatttctatggaccaaggtcaagcaacatcttatgcgattattaacttagaagatcgtggtgttaactttatggaaccaggtactgaagtatatgaaggtatgattgttggtgaacataaccgtgagaacgatttaacagtaaatattactaaagcaaagcatcaaacaaacgtacgttcagctactaaagatcaaacacaaacgatgaatcgtcctagaattttaacattagaagaagcgttacaatttatcaatgatgatgaattggtggaagtaactcctgaaagtattcgcttaagaaagaaaatacttaataaatctgcccgtgaaaaagaagcaaaaagagttaaacaattaatgcaagacgaacaataa

SEQ ID NO: 1721 - DNA, 189 bp, Staphylococcus epidermidis
cgaatcaaaacgtatccgatcgttttggagttattaactcatttaggagtgttaataatgaaattatttaacgcttttaaagacatcttagaagcagccatcactaacgatggcactcaattaggggcaagtattgttaacatcatagaaagtagcgttgatatggtgaatcgatttttgggaaattag

SEQ ID NO: 1722 - DNA, 264 bp, Staphylococcus epidermidis
ataatgaaaacgattgaactacatatcactttacaaccacaagttttagatacacaaggacaagctttaaaccgagcagttcacgatctcggttatgaacaagtgaatgacattcgagtaggtaaagttttatatatgacagttaatgaaccaactgacgaggctgttgataatattattacgacactaagtgaaaagttatttgctaatacagtcattgaagaatatagctataaagttatcgatgaaaaggagaaagcataa

SEQ ID NO: 1723 - DNA, 468 bp, Staphylococcus epidermidis
aataaagaaacaaagggggataacgttatgggtgaagttaaacatttacaaatcaattacaaaacagatgagcttttcgctgatttcagagaatttggtaacaagaacctatatatgattgaggagttaaagggacaaatgattgatgcaagttccgattctcctttttatggaatttttgttggtaataaattagttgcgagaatggcattacttgataaaggagaagtagaagaaacctatttccctaatagcaatgactatattcttctttggaaattagaagtattagatacgtaccaaagacgtggatatgctaagcaactattaaactttgctaaagaaaataaaaaaccaattaaagctattgctagaaataactcaaaagaattctttttaaaacagggttttaaagatgtagaaaccaaaaatcctgaggggcacgacatcttaatatggaatccataa

SEQ ID NO: 1724 - DNA, 126 bp, Staphylococcus epidermidis
aagaaattgacgatagaaatgcagtcgtcattgaataattatccttttaaaacagtacgagagactgaaaaaggtgaagtgtttcttatggataaatctacatatgactataaaaagattatgtaa

SEQ ID NO: 1725 - DNA, 141 bp, Staphylococcus epidermidis
atttttatgacaaataaagaattcgaaaaaaaatcagcagaaaaagccaaagaagtagaagaaaaacttaaagaacaaaacgaagaaaaaacagatgatatcgaacaaacaaagaaagatattcaagatacactagattaa

SEQ ID NO: 1726 - DNA, 243 bp, Staphylococcus epidermidis
attatttatttaatacgatttgagattatatcttttatctttgaatttcttacaaaaaggagtttagagctaaaagttcttaaactagtaaaaagagacaatttctatattatttcatatagaaattgtctcttttataattttcaaactataataagcttgttgatatactatcttacttatataagttcctttaatacaaatcatattccttctataactagccaattgtttttggtttag

SEQ ID NO: 1727 - DNA, 144 bp, Staphylococcus epidermidis
ttatttaaagcacaagcgccccccataattagcgtagagccaactagcatcaatagtatttgtggaatggaagataggaaggaatggtttgtcattactattgcaagccatgcgcctgcaaaagcaggtattaaattaccttga

SEQ ID NO: 1728 - DNA, 198 bp, Staphylococcus epidermidis
aaattattttatatgactatgcatcacttaaaagaacattcaatcaataaactaaaacaatatatcctactattaacctacctaaaatcagacacatcttatagacatattattcaacttaattctttctatataagatcatatttttctataagtaatattctttttttgtatctaattgataagatttatcaataa

SEQ ID NO: 1729 - DNA, 159 bp, Staphylococcus epidermidis
gttgtattttatacttacttaatgaagtgtttttttaaaagtaattcaaatgtcattaggattaatttaaaaacaacaaagtacatgcaaaataaaactgctttatttattcaaaaacatcatgtaaaatataacttaactgaaatcttagtaaattga

SEQ ID NO: 1730 - DNA, 141 bp, Staphylococcus epidermidis
ctgttgctttatttaagttttttaacagttaggcatgcacaactgtattgtgctcgattttatcgatataaacatatgagattttatatcaaattaacatttatgtataaaaacctctattatagtgaaaaatataaataa

SEQ ID NO: 1731 - DNA, 912 bp, Staphylococcus epidermidis
attaagctttatttctataggaggcgctttatggaacacttattatcaatggagcatttatctaattcagaaatttatgatttaattactatcgcttgccaattcaaatctggtgagcgaccattacctcaatttaacggtcaatacgtatcaaacttattcttcgaaaattcaacgcgaacaaagtgtagctttgagatggcagaacaaaaattaggattaaaacttattaattttgaaacaagtacatcatctgtaaaaaagggtgagtcactttatgacacatgtaaaacacttgaaagtataggtgttgatttacttgtcatacgtgactcccaaaattcttattacgaagaactggatcaattaaatattccaattgctaatgcaggtgatggaagtggacaacatcctactcagagtttattagacataatgacaatatatgaagaatatggttcgtttgaaggtttgaatattctaatatgtggggacattaaaaattctcgtgtcgcaagaagtaattatcatagtttaacatcattaggtgccaacgtaatgttctcaagtccaaaagaatgggtagataatacattagaggcgccttatgttgaaattgatgaagtcattgataaagtagatattgttatgttgcttagagttcaacatgaaagacatggaatttcaggtgaagctaactttgctgctgaagaatatcatcaacaatttggtttaacacaggctagatatgataaattaaaagaggaagccattgtaatgcatccagctcctgtaaatagaggtgttgaaattaaaagcgagctagttgaagcacctaagtctcgaatatttaagcagatggaaaatggaatgtatttaagaatggcagtaataagtgcgcttttacaatag

SEQ ID NO: 1732 - DNA, 132 bp, Staphylococcus epidermidis
attttcatttatctttattatgtgagtgaaaaaaagagaaagattaaaagaagaaacacgtatatattttttattactgcgcttaaaaagataaacatacactttcaacaaagtaatcatttaattatttaa

SEQ ID NO: 1733 - DNA, 147 bp, Staphylococcus epidermidis
tccctttcttactttataaaaaatacgccttatcaattatttttactgatagggcgtatttttatggactgcattcaacatttaatagtcaaacatcaatctaaacctattaatatatatatggatcgtcctttttttgtttgttga

SEQ ID NO: 1734 - DNA, 747 bp, Staphylococcus epidermidis
gtgaaaagttatttgctaatacagtcattgaagaatatagctataaagttatcgatgaaaaggagaaagcataatatgaaatttgcagttcttgtgttccctggttcaaactgcgatagagacatgtataacgcagctattaaatcaggtgttgatgcagcgtatgtcgattatcgtgaaacgactttagatggttttgatggtgttttaatacctggtggtttttcatttggcgattatttgagatcgggagctatggcaagtgttgctccgattattaaagaagttaagcgatttgcgaaagaaggtaagcctgttttaggagtatgtaatgggtttcaaattttaactgagattggattgttaccaggcgcattacttcataatgattcacatttatttataagtagaaacgaaactttaaaaattactaataatcaaacaccttttacgcatttatatgtgaaaaatgagaatgttgtttatcctgtagcacacggtgaaggtcattattattgtactgatgaaatatatcgtgaactcaacgataacaatcaaattatccttaaatatacgaataaccctaatggctcttatgaggatattgcaggaatagttaataaagagggaaacgtttgtgggatgatgccacaccctgaacgcgcacttgaaacattattaggaacaaatagtggtgtgaaattgtttgaatcaatggtgaaaagttggagggaacaaaatgtctaa

SEQ ID NO: 1735 - DNA, 1896 bp, Staphylococcus epidermidis
ataaacatctataagattaacataaataaagactggggcattacattgagtaattgctccagctttattttgttttcattaatcaatttgataatggaaaggaggagccctttggaggaatatcaaaagaaaattaaagaaaaattaaacgtagtccctttagagccgggttgttacttaatgaaagatagaaatgatcaggttatatatgtggggaaggcaaagcgtttaagaaatcgtctacgttcttattttacaggcgcacatgatgctaaaacaacccgtttggttggagaaatacgtaactttgaatttatcgtgacatcaagtgagacagaatcgctactgctagagcttaatcttataaaacagtatcaaccccgatataatattttattaaaagatgataaaagttacccttttattaaaattaccaaagaaaagcatccacgattacttgttactcgtactgtaaaaaagaattcaggcaaatactttggtccataccctaatgcatattctgcacaagaaacaaagaaattacttgatcgtatctatccatttagaaaatgcgataatatgccagataagctgtgtctttattaccatattggacaatgcatgggaccgtgtgtctatgatgttgatttagagaagtatgctcaaatgacaaaagaaattacggactttctaaatggggaagataaaacaattttgcatcatttagaagaccgcatgaataaagcgagtgaacagttagattttgaacaagcaaaagaatatagagatatgattcaacacattcacaatttaactaaaaaacaaaagattatgtcttcagataatacaattagagatgtttttggttatagtgtttctaaaggctggatgtgtgttcaagtcttcttcgttagacaaggtaatatgataaaacgtgatgctacaatgataccgttacaacaaacagaggaagaagaattttatacttttataggtcaattttatagtttaaatcagcatctattacctaaggaagttcatgtacctaaaaatcttgataaagacatcattcagtcagtggtagatactaagattgttcaaccagtacgaggagctaaaaaagacatgattaatttagcgaatcacaatgctgaagtacaactcgataataaatttgaattaattgctagagatgagtcaagaacaatcaaagcaattgaagaattaggagagcgtatgggtatccaaacaccaataagaattgaagcttttgataattcaaatattcaaggtgttgatccagtttcagcaatggttacatttgtagatggcaaacctcataaaaaagattatcgaaaatataagattaaaacagtggaaggacctgatgattataaatctatgagagaggtcgttcgtagacgctatacacgtgtactcaacgaggggctacctctaccagatttaataatagttgatggtgggaaaggtcatatgaatggtgtgatggatgtactcgaaaatgagcttgggctagatataccagttgctggtttacaaaaaaatgataaacaccaaacatctgaactactttatggagcaagtgctgaaatagtacctttaaaaaagaacagtcaagcattttatctattacaccgcatacaagatgaggttcatcgatttgcaattacattccaccgacaaacacgtcaaaaaacaggtctgaaatctgttctagatgacattgatggtattggaactaagagaaaaacttcattattacgtacatttggatcgattaagaaaatgaaagaagcatcctttgatgaattacgacaagcaggcttgcctgaaaaggttgctaaaaaccttcaaaacgcgttacaaaacaaataa

SEQ ID NO: 1736 - DNA, 141 bp, Staphylococcus epidermidis
tgttttttatacatgaacctcaagctcatgtgttcctcttttcacttaatacataggtatttagtgtttcttatacatgagcctcaagctcatgtgttcgtttgctcattttcgaacattacatatacattccaccgttaa

SEQ ID NO: 1737 - DNA, 132 bp, Staphylococcus epidermidis
tcatttaaatataacaacgaattttcgtctaattcacaatacttattaattgaacacttaactttgaattcagtttcagtaaatgttttcaaacaattcacaatttacataatctttatcaaagtttcataa

SEQ ID NO: 1738 - DNA, 1626 bp, Staphylococcus epidermidis
aggagtaaatacatgaagtgtaatacgttaaagttaactgaacaggatcagttcattaataaaataaaaaatagtgaatctcaaattacatctttttatgaatatgatgcagcgaaaaaggaaagcttttatagaagattaaaaacacctaataatggaagggaatttcatttatcacgagtgattaaatcttacatgaatgaattaaagttaacacatcagcagctgaataacatagatgctttagctgatggtgcaaaagtagtgattggtggacaacaagctggtctttttgggggtccactgtatacgtttcataagattttctcaattataactttaagtcgtcaactttctgaggaatatgatactcctattgtacctgtgttttggattgcaggtgaggaccatgattttgaagaggtgaatcatacgtatgcattcaataataaagaaactaccttgaaaaaagtaaagtatcatacgatgacaccaccagatagtaatgtttcaagatatactcctgataagaacgaattaaaagcatcattaaatcacttttttaaagaaatgaaggaaactgtacatactcaagatgtttatcaaatgtgcgtcaatattattaatcaatttgattcatggactgatatttttaagggattgatacatgaagtgtttaaggattatgggattttacttattgatgctcaataccctgaattaagacagatggagaaaccgttgtttaaagagatattagaaaagaggaatcaagtcgatcaatcttttcgtgaaactcagatacgaacaactcaacaacaacttccatcaatgatacaaacagagacaaacacacatttatttatccatgaagacggaatgagacagcttttaaattttgatggcacttattttaaactgaataaaactgagaaacgttacacgaaacaaaatttattagatattatagaaagagagcctgaaagaatttctaataatgttgttactcgtccagttgtagaggaatggttgtttaacacagtagcatttatcggaggtccaagcgaaatcaaatattgggcagaattaaaaggtgttttcgatacgttaaatgtagaaatgcctattgttatgccaagattaagaatcacgtatttgtatgctagaactaaaaagttattaaaacaatataatttatcgatagagtctgtcattgctaatggagtagaacaggaacgtcaacgttttgttcgtgaaaaagcatcaaataattttataaatgaagtagaagaaatgaaaattcagcaacaagaactttataacaatttattcacctatgtggaaaataaccatgacaaccaacttcttttagaaaaaaataatcaaattcatctcaatcagtacgattatttaatcaaacggtacttactgaatattgaaagagaaaatgatataagtatgcgacagtttagagaaattagtgaaacactccatccaatgggtggtctacaagaaagagtttggaatccacttcaaattatgaatgattttgggatagatgtgttcagtccctccacctatccaccactttcttactcgtttgatcatttgattataaatccttga

SEQ ID NO: 1739 - DNA, 129 bp, Staphylococcus epidermidis
attcgcactctatcaaagtcatttctatctttaacgatgattatttataaaaatatatttataccgtgcaaactatatacaaagttaaataatgatatcgtaaatatcgcattatttagtcaaagataa

SEQ ID NO: 1740 - DNA, 147 bp, Staphylococcus epidermidis
tttattaagtacactatagccttaaattgtattactttattaatcaaattacaactctcatcaacattttattgttacaaaatattattgacgaatgattataaaattgagttaaacaacttattgtttaactcaattttcatatag

SEQ ID NO: 1741 - DNA, 195 bp, Staphylococcus epidermidis
tgggtagatttctcacactcatcttctccttttaacttctatcataaagattatacatttctcatagtaaacgtcatgctttcaatgacatttgttaaagcactggcagtatccagtgatgttaaacaaggtacaccattttcaactgttgtacgtcgaatttggaatccatctcgttcgatatcttttccttga

SEQ ID NO: 1742 - DNA, 207 bp, Staphylococcus epidermidis
aaggtggggtatgggatgcaacaaaaaaaatctaaaggtattttctggatcttctcaatattggctgtcatttttttaactttatttagtttcgcattaggtgttgctaatgttccattgatgattttaacatttatacttctcattgcaacatttggtgttgggttcagtgtgaaaaagaaatatcgtaaaaacaattggctttaa

SEQ ID NO: 1743 - DNA, 702 bp, Staphylococcus epidermidis
ataggagatttgaatatgaaattcaaaaatatattatttgatttcgacgatacattagtggatttttatgacgctgagaaaaaagcgttttataatttagcacagaaatacaatcatcagccaactcaacaggatttcgaacattttaagaaagtgaaccaagcgcattgggaagcatttcaacaaaataaattgactaaagatgaagtgctgtcacaacgatttattaattattttaatgactatcaaattcatgtaaatggaaaagaagctgataagtgctttagagctgaattagcaatggcaccagttaaattatttgatcatacattagaagttatacaacaattaaaattaaatcattctctctatatagtaaccaatggtgtaacagaaacacagctacgacgaattgctcagacacaatttaatgaaatatttcaagatgtctttatatctgaaaaagctggatttcaaaagccgatgacagagttcttcgattttgtgtttgaacatatcggagagaataacaggaatcaaactctaattgtgggagattctttaacgtctgacatattaggtggtaaaaatgctaatatatcaacatgttggtttaatattagacaaaaagaaaaccatacgtctattcaaccggattatatcattaatgatttatcagaaatgattcgcattgttgagtga

SEQ ID NO: 1744 - DNA, 1827 bp, Staphylococcus epidermidis
aagcgatatcatatagattttcaaactttatctaattggagtgatgtttctatgtattatacaaatagtaattatgaagcgtttgctcggcctaaaaaacctgaaaatgttgataataaatcagcctatttgataggggctggattagcttctttagctgcagcatgttttttaattagagatggacaaatgaaaggcgagaatatccatattttagaagagttagatatctcaggaggaagtttagatggcatcaatatggagcatcatggctatgtagtacgtggtggcagagaaatggaaaatcattttgaatgcttatgggatttattcagaagtataccatcacttgagcaaactaatgcttctgtgttagacgagttttattggttaaataaagaagaccctaattattctaaatgtagagcgattgaaagtggaggtaagcgtattgatactgatggtgattttacattaacaaaaaaagcaattaaagaaattttaaatttatgtttgatgaaagaagaagatttagacgatgttaaaatcactgatgtcttttcaagagactttttaaattctaatttttggctttattggaaaacaatgtttgcattcgagccatggcattcagcgatggagatgcgtagatatcttatgcgttttgtgcatcatattggtggtttagcagattttagtgcattaaaatttactaagtataatcaatatgaatctttagtattaccgatgatagaatatctaaaatcacatagcgtgaactttgaatttggagtacaagtgaataatattttagttgatgcaacaccatctactaaaattgctagagaaatcattttaactagagatgataaagaagaatctatcccgttgacagttaatgacttggtatttgttactaatggaagtattaccgaaagttcaacctatggtgataatgaccatcctgctcctataacacattctttaggtggtagttggacattatggaaaaacttagctaatcaaagtcctgaattcggaagacctgagaaattctgtgatcacattccagctaaaagttggttcgtatcagcaacggcaacaacagataataaaaaaataatctcatatatcgaacaattatgtaaaagagatgttttatcaggtcggacagtcacaggcggtatcatttctgtcgctaattcgagttggcaacttagttttacagtgaaccgtcagcaacaatttaagaaacaacctaaaaatcaagttagtgtatggatttacgcattatactctgacgaaaaaggagacttcattaaaaaaccaatcacggaatgtactggtagtgaaatctgtcaagaagtgttatatcatatgggtgttccacaagaggaaattgttgaattagctcaatcagaatgtaacacgattcctgtttatatgccatatgtaactgcatatttcatgcctagagcatacaaagatcgaccgttagtagtaccgaatggctctaaaaatttagcatttattggaaactttgcagaaacagcacgggatactgtattcactacagaatattcagttagaacagctatggaagctgtttatcaattattggatgttgatagaggtgtacctgaagtttatgcctctgaatttgatgcacgcgtactgatggatgcattttatgaattaaatgatcgtaaatctttacatgaacttgttaataaaaactttattaaaagatcagtattaaatacagtgctgaagaaaatacgtggtactttcattgaagaattgttacgtaaacataaattactatag

SEQ ID NO: 1745 - DNA, 936 bp, Staphylococcus epidermidis
atgtttcatcatgtgagcgtcatgttaaacgaaaccattgattatttaaatattaaagaagatggtgtgtatgttgactgtacgttgggtggagcaggacatgccctctatttacttaatcaattaaatgataaaggtagacttattgcgattgatcaagatttaacagccatagaaaatgcgaaagaagttttaaaagaacatttgcacaaagtcacttttgttcataacaactttcgagaattaacaaatattttaaatgaattagaaattgaaaaagtagatggtatttattatgacttaggtgtttcaagcccgcaattggatgtgcctgaaagaggctttagttatcacaatgatgcgaaactagatatgcgaatggatcaaacacaatcactttctgcgtatgaagtagttaatcaatggtcttatgaagcattagttaggattttctttcgttacggcgaagagaaattttctaaacagattgcacgcagaattgaagcccatcgagaacaacaacctatagaaacaactttagaactagttgatgtcattaaagaaggcataccagcgaaagcaagacgaaaagggggacatcctgcgaaacgcgtgttccaagctattcgaattgctgtgaatgatgagttatcagcttttgaagattcagttgagcaagccattgaatgtgtgaaggtcggaggtagaatttcagttattactttccactctttggaagatcgtttgtgtaaacaaattttccaagagtttgagaaaggtccagacgtaccaagaggtctacccgttattcctgaagcatatacacctaagttaaaacgagtaaatcgtaaaccgattaccgctactgatgacgatttaaacgaaaacaatcgagcacgtagcgccaagttacgcgtagcagaaatattaaaataa

SEQ ID NO: 1746 - DNA, 609 bp, Staphylococcus epidermidis
gtcatgagtcatgatgcaaatactattgattctcgtacacacgaaggcgaattaaataaacttggcttttggattttccttacagctgaatttgcgttattcggtaccctatttgcaacgttattaacgttacaacatggtggcggatatggcggtaaattaactaccgacttattcgaattacatttgattttaataatgacttttgcattattaattagttcttatacttgtggtattgcaatttattacatgcgacaagaaaaacaaaacttaatgatgttttggatgattatcacagttatcctaggtcttgtattcgtaggtttcgaaatttacgaattcgcacactatgcttctgaaggtgttaacccaactattggctccttctggtctagtttctttatactactaggtacgcacggtgcacacgtatcattaggtattgtttgggttatttgtttgttaattcaaatcggcactcgtggtttggattcatacaatgctcctaaattatttatagtaagtttatactggcacttcttagatgttgtttgggtcttcatctttactgccgtatatatgatagggatggtgtatagcggatga

SEQ ID NO: 1747 - DNA, 894 bp, Staphylococcus epidermidis
cacatgatccagaaattattaaacgatatccaacaagacgattacgcgtggaagatggatgtcttaaagaaatggaaggtgaacacattgtttgaaagatggaaaaaacgccacaccttcgttgatgatgtaaatattattactaagttacttttaggtatcgcattattctttttcattatatttatccataacttcgactttatgatttatatcgtcatattaatgtttatgttcttacttttatttaacggtacagaatttaaaataactgcaatatttattttagttacaaccctctttgccttgatgtcatcattatttatgattttatatggtgatggagaacatatgcttgtaaaatttggtattttgcaaataagtacagaaagtattgtacgaggtcttcatctatctatgagaacaattaccgtttcaatttttggtatactaatcgcattgacttcacaaattgtaatgattttttatagtttaatgcaacatttaaaggtaaagccaaagtttgcttatgcttttatggcagcgattagaatggttccacttataataagttctcttattcaattaagacgttccctaaaaatgcgttatcaaatgatagatgcatctaactataaaggaatcaagcgtcttaaccatttagtcatacctttattaagtcaaaatattcgacgtgcacatcaactttcagttgcaatggagtctaaaggttttaaagatggtccgagaacatactactatcgggtaccattttcatataaagatatcgtatttattgcttgtatattaattatcattactttgtcatttgtcttatcatcataccttccaattactggtattcatgatgtccgttttggacaattagactaa

SEQ ID NO: 1748 - DNA, 222 bp, Staphylococcus epidermidis
ggaactgcccataatgactgctactttcactttgtacaccctttcgaaacttttggattgttattaggaatagttgtatattacacatatagcataacaatccatttggtatttttcaatcaaaaatcgaactttaacatcaatttaaatattaatttacgtcttttgactatcatttgctttttgattaatgttaaagttaagatattaattaataattag

SEQ ID NO: 1749 - DNA, 981 bp, Staphylococcus epidermidis
gccatggcacaaatgacaatggttcaagcgattaacgatgcgcttaaaagtgaactcaaaagagacgaagacgttttagttttcggtgaagacgttggtgttaacggtggtgtattccgtgttactgaaggtttacaaaaagaatttggcgaagatcgagtatttgatacaccattagcagagtctggaattggtgggcttgcactaggcttagcagtgactggcttccgtcctgttatggaaattcaattcttaggattcgtttatgaagtatttgacgaagtagctggtcaaattgctcgtactcgtttccgttcaggtggaactaaaccagcgcctgttacaattcgtacaccttttggtggtggcgtccacactccagagttgcatgctgataatttagaaggtatcttagctcaatcacctggtttgaaagtagttattccatcaggtccttatgatgctaaaggattattaatttcttctattcaaagtaatgatccagttgtatatctagaacatatgaaattatatcgttctttccgtgaagaggttcctgaaaaagaatacaaaattgacattggaaaagccaatgttaaaaaagaaggtaatgatattactctaatatcttacggggcaatggtacaagaatcactaaaagctgctgaagagttagaaaaagatggttattcagttgaagttattgacttacgtactgtacaaccaattgatatagatactttagtagcatcagttgagaaaactggacgtgctgtagttgtacaagaagcacaacgtcaagctggtgtgggtgcacaagtggcagcagaattagcagagcgagcaattctttcattagaagctccaatagctcgagtagccgcatcagatacaatttatccatttactcaagctgaaaacgtttggttaccaaataaaaaagatattatagagcaagctaaggcaactttagaattctaa

SEQ ID NO: 1750 - DNA, 933 bp, Staphylococcus epidermidis
gaaggaggtctagttttggaaaattataattttaatattatcgaacaatcacaagttggacaacgtatagataaacttgtttcagatttaaataaagattggtcacgtagtcaacttcaagattggattaaagaaggtttagtcaaggtaaatggtaaagtaattaaatcgaactataaggtcaagttaaatgacaaaattgttgtaaccgagaaagaagtcgtagaggcagatataaaacctgaaaacttaaatttagatatttattatgaagacgaagacgttgctgttgtatataaaccaaaaggtatggttgtacatccatctccaggccattatagtggaacattagtaaatggattaatgtatcaaattaaagatttatcaggaatcaatggcgaaatacgtcccggcatagttcatagaatagataaagatacgtctggtttattaatggttgctaaaaatgatgttgctcatcgtcatttagttgaacaacttatgtctaaaactgttaaacgaaaatacacggcgttagttcatggtaatatccctcatgattatggcactattgacgcaccaattggtcgaaataaaaacgatagacaatcgatggctgtggttgatgacggtaaagaagctgtgacacactttaatgtattagagcattttaaagattatacattgatagaatgtcaattagaaacagggcgtacacatcaaattcgtgtacatatgaaatatattggttatcctcttgtaggggatccgaagtatggacctaaaaaaacgttagatatcgatggacaagctttacatgctggtataattggtttcgaacatcctgtaacacatgaatacattgagaagcatgcaacattacctaacgattttgaaaagttactagatgatataagacgtagagatgcataa

SEQ ID NO: 1751 - DNA, 735 bp, Staphylococcus epidermidis
gtggaaaaacaaaaaagaacaagttacacattcattatcaaacactatttaaatagctatcaatcaaggaggattatcatgccttttacaccaagtgagattaagaataaagaatttacacgagtaaaaaatggtttagaacctacagaagttgcaaattacttagagcaactaagtaatgaaatcgaacgtttaaaagaagataaaaagcaacttgaaaaagtcattgaagatagagattctaatattaaatcatataaagatgttcaccaatcagtaagcgatgcacttattcaagcacaaaaagtaggagaagagacaaaacaagcagcaactaaagaagctgaagccgttttatcaaaagcacaagtacaagctgacagtattgtgaatgatgcaattgaaaaagcgcgtcgtctagctttccaaactgaagacatgaaacgacaatctaaagttttccgctctcgtttccgtatgcttgttgaagcacaacttgacttactcaaaagtgaagattgggattacttactcaattatgatttagacgccgagcaagtgacattagaagatattcatcatcttcatgataatgatttgacacctgaagaacgtgcaatgaaacaaaagcaaaatcaagaaatatcggctaatcagccttctacatcaagttcagaatctgtgagtcaatcaaatgcaaataacgaatcatcacaatcaacatcaaataattaa

SEQ ID NO: 1752 - DNA, 1203 bp, Staphylococcus epidermidis
ataatgaaacatattttattagctgttacaggcggtatcgcagcatataaagcaattgatttaacaagtaaattaatacaatccggctatgatgtaagagttatgctatctgatcatgctcaagagtttgttactccgctagcttttcaagcaatcagtagaaatcctgtttacacaaatacatttaaagaagaaaatcctgaagagattcaacatgtatcattaggagactgggcagatgcgattatagtcgcgccagcaactgctaatactatcgcaaaattaagtgttggaattgctgatgatttaattacttctacattacttgctacaacaacaccaaaattcgttgcacccgcaatgaatgtaaatatgtataacaatccacgtactaaacataatatgaaagtgctaagtcaagacggatattattttattgaacctggtagtggctatttagcatgtggttatgtagcaaaagggcgaatggaagaacccatgcaaatcctatctgttattaataaattttttactcaacagaagaatgttgtcaaaagctctttttctggaaagcgcgcattagttacagctgggcctacagttgaagttattgatcctgttcgatacgtatcaaatcgttcatcaggaaaaatgggatatgctatagctgaagcattacgagataagggagcaatcgtaactttaattagtggtcccacccacttatctctacctgaagggattaatgtagtaaaagttgagagtgcagatgatatgtttcaagctgtaaccgaacgctttgcgaaacaagatatagtgattaaagcagcggcggtgtctgattatacaccaatggacatacttgaacataaattaaaaaaacaagaaggaggattatctgttcaatttaagcgtacaaaggatattttaaaatacttaggagaaaataaaacgcaccaatatcttgttggttttgctgctgaaacacaaaatattgaacagtatgctctagacaaactcaaaagaaaaaatgcagatgttatcatttcgaacaatgtaggtgatacatccataggctttagttcagatgacaatgaattaactatgcattttaaaaataatgaaaaagtaaatattaagaaaggaaaaaaatcagctttagcacatcaaattatagaaattttagaaactaggtggcagtaa

SEQ ID NO: 1753 - DNA, 138 bp, Staphylococcus epidermidis
ataatggaacaattatttgacgcaattagaagtgtagtagatgcaggaatcaaccaagattggtctcaattagcttcaggcatcgctggtattgttgaaaatggtgttagtattatttctaaattattaggtcaataa

SEQ ID NO: 1754 - DNA, 759 bp, Staphylococcus epidermidis
agatggagacatattttaatggaacaaattacttctgctcaaaatagtaaaataaaaaatgcgaataaattaaaaaagaaacgtgagagggataaaacgggtcttgctttaatagaggggattcatctcatcgaagaagcttatcaaagtcaaattgaagtaatacaattgtttatcgttgattccgatagaatgtcatcttcaataattgattatgcgaaagaagtgtatcaaattaatctaaaagttgctgaagcactttctggaactgttacacctcaaggtttctttgccattataaaaaaaccaacctatgataagacactagccaaacaagtattattaattgaccgtattcaagatcctggtaatctaggaactttaattaggacagctgatgctgctggattagatttgatagttatggagaaggggacggctgatccttttcaagataaggtgatccgtgctagtcaaggaagcatttttcatataccagtcatttttgatgacatcaacaattatattcatcaatttaatggtccagtgtatggtacggcacttgaaaacgcagtgagcttcaatgatgttgaagcgcaagtcaattttgcgcttatattaggtaatgaaggagaaggtgttaacccagatttactaaaagaaacaacgcaaaatctcactattcctatttatggtaaagccgaaagtttaaatgttgctattgctggaagtatcttaatgtatcagctgaaaggttga

SEQ ID NO: 1755 - DNA, 633 bp, Staphylococcus epidermidis
cttctgacgcacaactttcctagagaaggttgtgcgttttttaggaggatgttttttatgtcaaaaggtttgaaactatctgaaattcttgtgacagttttaatttcagtagtatttgccatcatttataacttatggtggtttgtttacaatattgtacaagttgcgggtattcacttagaacaacttacatatggtgtatggtttatggcagcagtcgtttgttacttaatcattcctaagccaggtatagcattattagcagaaatcgcagctggagctggtgaaacgattgttatgggaaaatttgatatacctactatcatatatgcgatattacagggattggcttgtgaaattatatttgctatttttaaatacaaatcacgttctgctgctgtagcaatgcttgctgggttagcaactgctttaatctctttcccagtggattacttctatggttacttaaacgaagttgctggatggaacttactactatttatagttttccgttcaattagcggaattgtattagctggtttagtttcatactggattgtcaaagcattagataaaaccggtgtaactaaattctttagaccagcatcacaacaagattacgataacctataa

SEQ ID NO: 1756 - DNA, 1224 bp, Staphylococcus epidermidis
agtgtgaggcaaacaataaagatgaaattaaataaatttaaaatcgtattttttattatcgtattattaactttagtcgtgtcaataggtatattaggtgttgaatggacaagacacctagaattaaaaaaacaaacgttaagtcaagaaagtggaaatacgaattatatagaaaagagagataagactgttgagaaacctaaaaaaataaagactaaatatgataaaaaagatcctacttccaaatcgataaacaaatatttagaaaaaactcaatttaatggaactgtagctgtatttgataatggaaaagttaaaatgaataaaggatatggttatcaagatatagagaaaggcaaaaagaacactgcaaatacaatgtatttaataggatcagcgcaaaaatttacaacaggtttaatgctgaagcaacttgaagtcgaaaataaagtgaatttgcaagattcagtcactaaatatattccttggtttaaaacaaataaagaaattacaattaaagatttaatgttacataaaagtggactatataaatatgaagcttcaactaatatcaaaaatttagaacaggctgttagagcaattcaagctcgaggtattgatgatacagtttatcataagcatcaatataatgatgctaattatttagttttagctaaagttattgaaaatgttactggaaaaccatatgttaaaaattattatgaacgattaggtaataaatataatctcaaacatactgctttttatgacgagaaacctcttcaaagtgagatggcaaaaggctataagtttaaaaataatactttttcattccttaaacctaatatattagatcaatattatggagctggtaatttatatatgacgccacatgatatgggcaaattaatttatacgttacaacaaaataaaatctttaatgcacgtcaaactcgacctattttacatgaatttggaactcaagaatatccagaagaatatagatatggtttttacataactccgtatttaaatagagtcaacggggtattctttggtcaaatttttactgtttactttaatgatcggtatattgtcattttagggacgaatgtaagtaatacacctggattagtgagtaatgaagacaaaatgagacacattttctataatattcttgaccagaaaaagccttataatacagcaggtgttaaagttgagtaa

SEQ ID NO: 1757 - DNA, 300 bp, Staphylococcus epidermidis
aatcattttaatccaaggtcaggagaaattagtatgggtgaatttaaaaatagaataaatgttacgattaatgatcaacatttcacaatcattggcgaagatagccctgaacatattcgttatgtagcacatcttgttgatgaaaaaatgcaagaattaggtcaaaaatcagcaggtttagatacaactcgaaaagcgattttaacatctgtgaatattatgcatgagaaagttatattagaagaagagaacagacgattacaacaagaaataaatcaattaaaacaaagagatgaataa

SEQ ID NO: 1758 - DNA, 669 bp, Staphylococcus epidermidis
ataaactttaaaagtttatgctacaatatccataatcatattaaaaggaggcatattatgacccaatatactttttcacctaaggattttaaagcttttgaagtcgaaggtttagaccaaagaatggaagcacttaatgactatgtcagacctcaacttcatcaattaggatcttattttgaagaatatttcactacacaaacaggtgaaactttttatgctcacgtagctaaacacgcacgtagaagtgtcaatccacctatcgatacatgggtagcttttgctcctaataaacgtggttataaaatgttaccacactttcaaatcggattgtttagaaatcagcttttcattatgttcggtatcatgcacgaaggtagaaataaagaagaaaaagtgaaaatatttgataaacattttgataaactgacatctttaccaagtgattatagtgtttctctagatcatatgaaaactgaaaagcactatatcaaggatatgagtaatgaagagttgcatgctgctatcgatagagttaaaaatgttaaaaaaggtgaattttttgttgccagaacattatcaccaaccgataaaagattaaaatctgataagtcttttctaaaatttgttgaggaaacttttgatgaatttttaaaattttatcaataa

SEQ ID NO: 1759 - DNA, 873 bp, Staphylococcus epidermidis
gagtggtttaaggtggttgctaaaattttagatggtaaacaaatagcaaaagaatatagacaaagacttaaaaatcaagtcaatgacttaaaagaatatggttttactccaaaattatcagtcatattagttggtaatgatggtgcaagccaaagttatgtaaaatcaaagaaaaaagcagcagaaaaaattggaatgatatcagaaattattcacttagacgaatccacatcagaagaagtagttttaagcgaacttaatcgattaaacaatgacgatactgttagtggtattttagttcaagtaccattacctaaacaggtaagcgaacaaaaagtacttgaagctatcaatccggaaaaagatgtagatggtttccatccaattaatattggaaaattgtatattgatgagcaaacctttgtaccatgtacacccctgggtattatggaaattttaaaacacgcagatattaatttagaaggaaaaaatgcagttgttattggtcgtagtcatattgttggccaacctgtttcaaagttattgttgcaagctaacgcaactgttacgattttacattcacgtacaaaaaatatgaatgcacacttaaaacaagcagatgtgattgttagcgcagtaggacaacctggtttagttactaaagaaaatgtcaaaaaaggcgcagtaattatagatgttggtaatacacctgatgaaaatggaaaattaaaaggagatgtagcatatgatgaagtaaaagaaatagctagtgcaattactccagtaccaggtggtgttggtcctttaactattacaatggtacttaataatacacttcttgcagagaaattaagacgtggcttaacaaaataa

SEQ ID NO: 1760 - DNA, 138 bp, Staphylococcus epidermidis
agttctcttaagaatatttataaaattgaaaaagccagtgatataagaaacaaacaatatgctaggctcacaccaatcctaactcgctgtactatgttcactgtttcttacgcgtctgtctttatatcatatcaataa

SEQ ID NO: 1761 - DNA, 204 bp, Staphylococcus epidermidis
atggaagttaataaagtcatttatattttactagcagtctttcttggtagttttggcatccacaaattttatgctggtaaaccaattcaaggattattgcatattctattttgttggactgctatcccgcatgtgttagcaattattagtgcagttttaacattattcaaacctgccgacgcaaacgggaacgtcagaatgtaa

SEQ ID NO: 1762 - DNA, 1113 bp, Staphylococcus epidermidis
atggctcctaagttacaagcccaattcgatgcagttaaagttttaaatgagactcaatcgaaatttgaaatggttcaaattttggatgaagacggaaatgtcgttaatgaagacttagtacctgatttaacagacgaacaattagtggaattaatggaaagaatggtatggactagaattcttgatcaacgttctatttcgttaaatagacaaggacgtttaggtttctatgcaccaacagcaggacaagaagcttcacaattagcatctcagtatgctttagaaagtgaagacttcattttacctggttatcgtgatgtgcctcagattatttggcatggcttacctcttacagacgcattcttattctcaagaggacacttcaaaggtaaccaattccctgagggagttaatgcacttagccctcaaattattatcggtgcacaatatattcaaactgccggtgtagcgtttggacttaaaaaacgtggcaaaaatgcagtcgcaattacttatacaggtgatggtggttcatcacaaggtgacttctatgaaggaattaactttgcatctgcatacaaagcacctgcaatttttgtaattcaaaacaataactatgccatctctacaccacgtagtaaacaaacagctgcagaaacattagcacaaaaggctatttcagttggtatccctggaattcaagttgatggtatggatgctttagctgtttatcaagcaacattagaagcacgtgaacgtgcagtagcaggagaaggtcctactgttatcgaaactttaacttatcgttatggaccacatactatggctggtgatgatcctactcgttatagaacttcagatgaagatgctgaatgggagaaaaaagacccattagtacgtttcagaaaatatttagaagctaaaggtctttggaatgaagacaaagaaaatgaagtggttgaacgtgcaaaatctgaaataaaagcagctattaaagaggctgacaatacagaaaaacaaactgttacttctctaatggatatcatgtatgaagaaatgcctcaaaatttagcagaacaatatgaaatttacaaagagaaggagtcgaagtaa

SEQ ID NO: 1763 - DNA, 141 bp, Staphylococcus epidermidis
gaaatcactaaaaatactatgagtgaaatccaagtaaaaacacgttgtgattttttagattgtaaaaagccccatgttacacaaaatgaccataaaccattagcaaaatggaaaacaacagcaatgacacaaataatgtaa

SEQ ID NO: 1764 - DNA, 846 bp, Staphylococcus epidermidis
gtaatggctaatcaatcattaaaagaaactccaaaaactcaaagtaatccacaaactcaagtacaaggtcaaaatcaacaaccaaaacaaaaaacagtaaaattgataattaaacgtcaagataatagcgaatcaaaaccttatgaagaatcatttgaaattccttataaggaaaatttaaacgtaattgcatgtttaatggaaatcagacgaaatccagtcaactctaaaggcgaaaaaacgacaccagtcacatgggatatgaattgcctcgaagaagtatgtggcgcttgttcaatggttattaacggccgtgcaagacaatcatgttcagctattgttgatcaattagaacaaccaattcgtcttgaaccaatgagtactttccctgtcattcgagatttacaagttgatcgctcaagaatgttcgataacttaaaacgaatgaaagcatggattcctattgatggaacatatgacttaggacctggaccacgtatgccagagaaaaaacgccaaactgcatatgaattgtctaaatgtatgacttgtggtgtatgcttagaagtatgtccaaatgtcacaaaaaataataaatttgttggtgcacaagctatttctcaagtacgtttgttcgacttacatcctacaggttccatgactaaagatgagcgtttagatgcattgatgagtgcaggaggactgcaagaatgtggtaattctcaaaattgtgtgaatgcatgtcctaaaggtataccattgacaacgtcaattgccgcaatgaatagagaaacttctttccatatgtttaaatcattctttggttctgaccaccaagtagattaa

SEQ ID NO: 1765 - DNA, 741 bp, Staphylococcus epidermidis
gttgtggctaaccagaaaaagaaagaaatggtacatgattttcaacaaaaatttactgataaaatgaagtcgttaggattacattttaaaaatattgatttatatcaacaggcattctctcattcaagttttattaatgactttaatatgaatcgtttagaacacaacgaacgcttagaatttttaggtgatgcggtattagaattgacggtttcacgctatctttttgacagacatcctcatttaccagaaggtaatttgacaaagatgcgcgcaacaattgtttgtgaaccttcacttgtgatatttgcgaataaaattaaattaaacgaactgattttattaggtaaaggtgaagagaagacaggaggcagaacaagaccttcccttatttcagatgcatttgaagcttttgtaggtgcactatatttagatcaaggtttagattcagtatggacctttgctgaaaaagtcatctttccgtatgtagaagatgacgagcttgttggtgtcgtagactttaaaacacaattccaagaatatgtgcatagccaaaataaaggagatgtgacataccaattaattaaagaagagggtcccgcacatcatagactatttacatcggaagtgattttagaaaataaagcagttgcagagggtaaaggaaagacaaagaaagaatccgaacaaaaggcagcagaacaagcgtataaactaatgaaaaataaaaaatcattataa

SEQ ID NO: 1766 - DNA, 810 bp, Staphylococcus epidermidis
aaggaaaataagatgtttcataacaaaaatgcaaattttgtaaatggtgtaactatcaatattaaagataaagaaacaattaaaacattttatgagaatgttttaggatttaatcttatcaatgaatctgaaactgctgtacaatttgaagttggcgattcaaatcaatttattacttttattgaaatacagaatggacgagaaccgttaatgtctgaagcaggtcttttccatattggtatattgttgcctactttgactacattagctgatttactcgtacatttaagtgattttgaagtaccagtgaacggtggacaacaaagtgttgcaacatgtttatttattgaggatccagagggcaatgctataaagttttatgtcgatcgtgagacagaatcatggattgatgagaaagaaggcagaattagaatggatattgctccaattaatgtacctcgattactgcaaaacgtctctcatactcaatggcagggcataccagatgaaactaaattaggttcattacatattaagtccattcgaatttctgatgttaaatcatattatttaaattattttggactagaagaatcagcatatatggacgattattctctatttttatcttcaaacgagtattataatcatttggctgttaatcagtggttatctgcgacaaaacgagtagataatgaacatacctatggtttagctatgatagattttcactatccaaaaacaacacataaaaatcttaaaggacctgatggtatttattttagatttaatagaataaaagaagtgtga

SEQ ID NO: 1767 - DNA, 648 bp, Staphylococcus epidermidis
aggaatgataatgtgaagattaatttattatgttctcaacgtttattacctaatcatatttttgaaaaagaaaaagattctaattgggcaggtattgatagaggtgcgcttatactcgtaaaacaaggtattcaacctatattttctgtaggtgattttgactcagtgaataatgaagaacgtttgatgttgatgaaaaatcttcaaatcgaaccggttgaagctgaaaaagatgatactgatttagctttaggagtagctcaagcagttgaaagaggatacacagaaattacaatttatggtgcaacaggcggtcggttagaccactttatgggtgtgcttcaaattttacaaaaacctcaatacttacatcaatctataaaaataaaagtcattgatcaacaaaatcatattcaattattaaatgaaggtaagtatgtaatcaacagagatagtacttatccatatatatcgtttatccctctaaatgataaaactatattaactttacagggtttcaaatataatttaaatcaagaacacttaaatttaggctctacactcacaatttcaaatgaagtaaaggttaatgaagcaatcattcgagttgaacaaggaacagttttaaaaatacgtagtcgtgactaa

SEQ ID NO: 1768 - DNA, 633 bp, Staphylococcus epidermidis
gtaatagataaagaaagtgttatgatatttaaggaatatttaagacttggtactaaaatgaggggtgagcgtttgaaattaaagaaaaacgatagacgagtagccattaaagaggctatcgaattaaaccccttcatcactgattatgaattgtgtgagaagtttgatgtaagtattcaaactatacgtttagatcgcacgcatttaaatattcctgagttacgtaaaagaattaaattggtagctgaacaaaattatggacgaattaaatcaatagaagccaatgaaattataggtgatttgattcaagtgaatcctgatgttagcgcacaatctttaattgaaattacaattgattctgtttttgcaaaaagtgagattgctagagggcacgtcttatttgcacaagctaactcattatgtgtagctcttatacataaaccaatagtattgacacatgaaagtcaagttgaatttaaagaaaaagtaaaattaaatgatacagttcgagcagatgcccgtgtcatagatataacagataagcattatattattgaagtgaattcttatgtttcagatatgttagtttttaaaggtaaattcaaaatgtactatacaagtgaggatgaatga

SEQ ID NO: 1769 - DNA, 627 bp, Staphylococcus epidermidis
ggcatggataaggaaaaaggactgttaattgttctttcaggcccttcaggtgttggaaagggaactgttagaaagaagatatttgaagacccaactacttcatataagtattctatatcaatgacgacacgtcatatgcgtgaaggtgaaattgatggtgtagattacttctttaaaacaaaggaagaatttgaggcgttaattaaagacgaccagtttattgagtatgcacaatatgtaggtaattactatggtacacctgtacaatatgtaaaggatactatggaagaaggtcatgacgtctttttagaaatcgaagttgaaggtgctaagcaagtaagaaagaaatttccagatgcgttgttcatatttttagcgcctccaagtttagatgacttgaaagaacgtcttgttggtagaggaactgaatcagatgaaaagattcaaagtcgtgtgaacgaggcacgaaaagaagtagaaatgatgaatttatacgactacgttgtagttaacgacgaggttgaactcgctaagaatcgaattcagtcaatagttgaagctgagcatttaaaaagagagcgaatcgaagctaaatatagaaaaatgttactggaggtcaaaaaataa

SEQ ID NO: 1770 - DNA, 1551 bp, Staphylococcus epidermidis
ttcagacgtaaaaataaaagaaaacgtttcagatatcaaacaaaaatgggaaggggctatagttcaatgtctaactactcaggattaaatgaagaatgtggcgttttcggtatttggaatcatcctgaagcagcacagttaacatatatgggtctacatagtttacaacacagaggtcaagaaggtgcaggtattgtagtttcaaatcacgaaacgctaaaaggtgaacgaggattaggcctattaactgaagcaattaaagacgaacatatgtcaaatataaaaggttatccacatgcgataggacatgttcgttacgcaacctctggtaataaaggcattgaaaatattcaaccatttttatatcacttttatgatatgagcgtaggtatatgtcataacggtaatttaattaacgctaaatcattacgtcaaaatttagaagaacaaggtgcgattttccattcttcttcggatactgaagtcattatgcacttaattcgtcgtagtaaggcgccgacatttgaagaggcattgaaagagagtttacgactcattaagggtggatttacttttgccatcctaacaaaagatgcgttgtatggtgcagtagatcctaatgctattcgaccattagtagttggaaaaatggagaacggtgcttatattttagcaagtgaaacatgtgcgattgatgttttaggtgctgaatttatacaagatattcatgcaggtgagtatgttgttattacggatgaaggtatagaagttaagacttacacacgacaaacaacaactgcaatttcagctatggaatatatttattttgcgagacctgattcaacgattgcaggaaaaaatgttcatgcggtacgaaaggcatcaggtaaacggttagcacaggaaaacccagcaaaagcagatatggtaataggcgtacctaattcatcattatctgcagcaagtggttatgctgaagaaataggcctaccatatgaaatgggactagttaaaaatcaatatgttgctcgaacttttatacaacctactcaggaattaagagagcaaggtgtacgtgtgaaactgtcggctgttaaggatattgttgatggtaaagatatcgtacttgtagatgattcgattgttcgaggtacaacgattaaacgcatagttaaaatgcttaaggattcaggagctaaccgcattcacgtaagaattgcttctcccgaattcatgttcccttgtttttatggtattgacgtatctacaacagctgaactcatctcagcaagtaagtctcctgaggaaattaaaaatcatattggtgcagattctcttgcttatttaagcgttgatggcttaatcgagtctataggacttgattatgatgcgccatatcatggcttgtgtgtagaaagttttacaggtgattatccagcaggactttacgattatgagaaaaattataaaaagcatttaagtgaacgtcaaaaatcatatatagctaataataaacattattttgatagtgagggaaatttacatgtctaa

SEQ ID NO: 1771 - DNA, 1422 bp, Staphylococcus epidermidis
tggaggggtaaaaacatggtagttggagatttcccaattgaaacagatactattgtaataggagcaggtccaggtggatatgtcgcagccattcgcgcggctcaattaggacaaaaggtaacaatcgttgagaaaggtaatttaggtggtgtatgcttaaacgttggttgtataccttcaaaagcattactacatgcttctcatcgctttgttgaagcgcaaaattcagaaaacttaggggtaattgctgaaagcgtttcgttaaactatcaaaaagttcaagaattcaagacttctgtagttaataaattaactggcggtgttgaaggacttttaaaaggtaacaaagtagagattgttagaggtgaagcttatttcgttgataacaatagtttacgtgtcatggacgaaaagagtgctcaaacttacaatttcaaacatgcgattatagctacaggttcaagaccaattgaaattccaaattttgaatttggtaaacgtgttatcgattcaacaggagctttaaatctacaagaagtacctaacaaactagttgtagttggtggcggatatatcggttctgaattaggtactgcttttgcaaactttggctctgaagttactatccttgaaggtgcaaaagatattttaggcggatttgaaaagcaaatgacacaacctgttaaaaaaggtatgaaagaaaaaggtatcgaaatcgttactgaagcaatggcaaaatctgcagaagaaactgaaaatggtgtcaaagtaacttatgaggcaaaaggtgaggaacaaactatcgaagctgattatgtattagttacagttggccgtcgccctaatactgatgaattaggattagaagaacttggtctgaaatttgctgatcgtggattactagaagtggacaaacaaagtcgtacttctattgaaaatatctttgcgattggagatattgtacctggattaccattagctcacaaagctagttatgaaggtaaagttgctgctgaagcgatagatggtcaagccgcagaggtagactatattggtatgccagcagtttgctttacagaaccagaattagcacaagttggttatactgaagctcaagcaaaagaagaaggtttatcaattaaagcttctaaattcccttatgcagctaatggacgagctttatcattagatgatacaaatggttttgttaagttaattacacttaaagaagatgatacgcttattggagcacaagttgtaggtactggcgcatctgatattatctctgaattaggtttagctattgagtcaggtatgaatgctgaagatatcgcattaactgtacatgcacacccaactttaggtgaaatgacaatggaagctgctgaaaaagcaattggttatccaattcatactatgtaa

SEQ ID NO: 1772 - DNA, 192 bp, Staphylococcus epidermidis
cacgaattcaaaatggagaagtgcaaattgtttttttttttttttattcaaggaaaagatatcgaacgagatggattccaaattcgacgtacaacagttgaaaatggtgtaccttgtttaacatcactggatactgccagtgctttaacaaatgtcattgaaagcatgacgtttactatgagaaatgtataa

SEQ ID NO: 1773 - DNA, 141 bp, Staphylococcus epidermidis
aaaccacccaaatcttcagttttagttccaaaaaatagtgctgcaccaagtgtaagtaataagcaattgactacaaaagcgatggatagctgtatattagagtctatggtagcatacttaatcgcttgtgctttttcatga

SEQ ID NO: 1774 - DNA, 321 bp, Staphylococcus epidermidis
gttatgaacaaattactacagtcattatcagcacttggagtttcagctacattagtgacacccaatttaaatgcagaagccactactaatactgaacctcaattaaaaggtgttaacgatatcgttattgaaaaaggacaagaatataatttacttaaaggcataagtgcttacgataaagaagacggcgatcttactcataaaatcaaaattgatggtcaagttgatacatccaaagcaggtaagtataaagtaaaatatcaagttaccgattctgatggtgctgaaaaaacttctataagaaatattgaagtaaaatga

SEQ ID NO: 1775 - DNA, 522 bp, Staphylococcus epidermidis
agggtgaacaacatgtctaagtggattattcttagtgataatcacaaagaaacaggtatcttatatcatatttatgaactacataaagatgcagataaatttttacatttaggggattctgaatttagttataatgacacagaacttagtttgtatcagcgtgtgaaaggtaattgtgatttttatccagagtttttagaagaagaaatcactgaagaaaacggaatccgtgccttttatactcatggacatctttatcaagtaaaccaaacacgaatgaaactggctgaaaaggcaaaagaattaggatgtttgtttgccttttatggacatacacatgttgcaaaatatgagcaaataggtggtatccatgtaattaatcctggtagtatttctcaatcacgtagtcaaattgaagaaacttttgccgaactcgtatacaaggaagatgaaaataccatcattttgaattttagaaatagagaaaatcagatcattgaaacagttaagattgaattttag

SEQ ID NO: 1776 - DNA, 129 bp, Staphylococcus epidermidis
atttatttaaacttgtaccaattactaactatcaatggttacctaaatgatgcacatgagataataaatatatataaagtatttatattaacagtgttatcgatatatgaatgtcattttgagaattag

SEQ ID NO: 1777 - DNA, 246 bp, Staphylococcus epidermidis
ctattactaaatgtaactttcaagttggacaaagaatttttgtctgatttcaagcttgttttatacgctattcaactattttataatttactagtaattaaaaaacctaggacaatttttatgtcccaggctctaccaatattaataaaactttatcctaaatactctttcggtacaacaggttctattttaccatcagcaatttcttctaaagcttttccaacaggtttagctgaatggtactga

SEQ ID NO: 1778 - DNA, 1005 bp, Staphylococcus epidermidis
aaagagctaaaattagaaagtgaagaaaaggagatttatatgatctttatatacgcaatcatcgcattactgataacatttattttagtccctatacttattccaacattgaaacgtatgaagtttggacaaagtatccgtgaggaagggcctcaaagccatatgaaaaaaacaggtactcctactatgggtgggcttacatttttaattagtattataattacctctatcattgcaattatctttgtagaccattcaaatccaattattttgttactatttgtaacaatcggttttggtcttattggatttattgatgattatattattgtagttaaaaagaataaccaaggattaactagtaaacaaaagtttctagcacaaataattattgcagttatattctttgtgctaagtgatgtatttcaccttgtgcattttacgacagatttgcatattccatttgtgaattttgatattccgttgtcatttgcttatgtgatatttatcgtcttttggcaagttggtttctcaaatgctgtaaacttaactgatggtttagatggattggcaaccggtttgtcaataataggttttgcaatgtatgctgtaatgagttacatgttagattcaccggctattggcatattttgtattataatgattttcgctttactaggtttcttaccttacaatttaaatccagcgaaagttttcatgggagacacaggaagtcttgctctaggtggtatttttgcaacgatttcaatcatgttgaatcaagaattatcattaatattaattggttttgtgtttgtagttgagacattatctgtaatgttacaagtagcctcatataaattaacgaagaaacgtattttcaagatgagtcctatacatcaccacttcgaattaagtggttggggtgaatggaaggtagtaacagtattttggacggtaggtttaattacaggattaataggtttatggattggagtgcattaa

SEQ ID NO: 1779 - DNA, 126 bp, Staphylococcus epidermidis
tttttaataaactctaaagaccaattgtctcatattaataaaacgagcctgcaacatatgtattcatatgtacagactcttcatcttttacaaggattttttcattttaatcagataatcatttaa

SEQ ID NO: 1780 - DNA, 1071 bp, Staphylococcus epidermidis
ctaataataaacattattttgatagtgagggaaatttacatgtctaaagcatatgaggaatctggtgtaaatattcaagcaggatatgaagcagtcgaaagaataacaagtcatgttgaacgtacattgcgcaaagaagtattaggtggtttaggtggatttggtgcaacatttgatttgtctcaattaaaaatgaaagcgccagttctggtatcaggtactgacggtgtgggtacaaagttaaaattagcaattgactatggaaagcatgacacaattggtattgatgctgtcgcaatgtgtgtaaatgatattttaacaacaggtgctgaacctttatactttttagactatattgccacgaataaagtagtgccaagtactatagagcaaatcgttaaaggtataagtgacggttgcgaacaaaccaatacggcacttataggcggtgaaactgctgaaatgggagaaatgtatcatgaaggtgaatatgatattgctggttttgcagtaggagcggtagagaaagaggactatattgatggttcaaatgttgaagaaggacaagcaattattggtttagcttcaagtggtattcattcaaatggctatagtctagttagaaaaatgataaaagaatcaggagttcaattacatgatcaatttaatggtcaaacctttttagaaaccttccttgcaccaacaaaattgtatgtaaagcctattcttgaattaaagaaacatattgatatcaaagcgatgagccatattactggtggaggtttctatgaaaatattccgcgtgcccttcctaaaggtttatcagcaaaaatagatacacaatcattcccaacgttggaagtctttaattggcttcaaaaacagggcaacatttcaacgaatgaaatgtataacatatttaatatgggtattggatatacaattattgttgacaaaaaagatgttcaaacaacattaacaacgttacgtgcaatggatacaactgcatatgaaattggtgagattataaaagatgatgatacacctattcatttattggaggtagaatag

SEQ ID NO: 1781 - DNA, 129 bp, Staphylococcus epidermidis
attgaaataaatctatctgagtttgtattcgatgtcaatatattaacatatttttctaacttcgaacaactatataaaataattattgaatattttttctgttttcaaaacaataatcatacgttttaa

SEQ ID NO: 1782 - DNA, 147 bp, Staphylococcus epidermidis
ggagagataaacatgtcaaaattagcagaagctattgcaaatacagtaaaagcagcacaagaccaagattggactaaattaggaactagtatcgttgatatcgtagaaagtggcgttagcgtattaggtaaaatcttcggtttctaa

SEQ ID NO: 1783 - DNA, 147 bp, Staphylococcus epidermidis
ggagagataaacatgtcaaaattagcagaagctattgcaaatacagtaaaagcagcacaagatcaagattggactaaattaggaactagtatcgttgacatcgtagaaagtggcgttagcgtattaggtaaaatcttcggattttaa

SEQ ID NO: 1784 - DNA, 132 bp, Staphylococcus epidermidis
aatctggtaaagttactagagtttaataaatataatgcacataataaaaatatccttatgtggaggataaattttaagaccttaaaggtgagacctttaaggtcttttttagtcacgactacgtatttttaa

SEQ ID NO: 1785 - DNA, 3114 bp, Staphylococcus epidermidis
aggatttcaaagaaaaggagcgtcaaatcaatgcctaaaagagatgatattaagacaattttagtagtcggttcaggcccaattattattggacaagctgcagaatttgactatgcaggaacacaagcttgtctagcattaaaagaagaaggctacagagttattttagttaattctaatcctgcaacaataatgacagataaagaaattgccgataaagtctacatagaaccattaacgcacgattttattgctcgtattattagaaaagaacaaccagatgcattattacctactttaggtggtcaaactgggttgaacatggcgattcaacttcatgatagtggtgtgttagaagctaataatgtaaagttgttaggcacagagctagagtctattcaacaagccgaagatcgtgaaatgtttagaacattaatgaatgatttaaatgtacctgtaccagaaagcgatattgttaatacagtagaacaagcatttgaatttaaagaacaagttggatacccgttaattgtacgtcctgcatttacgatgggaggtactggcggtggtatttgccataatgatgctgaattaaaagaagttgttagtaatggtttacactatagccctgctacacaatgtttaatagaaaaatcaatcgcaggttataaagaaatcgaatatgaagttatgcgtgataaaaatgataacgcaatcgtagtatgtaatatggagaacatagatcctgtaggcattcatactggagattcaatcgttgttgcaccgagtcaaacactgtcagatgtagaatatcaaatgctacgagacgtatctttaaaagtaattcgtgctttaggtattgaaggtggatgtaatgtgcaactcgcgcttgacccacattcattgaattattacatcattgaggtcaacccacgtgtgtctcgttcatcagcattagcttcaaaagcgacgggttatcctattgcaaaattagctgctaagattgccgtaggtttaacattagatgaaatgcttaaccctatcacaggaacttcatatgctgcatttgaaccaactttagactatgttatttctaaaattccacgtttcccatttgataaattcgaaaaaggtgaacgtgaacttggaactcaaatgaaagcgacaggcgaagtcatggcaatcggtcgtacatatgaagaatctttactgaaagccattcgttcacttgaatatggtgttcatcatttaggtttaccaaatggagaaagttatgaattagattacattaaagagcgtattggacatcaagatgatgaaagattgttctttatcggcgaagcaattcgtagaggaacatctcttgaagaacttcataatatgacaaaaattgactatttcttcctaaataagttccaaaacattattgatattgagcatgaacttaaaaatcatcaaggtgatttagagtatttaaaatacgctaaagattatggttttagtgataaagtgattgctcatagatgggataaggaagaaaaagacatatatcaactacgtatgagtcaaaatattaaaccagtttataaaatggttgatacatgtgcagctgaatttgaatccacaacgccatactattatggtacgtatgaatatgaaaatgaatctatagtaactgataaagagaaaattctagtactaggttcaggaccaattagaattggccaaggggtagaatttgattatgcaactgtacatgcagtatgggctattcaaaatgctgattacgaagctattattgtgaataataatccggagactgtatctactgacttttcaatttctgacaaattatattttgaaccactaacagaagaagatgttatgaatatcattaacttagaacaacctaaaggtgttgtagtacaatttggtggtcaaacagcaataaacttagctgataagttagcacaacatggtgttaaaattctcggaacatcattagaagatttaaatcgagctgaggatagaaaggaatttgaagcgttattacgtgaaatagctgtacctcagccacaaggtaaaactgctacatcacctaaagaagctcttgaaaatgcaagagaaataggctatccagttgtagttcgtccttcatacgtgcttggtggccgtgcaatggagattgtagataatgatcaagaacttgaaaattatatgactcaagctgttaaagcaagtccagaacatcctgtattggtagaccgctatttaacaggaaaagagatagaagtggatgctatttcagatggtgagactgtcgtgattccaggaattatggaacatatagagcgtgcaggtgttcacagtggagattctattgcagtttatccaccacaaacactgactcaagacgaaattaatacactcgaagactacacaattaaattggcaaaaggtttaaatattaaaggtcttattaacattcaatttgtcatagctcacgacggtgtttatgtgttagaagttaatccgcgttcaagccgtacggtaccattcttaagtaagattactgatattcaaatggcacaattagcgatgcgtgcaattatgggtgaaacgcttgccgaaattgggttcaaacaaggtatccaaccatactctgaaggcgtatatgttaaagcgcccgtatttagttttaataaattaaaaaatgtagatataacgcttggaccagagatgaagtctacaggtgaagttatgggtaaagacctaacacttgaaaaagcgctatacaaaggtctcactggtagcggatttgaagtgaaagatcatggtacagtattgatgactgtaagtgataaagataaagatgaaatagtcaagattgcacatcgattaaatgaaataggctacaaaatattggctactcgtggaacagcacaaaagttaaaagatcataatattccagttgaggtcgtaggaaaaatcggtggcgaggatgatttactgacacgaattcaaaatggagaagtgcaaattgtttttttttttttttattcaaggaaaagatatcgaacgagatggattccaaattcgacgtacaacagttga

SEQ ID NO: 1786 - DNA, 957 bp, Staphylococcus epidermidis
aagagtacaaaaaaagagaggattcaattaatgggaaatgtcgtatacaaactcacgtcaaaagaaattcaatcattgatggctcaaactacttttgagacgacgaagttacctcaaggtatgaaagctcgtacgagatatcaaaatactgttatcaacatctatagttctggcaaagtaatgtttcaaggtaagaatgctgatcaacttgcgagtcaattgctaccagataaacaatcaacaactggcaaacatacatcatcaaatacaactagtattcaatataatcgttttcattgtattggaagcgatgaagcaggcagtggcgactattttggtccattgactgtatgtgcagcttatgtgagccaatcacatatcaaaatcttaaaagaacttggtgtagatgattcaaaaaaactaaacgatactaaaatcgtcgatcttgcagaacagctcattacctttatcccgcattctttattaacattagataatgttaagtataacgaacgacaaagtataggatggtctcaagttaaaatgaaagctgtcttacataatgaagctatcaaaaatgtgcttcaaaaaattgagcaagatcaactggattatattgttattgatcaatttgcaaagcgagaagtttatcaacattatgcattatcagcattaccttttcctgacaaaacaaaatttgaaacaaaaggtgaatctaaatcactagcaatcgcggcagcaagcattatttctcgttatgcatttgttaaacacatggaccacatctctaaaaaactccatatggaaataccaaaaggagcaagtaacaaagtagatttaattgccgctaaagtcattcaaaaatatgatattcaacaacttgatactatttcaaaaaaacattttaaaaacagagataaggcaattcatctaatgaatcaaaaatacaataaataa

SEQ ID NO: 1787 - DNA, 171 bp, Staphylococcus epidermidis
atgaaagcaaaaccaaagatgatagttaccttagcatggaatgtcatattagtgtatagagttacaaaaactgctaaaagcgttagtacgatagaagcaataaaacctactgtatgttttacgattgtattcatccgctatacaccatccctatcatatatacggcagtaa

SEQ ID NO: 1788 - DNA, 1014 bp, Staphylococcus epidermidis
aggagggcaaacgttatggcatttgaaggattatccgatcgcttacaagccacgatgcaaaaaatgcgtggtaaaggaaaagtaacagaagcagatattaaaacgatgatgcgtgaagtgagattagcgttattggaagccgatgttaacttcaaagttgttaaggaatttgttaagaatgtttcagaacgagcgctaggttctgatgtcatgcaatctttaacacctggccaacaggttattaaaatcgtacaagaagaacttactagtttaatgggtggagaaaatacttccattaagatggcaaacaaaccaccaactgttgtcatgatggtcggcttacaaggtgcaggtaaaacgacgacagcaggtaagttggcattattaatgcgtaaaaaatataacaaaaaacctttacttgtggcaggagatatttatcgtccagctgctattgatcaattacaaacagtaggtaaacaaattgatatccctgtgtatagtgaaggtgatcaagtatcaccacaacaaattgttgaaaatgctttaaaacatgctaaagaagaacatctagatttcgttatcattgatacagctggtcgtttacacattgatgaagcacttatgaatgagcttcaagaagttaaagaaatctctaaaccagacgaaattatgcttgttgttgatgcaatgacaggtcaagatgctgtgaatgtggcacaatcatttgatgaacaattagatgtttcaggtgtaacattgactaaattagatggtgatacacgcggtggtgcagcactttcaatccgttccgttacccaaaaacctattaaatttgtaggtatgagtgagaaattggatggtttagaattattccatcctgaacgaatggcctcacgtattttaggtatgggtgatgttttaagcctcattgaaaaagcgcaacaagatgtagatcaagaaaaggctaaagatttagagaagaagatgagagagtcatcttcttctctaaatctt

SEQ ID NO: 1789 - DNA, 417 bp, Staphylococcus epidermidis
cgctttaaaaataaaactctgaaattttcaggaggaacagatatgacattagaaatttcaaatgactacggtaaaattgatatttcaaatgatgtaattgcatcagtagttggtggcaaagccgttgaaagttatggaattgttggtatggcatcaagacaacaagttagagatggtatcgctgaaatccttggacacgataactatgctaaaggcattaaagttagagaagacaacggaattattgatgtagacatgtatatcatcgtgagctatggtgtgaaaatttctgaagtagcaagcaatcttcaatcaactgttaaatatactttagaaaaaacactaaatgtgaaagttaattcaataaatattttcgtacaaggtgtacgtgtaaatgagacagtgaaaaaggtttag

SEQ ID NO: 1790 - DNA, 141 bp, Staphylococcus epidermidis
gaaattaaaaaatcgagtaaatcacaatatcgatttactcgttttaaagatgttaagtattatttagattcttttctttgtcgtcttagtaataaaagtgaagatattaaagcgatagaaccaaatactgtagttgtataa

SEQ ID NO: 1791 - DNA, 126 bp, Staphylococcus epidermidis
gaagctaaaaactttactcaacctttctcatttcattttcctatacacggtttcaagaacccaacatactacaaacgaatttcaaaaggcgagagtaaagctgacttgttttttatacggatttaa

SEQ ID NO: 1792 - DNA, 612 bp, Staphylococcus epidermidis
atggctaaaaatattgctaaagcattgttagacatagaggcagtttcattatctccaaatgatttatttacttggagctctggaattaaatcgcctatatattgtgataatcgaataactttaggctaccctgaagtgcgtaatgcgattagagatgggttaattcaattaattaaagaacatttttctaacgttgaaattatctcgggtacggccactgctggtatccctcatgcagcttacatttctgaaaaattagaattacctatgaattacgttagatcaaaaagtaaaagccatggtaaacaaaaccaaatagaaggtgcaaaaagcgagaataaaaatgtcgttgtagtcgaggatttaatttctactggaggttcttcgattacagctgtcgaagcattggaagaagcgggagctaatgtgcttggggtcgttgctatattcacatatggtcttgcgaaagcagacaagacatttaataaggctcatattccgttttacactttaagtgattataatgagcttatagaagttgcgaaagatgaaggtaaaatctctttaaatgatatccaaacattagttgattggcgagataacttatcgtaa

SEQ ID NO: 1793 - DNA, 123 bp, Staphylococcus epidermidis
tataataaaaagtttttacatgtgagcgtgtatttcaagaaaataaattttaaattattgattaaatacaataagaaagcccaaaatgaatttcattttgggcttatttttgtgaagttataa

SEQ ID NO: 1794 - DNA, 1122 bp, Staphylococcus epidermidis
caagataaaaagaaaggaaagttagagatgataactgcagaaaaaaagaagagaaacaaattcttacctaatttcgaaaaacaatcgatctactccttaagatatgacgagatgcaacaatggcttattgatcacggacaacaaaaattcagagcaaaacaaatttttgaatggttataccaaaagcgtgtgaatactattgatgaaatgactaacctgtctaaagagttacgtcaaattctcaaagatcattttgcaatgacgacattgaccactgttgttaaacaagaaagtaaagatggaacaatcaagttcttatttgaattacaagatggttatactattgaaactgttttaatgagacatgaatatggaaattctgtctgtgtaacaacacaagtaggatgtagaattggttgtacgttttgtgcttccactttgggcggattaaagcgtaatttagaggccggagagattgtctctcaagtattaactgtacaaaaggcactagacgaaacgaatgaacgtgtatcacaaattgtcattatgggcataggtgaacctttcgagaattatgatgaaatgatggatttcttaagaattgttaatgatgataacagtttaaatattggtgcacgtcatattactgtatctacttcaggaattattccaagaatttatgattttgccgaagaagatatacaaataaattttgctgtgagtcttcatggtgctaaagacgaaataagatcaagattaatgcctatcaatcgtgcttataacgttgataagttaatggaagctattcgttattatcaagaaaagacaaatcgccgtgttacttttgaatatggattgtttggtggtgttaatgaccaacttgaacatgcgagagatttggcacatttaattaagaatctcaattgccacgttaatttaataccagttaaccatgtcccagaaagaaattatgtaaagacaccaaaagatgatatttttaaattcgagaaggaattaaagagattaggaattaatgctacaattagacgtgagcaagggtcagatattgatgctgcgtgtggacaattaagagcgaaggaacgacaagtagaaacgaggtaa

SEQ ID NO: 1795 - DNA, 225 bp, Staphylococcus epidermidis
aaaataaaaaaggagcctcattcaatgagactcctttttgttatagcgtcctgggagggattcgaacccccgaccgatggcttagaaggccattgctctatccagctgagctaccaggacattttcaacacaagaattattatatctaaatatatgtcttttagcaataggtacctaataaaaattatttatatttttcactataatagaggtttttatacataa

SEQ ID NO: 1796 - DNA, 1227 bp, Staphylococcus epidermidis
tatatgaaaaattttaaaaatataatgcgatatattggaaagacttctaaatttatcgattatccattgttaataacttatgttgtcctctgtttgattggattagtaatggtttatagcgcaagcatggttgcagctacaaaaggtacgttaaccgggggagtaccagtttccggaacatacttctacaatcgacaacttttatacgttatcatgagctttgttatcgtattttttatggcttttattatgaatgttaaagtattaaaaaagcctaatgttcaaaaaggtatgatgattggtatttttatacttttactactaacattagtaataggaaaaaatatcaatggttctaaaagttggattaacttagggttcatgaacttacaagcttcggagttattgaagatttcaataattctatacataccatttatgattgaaaagaagatgcctgcggtgaggcataatataaaattaatattaggaccaattttgtttgttgtaacttgtttgatacttgttctttttcaaaaagatgttggtcaaacaatgctgattgtgatcatattcttctcaattattttttactcaggtatcggtgtgcagaatatgttaaaatggggcgctttggtagctattggttttatcatcgtagctacatttatgttcatgttagatatggttccaagttatttgcaagcacgttttagtacgttaaccaatccatttagtcaagaatcaggcacaggatatcatatttctaattctcttttggcaattggcaatggtgggttgttcggacgtggtctaggaaatagtattatgaagcttggttatttgccagagccacatacagactttatatttgctattatttgtgaagagatgggattaatcggtggcttaatcgttttaattttagagtactttattgtatatcgcgctttccaacttgctaataaaacgcaatcgtatttttataaattagtttgcgttgggatagctagttatatcggaagccaaacattcgtaaatatcggtggtatttctgctacaattccacttactggtgtaccgttaccatttattagttttggtggttcatcgatgattagtttaagtatagctatgggattactacttattacagcaaaacagataaaacaagatgataaacgactgaaacaacgtaaggtagatattaaacgtcgatataattaa

SEQ ID NO: 1797 - DNA, 1101 bp, Staphylococcus epidermidis
atgcttgaaaaacgttatcttgtactggaagatggctcttattacgaaggatatcgcttagggtcagatgacttatctataggcgaaattgtattcaacactgctatgacggggtaccaagaaacaatctctgacccgtcttacacaggtcaaatcataacttttacgtacccactaattggaaactatggtattaatcgcgatgattttgaatcattaacacctaaattaaatggggtagtagtaaaggaagcaagtacacaccctagtaactttagacaccaaaaaactttacacgaaacacttgctcaatatcatattcctggtatatcgggggtagatactagaagtattactcgtaaaattagaaattatggtgttttaagagctggatttacagataataaagataacattcaggaacttgttgaacagttgaaaactgctgaattacctagagatgaagttcaaacggtttctacaaaaacaccatatgtatcaacaggttccgatttaagcgtcgttttactcgactttggtaaaaagcaaaatatcgttcgtgaattaaatttacgtggttgcaacgtcacagttgtaccatatgatacgtcagctgaagagattttaggcatgtctccagatggtgtcatgctatcaaacggacctggtgatccagacgaagttgacgttgctttagatatgatcagaggcatattaggaaagataccattctttggtatctgccttggtcatcaactttttgcattatcacaaggcgcaacttcattcaaaatgaaatttggacatcgtggtgcgaaccatcccgttaaagatttaagaacaggtaaaatagatatcacgagccaaaatcacggctattctattgattgtgactcgctaaaaaatactgaccttgaagttacacacattgctttaaacgatggtactgttgaaggactaagacataaagaacttccagcgttttcagtccaatatcatcctgaagcaagaccaggtccaagtgattctaattacttatttgatgagttcatagcaatgatgaaggatttcaaagaaaaggagcgtcaaatcaatgcctaa

SEQ ID NO: 1798 - DNA, 1692 bp, Staphylococcus epidermidis
gacagtgaaaaaggtttaggaggacaacgtgaaatgattagcaaaataaatggtaaattatttgccgatatgattatacaaggggcacaaaatttatcaaataatgcagacttagtggattcattaaacgtctatcctgttccagatggagatacagggacaaatatgaatttaactattacttctggtcgtgaggaagtcgaaaataatttatctcaaaatattggagagttaggtaaaacattttcaaaaggattacttatgggggctcgtggtaattcaggtgttattctttctcaattattcagaggtttttgtaagaatattgaagaagaaaaagaaataagcgtgcaacagtttgctgagagttttcaagctggagttgaaacagcttataaggcagttatgaaaccggtagagggaacgattttaacagtagccaaagatgcagcaaaagcggcaatggattacgtggatcaagctgaagattgcgttgatttaatggcacatctgattgaagctgcaagcgaatctctagataatacgcctaatttattagcagtacttaaagaagtaggcgttgttgatagtggtggtaaaggtttattatgcgtttatgaaggcttcttaaagggtcttaaaggcgaaaaaatagaagcacaagcacctaaacttgatactgaatcatttgttaatgatgatcatgattttcatggggttattaatacagaggatattgtttacggttattgtacggaaatgatggttcgatttggtaaaaataaaaaagcattcgacgagcaagaatttcgtaatgatatgagtgaattcggtgattcgttattagtaattaatgatgatgaaattgttaaagtgcacgtacatacagaacatccgggtgatgtatttaattatggtcaaaaatatggtgaactaattaaacttaaagtagaaaacatgcgtgaacaacatcgtgaagttattcgtaaggaacaagatggacttcaaagtaaagaagctaatgaatccaaaacagttgaaacagctattgttacaatttctgtaggcgatgggattgctgaattatttaaatctatgggagcaacgcacattattagtggagggcaaacaatgaacccttctactgaagatatagttaaagttattgaacaatcacaatgtaaacgtgcaattatcttaccaaacaataaaaatattatgatggccagtgaacaagcagctagtattgtagaagctgaaactgtagtgattcctactaaatctattccacagggaatatcagccttattccaatatgatttagaatctagtttagaagataataaacgccatatgagtgatgctttggaaactgttcaatctggttcaattacttttgcagttagagatactaaaatagacggtattgaaatcaagaaagatgaattcatgggtctagctgaagacaaaattgtgacaagtgatgttaatcaatttcatgcagtaaaaggtctactcagcaaacttcttaatgaagatagcgaaattttaacaatgatttcaggcgaagatgctgataattcaattacaaaccaaatcattaattggattgaatcggagtaccctgatgtagaagtggaacaacatgaaggtggacaacctatttatcaatatttcttcgcagtagaataa

SEQ ID NO: 1799 - DNA, 159 bp, Staphylococcus epidermidis
attatacgaaagggccttatttttttaaagtattttaatgtaaaattacatatgaatacaaagtattttggcgagactcttgagggaacaggacaagctgaagactacaggctgaagctgtcctctaagaaagcgagccaacaatacgaagtattgtaa

SEQ ID NO: 1800 - DNA, 552 bp, Staphylococcus epidermidis
gtggttagaaagatggatattggatacaaattacgtaatttaagaagaataaaaaatttgacacaagaggaattagcagagcgaactgatttatcaaaaggatatatatcacaaattgaaagtaatcatgcttcacctagtatggaaacatttttaaatttaatagaagtacttggtacttctgcaagtgacttttttaaagaaccgtcagatgagaaggtactttataagaagaaggaacagaccatttatgatgagtatgataaaggttatatcttgaactggcttgtagcgaattctaatgaatttgacatggaaccattaatcctaactttacgaccaaatgcctcatataaaaactttaaaccatctgaatcagatacttttatctattgtttaaatggtgaagtatcacttcaattaggaaatcaagtatataaagcttgtaaagaagatgtactttattttaaagcgaaagataaacatcgcttatataacgaaacagataaagaagtgaaggttttaatcgttgccacagcttcatatttatag

SEQ ID NO: 1801 - DNA, 537 bp, Staphylococcus epidermidis
ttgaatagaaaagtagaaaaaagattagcgtggattgcaaatatcttgagcctattatttttaatttttggtattctatcgatatttgttattaataacacatcaaatcaacaacaatataatgaattaatgaagcagttttcaggtaataatcaagatatgtcatctgaaatgtttttagtttctcttattgcgtcattagtcattttaggtttttcaacgctattaggttttgttggtacaatggtaattgaaggtataaaaaaccttgctgctactttactcatagcagcggctatcgtaggtttatttacgactaatttaatcgcaatggttttatggatgattgctgcgattagactttttgcaaaaaaagataaaacagatgtaaatgaaaatgctacggctcaacttcgtcaaaaccattcaaagagccaaagtgattggaatcatcaacaaaaccaacaacataaagatgcttgggatcctgaacaagaaatcaacaaacaaaaaaaggacgatccatatatatattaa

SEQ ID NO: 1802 - DNA, 798 bp, Staphylococcus epidermidis
  modified_base (32)..(32): a, c, g, t, unknown or other
aatattttgaaagagagatttattaagaaaantcattatttagactatgaatttgatgagggtagtgatattaagttaggtttcactactcgagaaaatgggttaagtccttatcctaatcatagttttaatatggcaagatatatcagtgacagtgcacatcatattacacatcatcaaaatatcttagcgaatcttattggttatacaagagatgaatgggtttttcctatacaaacacatgataatcgtatcgttgaagttacaagtgaacataaaggaacaaatattgatgaactaactgatgatttacatggcatagatggaatgtatacttttgattctcacattcttcttactatgtgttatgcggattgtgtacctgtatatttttatagtgaaccacatggctatataggattagcacatgcaggttggcgaggaacatatggtcaaatagtaaaagaaatgctaaaaaaagtggattttgattatgaagacttaaagattgtaattggtccagcaacttcaaattcttatgaaatcaatgatgatataaaaaataagtttgaggaattaaccattgattcaactttatatattgagaccagaggtaaaaatcaacatggtattgatttgaaaaaggctaacgcacttcttctagaagaagctggagttccatcaaaaaacatatacgttacggaatatgcaacttcagaaaacttagatttattcttttcatatcgtgttgaaaaagggcagacgggacgtatgttagcatttattggacggaagtaa

SEQ ID NO: 1803 - DNA, 423 bp, Staphylococcus epidermidis
tataatttgaagataaaggagtttgatttatttatgaaacaatcatttattaaaattggtgaaggtttaaccgatttattcgaatttacaactcttatagaatataatcataagcgaatcaatcgtattgtgtatttccatacacctcattctgagaaacaattatcgtccgttgcaataataatgaaccctactgctgaaaaacatttccaggctatgtatatcatgacaaatgccttaaaatatccctatccagagggcaacaaaaaattcaatatgattaattcagctgcagaaaattatgacataccagttgtaggtatcgacgtacaacctcctgatgtatatccagacttagaattatattttaactaccttatcagtgttttgcgtcttcaaagatggataccacctttgcaataa

SEQ ID NO: 1804 - DNA, 963 bp, Staphylococcus epidermidis
atgaaactgaagtggaggcgtattttgacaatgagtaaaatcatttttatgggaacacctgatttttcaacgaaaattttagagatgttaattgctgagcatgaagttatcgctgtagtgacacaacctgatagaccagtgggacgtaagaaagtgatgacaccaccaccagtaaaaagagtagctacaaagcatcaaataccggtatatcaacctgaaaaacttaaagattctcaagaattagaatcgttactttctttagaatcagatttaatagtaacggctgcgttcggtcaactattaccagagtccttactcaatgcacctaaattaggagctattaatgtccatgcatcattgctacctaagtatagaggaggagcacctatacatcaggctataattgatggtgaagaagaaactggaatcacgattatgtatatggttaaaaaacttgatgcaggtaatatcatctcgcaacaatcaattcgtattgaagaagaagataatgttggcacaatgcatgataaattaagctttttaggtgccgaattattaaagaagacacttcctagtatcattgataataccaatgacagtatccctcaagatgatgcacttgcaacatttgcatctaatattcgtcgtgaagacgagagagttgattggaatatgagtgcacaagcaattcataaccatattagaggactgtctccatggccagttgcttatacaactatgaatgaaaagaatctcaaattatttagcgctttcattgtgaaagggaaaaaaggtaatccaggaacaattattgaaactactaagcatgaactcatcatagctaccggttctgatgatgccatcgcacttactgagattcaacctgcaggaaaaaaacgcatgaaagttactgattatttaagtggtgtacaagagtcgttagttgggaaagttctattatga

SEQ ID NO: 1805 - DNA, 561 bp, Staphylococcus epidermidis
agccatatgaaatggtcaataacacaattgagaaaatatcaaggtaagccatttgaatttaatcaaacggttaattttgagcatttaagagaatcattagatttaattgatctttcagatatcaatgttgaaggacagttgacagtcaaatcaaatgaagtgattgcagacatgcatgttactggaacttacacgatgccttgtgctcgtactttagtaccagttgatgtgcctcttgatgtatctacttcagaagtatttgatttagaaggctatgatggttataccgatagtgacgatcaagaagatgagcattatcatcttgtaactgacggtatgattaatattaaagacattgctgaagaacttgtaattattgaaaaacctatgcgtgcttattctgaacatagtgatcaaatgttaacagaaggcaatggttgggaagtcattgatgaagatcaattgactgaagttcaaaaagagcaagatagtgattctgaacaaagaaaaagtgatccaaggcttcaaaaattacaacaattaaacgataaagataattag

SEQ ID NO: 1806 - DNA, 810 bp, Staphylococcus epidermidis
agaagtatgaataaacctattggagtcattgattcaggtgttggtggtcttactgtagctaaagaaattatgagacagttaccaaatgaaactatttattatttaggtgatatagcacggtgtccatatggtccaagaccaggagaagaagttaaaaaattcacaacggaactagctcaaaaattgatggaatttgatataaaaatgctagttattgcttgcaatactgctacggcagttgcattaaattatttacaaaacatattacctattcctgtcattggtgttatcgaacctggagcaagaactgctataatgactacaaaaaatcaaaatgtattagttttaggaactgaaggaacaattaaatcagaagcgtatcgcacacatataaaaaagataaatccaaatgtgaatgtctatagtgttgcatgtccgggctttgttcctctagttgaacaaatgcgctataaagaccctacaattactaatattgtgattcatcaaacgttgaagcaatggagaaacagtgatgcggacacggttattttaggatgcacgcactatccgttgttatatcagcctatttatgaatattttagtggtactaaaacagttatctcatctggcttagaaacagcaagagaagtaagtgcattactcacgtttagcaatgagcatgccagttacacagaacatccccaacatagattttttgcgactggtgacaccacacatattaaaaatattattgatgaatggttaaatatgaaagttgaagttcaaagaataactgtagatgattcatag

SEQ ID NO: 1807 - DNA, 633 bp, Staphylococcus epidermidis
cagttcatgaattttaaaaagactgtagcaattgtcctaacgtcagcagtgttattagctggatgtactatagataaaaaagaaattaaaaaatatgatgatcaagtacaaaaagctatggaccaagagaaaaccgttaatcaagtaagtaaaaaaataaacgaattagaagagaaaaagcaaaaattatttaaaaaggtaaatgataaagatcaaagcacacgtaaaaaagcagctgaagatatagttgaaaatgtaaaacaaagacaaaaagaatttgaaaaagaagagaaggctctagataattctgaaaaagaatttaaacaagccaagcaatatcttgaacatgtagaaaacaaagcaaagaaaaaagaagttgaacaacttgatagtgctattaaagaaaaatataaatcacatgatgcttatgcaaaggcttacaaaaaagcacttaataaggaaaaagaactgttttcttatttgaatgaagataatgcaacacaatcggaagtagacggaaaatcgaaagatctttctaaagcatataaagaaatgaataataaatttaatgcttactcaaaagccattgagaaagtaaaaagagaaaaacaagatgtagaccaattaaaataa

SEQ ID NO: 1808 - DNA, 1284 bp, Staphylococcus epidermidis
ttctacatgaaattaattaaaaacggaaaaatcttaaaaaacggtatcctaaaagacacagaaattttaatcgacggtaaacgtattaaacaaattagtagtaaaattaatgcttcatcttcaaatattgaagttattgatgcaaaaggaaatttaattgctcccggttttgtagatgttcatgtgcacctacgtgaaccaggtggtgaacataaagaaacaattgaaagtggtacaaaagccgctgcaagaggtggttttactacagtatgtcctatgcctaatacaagacctgtaccagatacagttgaacatgttagagaattaagacaacgaatttctgaaacagcacaagttagggtgttgccttatgctgctattactaagagacaagcaggtactgaacttgttgattttgaaaaattagcactagaaggtgtgtttgcatttactgacgatggtgtgggagttcaaacagcaagtatgatgtatgctgctatgaagcaagctgcaaaagttaaaaaaccgattgtcgcacactgtgaagataatagcttaatctatggtggtgcaatgcataaaggtaaacgtagtgaagaattaggcatacctggtattccaaatattgctgaatctgtacaaattgctagagatgtattattggctgaagcaactggttgtcactatcatgtgtgtcatgtttcaactaaggaaagtgttcgagtaatcagagacgctaaaaaagctggtatccatgtaacagcagaagttacaccacatcatttattattaactgaaaatgatgttcctggcgatgattcaaactacaaaatgaatccaccattaagaagtaatgaagatagagaagcacttttagaaggcttattagatggaacaattgattgtattgcaacggatcatgcacctcacgctaaagaagaaaaagcacaacctatgacaaaagcacctttcggcatcgtaggtagtgaaacagcattcccattactttatacacactttgtaagacgaggtaattggtcactgcaacaattagttgattatttcactattaaaccagctactattttcaacttaaattatggaaaattacacaaagatagttacgctgatttaacaataattgatcttaatactgaaaaagaaatcaaaagtgaagatttcttatctaaagctgataacactccatttattggtgaaaaagtttatggaaatccaacactaacaatgcttaaaggtgaagtagtattcgaggaggaaaagtag

SEQ ID NO: 1809 - DNA, 402 bp, Staphylococcus epidermidis
aacaaaatgaagatattcctgaagaaatctctagaaattcatccgttgaatctgaagaaggtaactaaaatgggacaaaatgatttagttaaaacattgcgtatgaattatctatttgatttttatcaaagtttgcttacaaataaacagaaaaattatctcgaattattttatttacaagattattctttaagtgaaattgctgatacatttgaagtgagtagacaagcagtttatgataatataagaagaactggcgatttagtagaagattatgaatcgaaattacgactataccaaagattcgagaaacgtcgtgaattatataacttaatgaaacaatcacttaatcaacctgagttgcttaaacaatatatcactcaattagaagaattagagtag

SEQ ID NO: 1810 - DNA, 477 bp, Staphylococcus epidermidis
gtaaggatgaaacttatgaacgtacccattttaccaacgataagtacatcgtgtattgttattagtgcgattttagtcgctattggttgggcattgatttggaaacgtcaagttcataagcataaaaacattatgctatgggctgcctttttcgctttaacattctttattatttatgcagcaagaactatttttatcggtaatacagctttcggtggaccaagttctattaaagtttattacactattttcttagttttccatatcattcttgcaacagttggtggcgttttaggcttaattcaaatcattttagccttcaaagataaacttcatattcacagaaaaattgggccttgggcttcaataatttggttctttaccgcaattactggtgttgcagtttatgtattgttatatgtattgtatccaggtggagaaacaacatcattgcttaaagctacattaggtctataa

SEQ ID NO: 1811 - DNA, 672 bp, Staphylococcus epidermidis
tggaggacgaatatggataaagagtatgtcgtaattggactagggcgttttggtggtagtattgttagagaacttaacgcattagacatggatgttatggctattgatagagacgaaaatcgtgttaacgaatatagtgatatagcaacacatgcagttgttgctgatacaactgatgaggcagtaatgaagagtttaggaatacgtaatttcgatcatgttattgtcgctattggtgagaatatacaatctagtacactaacgacgttaattcttaaagaattaggtgttaaaaaggttactgctaaagcccaaaatgattatcatgctaagattttaaataaaataggtgccgatactgttgtgcaccctgaaagagatatgggaagacgtattgctcataatgttgctagtgctagtgtccttgactacttggaacttgctgatgagcattcaatcgttgaattaaaatctacagaaaaaatggcaggacaaacaattattgaattagatattcgagctcaatatggtattaacattatagcaattaaaagagctaaagaatttatagtctctccagaccctaacatcaatattgaaataggggacattttaattatgattggtcatgataatgacttaggtcgctttgaaaaaaatataagcaagtaa

SEQ ID NO: 1812 - DNA, 1314 bp, Staphylococcus epidermidis
gaggacaagaacgtggcatttgaatttagattacccgatatcggggaaggtatccacgaaggtgaaattgttaaatggtttattaaagccggcgatacaattgaagaagatgatgtattagcagaagttcaaaatgataaatctgtagtagaaattccttctccagtaagtggtactgttgaagaagtgttagtagatgaaggaacagtggcagtagtaggagatgtcatcgttaaaattgatgcacctgatgcagaagaaatgcaatttaaaggtcatggcgatgatgaggattctaagaaagaagaaaaagaacaagaatcaccagtgcaagaagaagcttcatcaactcaatcacaagaaaagacagaagtagatgaaagtaaaactgttaaagcgatgccgtcagtgcgtaagtatgcacgtgaaaatggtgtcaatattaaagctgtaaatggttctggtaaaaatggacgaatcacaaaagaagacatcgatgcatacttaaatggtggtagttccgaagaaggttcaaacactagcgcagcatctgaatcaacttctagtgatgtcgttaatgcttctgcaacacaagcattaccagaaggcgacttccctgaaactacagaaaaaatacctgcaatgcgcaaagcaattgctaaagcaatggttaattctaaacacactgcacctcatgttacattaatggatgaaattgatgtgcaagaattatgggatcaccgtaagaaatttaaagaaattgctgctgaacaaggtacaaaacttactttcttaccatatgttgttaaagcattagtttctgcacttaaaaaatatccagcacttaatacttctttcaatgaagaagctggagaggttgtacacaaacattactggaatattggtattgctgcagatacggataaaggattattagtaccagtagttaaacatgccgatcgtaaatcaatattcgaaatttctgatgaaattaatgaactagctgtaaaagcacgtgatggtaaattaacttcagaagaaatgaaaggtgcaacatgcacaattagtaatatcggttccgctggtggacaatggttcactccagttatcaatcacccagaagtagctatcttaggaattggccgtatcgctcaaaaacctatcgttaaagatggagaaattgtagctgcaccagtgttagctttatcattaagctttgaccatagacaaatcgatggtgctactggacaaaatgctatgaatcacattaaacgcttattaaataatccagaattattattaatggaggggtaa

SEQ ID NO: 1813 - DNA, 1056 bp, Staphylococcus epidermidis
aagatgaagaagttaataattaaagttattggtgttatattattagtgacatttttaatttatctcttttactcaccacgtttaaagtttgatgttctagagaatccaaataaaaatagcaaaacgactaagacagagcaatttaaacaggtgaataaggatgctgagaaccctaaacctaaagaagggatagggacttggattggaaaagatattaaaacactaacgcatcattatggacaagctgatcggtcttatccatataaaaatgggttaaaaaattatgtctttaaacagaaagatgaatattatattgtaagtactaataaaggaacaatcacatcagtttatgccacaggtaaaggtgtgaaagtgagcccacttaaaataggtgaaagttcatctcatatttttgaagatactagtattaatccagaaccaactgtcaaaacgaaaggtaaaacttataaatttgaaatgtctgatgaagacttaaagacacagacgttaattaaatatggagatgtttatgctcaaatatattctgatcaacaaactaataaaattttggcagtgagatttttagatgcaaatacattggcaacactacaaccatataagttaaatagagcagaagatgagggacaaattagtgaaagttccgacgataaaattccacatgaacaaaaccctaatcaattgattacactctatgaagtaacgaataaaatgagagaaatgaaaaatttaaattcacttaaagttaacaacgatattgctcgtattgctgctatcaatctgtatgaagcaacggataaaggatcaaacagtgtggagtttactgagaatgctttaacacaacaactggatgaacgccatgtaagttataagtcagcaagtcaaaatgtaggttatgattttgacgatgtacctacacttattcatagttggattaattctgatattcatcgctcacgcttgttaagtaataaatatgatgaaatgggtggagaagtgatgagtgattattattcattaatatttgtagaaaagtaa

SEQ ID NO: 1814 - DNA, 564 bp, Staphylococcus epidermidis
atgaaatggaagtgtgagtcaatgcgtgtaattgcgggtaagcataaaagtaaagcgctagaaagtttagaggggcgaaatactcgtccaactatggataaagttaaagaaggtatttttaatagtttatatgatgtttctggtttaggattagacttatttgccggtagtggtgcacttggcattgaagcattatcccgtggtatggataaaatgatttttgtagatcaaaattttaaagcggtcaaggttataaaagctaatcttaatcaattagatttaatgtcacaagctgaagtctataaaaataatgctgacagagcacttaaagcacttgctaaacgagaaatacaattcgatgttatctttttagacccaccttataataaagggcttataaatgaggcgatttctcgtatagcagagtttaacttattaaaagaaaatggtattatcgtttgtgagtttagtcataatgaaaaaataacaattgcgccatttcaaatgattaagcgttatcattatggtttgacagatactttgttacttgaaaaaggagaataa

SEQ ID NO: 1815 - DNA, 522 bp, Staphylococcus epidermidis
atgctcattgatatagttgttcttcttattatttgttactttatagtgatagggtttcgtagaggtatttggttatcgatattgcactttgcttcttcaattgtatctttatatattgcgtcacaacattatcaatcgattgcgcaacgtttagttgtatttgtgccatttccgaaaacggtggcgtttgatatggtctatactataccttatgatcatttgcaatacagatttgaaaaagtgatagcatttattataatatttggtatgtgtaagcttattttgtatctagttgttgttacatttgataatataataacgtataaaaagatacatttagtaagtcggatatcgagtgtcgttttgagtatcatatcggtttttatatatttacaaattggactttatttattatcgctatatccgcattcatttatacagtaccaattatctcaatcgctagtaagtcgagttgtgattgaacaaattccttatttatcacaatttattttaaatttataa

SEQ ID NO: 1816 - DNA, 1827 bp, Staphylococcus epidermidis
tttatatctgaaattaaaagtagggctttagatttaaatattcaggggagtgacatttctatggcagagaaaaaaattattgttgtcggtggaggactagctggtctgatgtcaacaattaaagcggcagaacaaggtgcacatgtagatttattttccattgtaccggtaaagcgttcgcactctgtttgtgcacaaggtggcataaatggtgctgttaatactaaaggtgagggagattcaccgtggattcactttgatgatactgtttatggtggagacttcctggctaatcaaccaccagtcaaagcaatggctgatgctgcacctaaaatcatccatctgttagatcgtatgggggttatgtttaacagaacgaaagaaggcttattagactttagacgttttggcggtacactacatcatagaacagcttttgctggcgcaacgacaggtcaacaattgctttatgcattagatgagcaagttcgttcatttgaggtagatggtttagtaactaaatacgaaggatgggaatttctaggtattgttaaagacgaagaagatgctgcaagaggtattgtcgctcaaaatatgacaacatcagaaattcaatcattcggttcagatgctgtcatcatggcaacaggtggtcctggtattatctttggtaaaacgacgaattcaatgattaatacaggttcagcggcgtcaatcgtttatcagcaaggtgcgatttatgcaaatggtgaattcatccaaatacatccgactgcgattcctggagatgacaaattacgtcttatgagtgaatcagctcgtggtgaaggtggacgtatttggacgtataaagatggtaaaccttggtacttcttagaagaaaaatatccagactatggtaacttggttccacgtgatatagcgacacgtgaaattttcgatgtttgtattaaccaaaagttaggtatcaatggagaaaacatggtataccttgatttatctcataaagatccacacgaattggatgttaaattaggtggtattattgaaatttatgaaaaattcacaggtgatgatccacgtaaagttccaatgaaaatcttcccagcagtgcattattcaatgggtggtttatacgtagactatgatcaaatgactaatatcaaagggttatttgcagctggagaatgtgatttctcacaacatggtggtaaccgtttaggtgccaattctttactttcagctatttatggaggtacagtagcaggtcctaacgctatcaaatatgttgaaaatgttgaaaaatcgtatacagatctagatgacagtattttcgaagctcgtgttaaagaagagaaagaaagatttgatcatttattaaatatgcgtggaactgaaaatgcttataaacttcaccgtgaattaggtgaaattatgacagctaacgtaactgtagttcgtgaaaatgaaaagttgcttgaaacagataaaaaaattcaagagcttatgaaacgttatgaagatatcgatatggaagatacgcaaacatggagcaaccaagcagtattcttcacacgacaattatggaatatgttggttcttgctcgtgtgattacgattggtgcatataatcgtaacgaatctagaggtgcacattacaaacctgaattcccagaacgtaatgatgaagaatggttaaaaacaaccatggctcgttataaaggtagaagtgaaaagccagaatttacttatgagccagtagatgtaagtttaattccacctcgtaagcgtgactacacaagtaagtctaaaggaggtaataagtaa

SEQ ID NO: 1817 - DNA, 240 bp, Staphylococcus epidermidis
tgtatgactgatacagtgattatttatacacaagatgactgtccaccttgtgcttttattaaaaattatttagtaaataaaaatataaaatttacagaaaaaaatatcaaaaaccaaaaatataaaaatgaaatgatggattacgatgcttttgctacaccttttattttgcttaaagggatgccaatgtatcaagtagatatggaaaaattgaatgatgaattgaatattacaccttaa

SEQ ID NO: 1818 - DNA, 450 bp, Staphylococcus epidermidis
ataaaggatgattctgtgattactgaagaaacattagacattttagatgatattgaggatatctcggatatgattgtacaatctgatatttatgtctcataccgacgagctaaaatgcaattagatgctgatgatgaggcaagtctactttatcaagcttttctaaaagtgaaagataagtatgatgatgtgatgagatttggaaaatatcatcccgattacaaagatattatgttagaaactcgaaaacgaaaacgtgcttatgaaatgcttccagtagtaatggagtataaagcaaaggaagtggcattacaaaatttaattgacgaagtgatgtccaaaatagcattagctgtttctgagcatgtaaaaattgaaacaggtaatcctttcttccaaactggacatgatggatgtgcatctggtggcacatgtaactgttcattgtaa

SEQ ID NO: 1819 - DNA, 486 bp, Staphylococcus epidermidis
aagaagtgtgatgatatgaaaaaagcaatcatagtcatgtttgttgttactgttatcttgacaatagcagcactcattgacgagtttatgattcaagatgcgaaacatggtcaaagtcgttttacgtcacatcatcctatgaaaatcaatacatataaaaaggggcagtgtacatattacgtctttgaacgtgttaaaaatgatggaaataagataaacaatacttggagcgacgccaagcattgggataaaaaagcaattgatgatggatacattgttgaccgtaaccctaaaaaaggatcaatattacaatcttctaaagggaaatacggtcatgttgcatatatagaaacaataaatgaagatggttctatgcaagtttcagaaatgaactatacacaaccttatgaaatcacaaaacgcacaattcatacctatgatattaaaaattattattatattcatccgcaaaagataaaaacataa

SEQ ID NO: 1820 - DNA, 777 bp, Staphylococcus epidermidis
ataaccatcgatatatatcagcattttagaaaggaagaacaagatgctctcgatcaattcatcgataaatgtaagcaggctgatgctaattatgctccagttctaacccatttcttggatccgagaggtcaatatatacttgaagtcattacgcgtagttatcaagatttacatgttacattttttggtggaccacatgcagaaagaaaacgtgcaatcatcgcaccattatattttaagccacagcctgaggactttgaattaactttatttgaacttcaatatcctaagaaatttgtaacaatacaacatcaacacgttcttggaacactcatgtcactgggaatacaaagagatcaactcggcgatattatagttggagaagatatacagtttgttttgacaaaacaattagaatcatatattatatctgaattaacgcgtattaagggagcctcagttaaacttaattctattcctactgaagatatgatacaatcagaagagaattggaaagttcatagtacaactgtgagcgctttgagattagatgtagttttaaaagagatgattcataagtctcgaaatattgcacaacaattaattataaaaaaaagagtcaaagttaaccatacagtaatagattctacagattttcaattagagcagaatgatttattgtcaatccaaggttatggtagagctcaaattgttgaaataggtggaaaaacaaaaaagaacaagttacacattcattatcaaacactatttaaatag

SEQ ID NO: 1821 - DNA, 153 bp, Staphylococcus epidermidis
caattaatcgattcaaaagcaaataaaaaaataatgaaaaattataattgggaatattttaaagtccaaattattaaaaagttttcagaaccaaaaacaaaaagcatctacagtcaagaaaaattgatgtggagcctgtttttggatttatga

SEQ ID NO: 1822 - DNA, 183 bp, Staphylococcus epidermidis
tccaattacgacatactctttatccatattcgtcctccactatataaaagaggaatgattactaacattcctcagagtcttattatttctttccttccacatatgctttgtcgaaaacaaataatcttaataataatattaacgatggaattaataaaagtaaacctaaaacaaaaacaataa

SEQ ID NO: 1823 - DNA, 126 bp, Staphylococcus epidermidis
acgatcaacgatgatgtcttttactttatcgaagttttccacgtcgcttcacctccttttaaagagtcttttgatagactattttattttcccattttactttctaaaatacaagtagaattttag

SEQ ID NO: 1824 - DNA, 150 bp, Staphylococcus epidermidis
ctccaaaacgatcggatacgttttgattcgttatctctatcgttttgttacctatactataaagttaatttgactcaatttgttgcatttttcatactaagtaattacgagttcctaactgttgctttatttaagttttttaacagttag

SEQ ID NO: 1825 - DNA, 192 bp, Staphylococcus epidermidis
ttacagcaagatatagataatatgaagcgatacacccataagagcagagtcttttattataaagttgatagaaaggtgactctttatacgaaatatgacaaaaaagttcaggtcagtgaaagaataacgttgactacaatgggattaaactacaatttatgttttgtatctaacactatgattgagctgtaa

SEQ ID NO: 1826 - DNA, 336 bp, Staphylococcus epidermidis
tcacatcgagaatatggagcaacactacgaataaggagttcaactatggatattggtttgctaagtacaattttccgatttattatatttttagttcaaatatattattttggaatgattatatatttctttacttcttgggttccgagtataagagagtctaagtttggagaatttttaggaaagttatatgaacctttcttagaacctttccgtaaaattattcctcctattggctttatagacatttcttctatcgcggcaatcttcgttctagttttattccaaagtggtttagtaaaaatatttaatttaattcttgcatatttatcttaa

SEQ ID NO: 1827 - DNA, 1398 bp, Staphylococcus epidermidis
atgctcatggaagagaataaaaatcaacctaataaggagaatatgtcgaataaagacgataatgcaactcatttgaatgacagtcacagaaatgaagacttagagctttttagacggaataaaaacgctcgccaacgcagaagacgtcgtatagataaccaaagtaaagaaaaggatgctacgtctacacaatcacagttagaaactaaaccaatggataaatttatagataatcacaagtcgcataatcaaaacaaagaaataaaaagtgacttaattgaagaaaatgttaatgatgaaaacgacaatcaaaaaaatattaatgataaattaaatgaccgtattgtccaagaaacaaatgaaagtcgtcaaagtactgaagacgatgaggaatttccacttgatcatcggagtgaacaacaacctaaagcctctcgtcattctaaaaagcataaattactaagtaaatttacttctaaaaaagaaaaggaaacatctacatcgttcaatagtaatgagaaggtaactcaaattaaaccgcttagtttagaagaaaaaagagccataagacgtaaaaagcaaaaaagaatccaatataccattatcacactactcattcttatcattgttctcattttactctatatggttacaccactgagtaaaatatcaaatgtaaatgttaaaggtaataacaacgtaagtacgagtaaaataaagaaagaacttaacgttacttcgcgatcacgaatgtatacttttagtaaaaataaagcgattaggaacttaaaacagaatcctttaatcaaagaagttgatattcataaacaattaccaaacacgttaactgtcaacgtgactgagtaccaaattgtcggtttagaaaaaaataaagataaatatgtgccaattatagaagatggtaaagaattaacagaatacaaagatgaagtgtcacatgatgggcctatcattgatggtttcaaaggagacaaaaaaacacgaattataaaagctttatcagaaatgtcacctaaagtgagaaacttaattgcagaggtgagttacgcaccaactaaaaataaacaaagtcgcataaagatcttcaccaaagataatatgcaagttattggtgacattacaacgattgcagacaaaatgcaatattatcctcaaatgtcacaatcattaagcagagatgactctggcgaacttaagacaaatggctatattgatttatcggttggagcgtcatttattccttatcaaggttcatcaactgttcaatcgggtacagaacaaaatgtaaccaagtcaacacaagaagaaaatgatgcaaaagaagaacttcaaaatgtgttgaataaaataaataaacaatctaaagaaaataattaa

SEQ ID NO: 1828 - DNA, 1314 bp, Staphylococcus epidermidis
atcaacatggaaaatgagcaaatgtttgagcgtaccgttcagccagttcttgatgtaaaagataaaccaaaaccagcacaatgggcatttctgagtcttcaacatttatttgcaatgtttggatcaactgtacttgtaccatttttaacacatctgcctatatcagcagctttgttggcatcaggtattggtacacttttatacatattaatcacaaaagcgaaaattcctgcctacctaggatcgagttttgcctttattacacctatcattacagggttaagtacacatagtcttggagatatgctggttgcattatttatgagtggattaatgtacgtgattataggtattttcattaaattgagtggaacacattggttaatgcacttgttaccaccagtagttgtcggaccagtaataatggtcattgggttaagtttagctcctacagcagtaaacatggccatgttcgaaaattctgctgaaatgaaagggtataacttaagttacttaattgttgctttgattacattagcagtaaccatcatcgtccaaggattcttcaaaggatttttatcactaatacctgtacttataggtattatagtgggatatattgtatccattttcatgggcatagttaaatttgctccaatagcacaagcgaaatggatagattttcctcatatttatctaccatttaaagattacacaccatcttttcatttaggactcattctcgtgatgatacccgtggtgtttgtgacggtaagtgaacatattggtcatcaaatggtaattaataaaatagtaggacgcaatttctttgaaaatccaggtttagataaatcaatcattggtgatggtgtttcaactatgtttgcaagtatgataggaggtcctcctagtacaacttatggtgaaaatataggtgtactagcgatcaccaaaatatatagtatttacgttattggtggtgcggcagttatagctatcattcttgcatttattggtaagttcactgctttaatatcttcaatacctacgccagtgatgggtggtgtctcaattttattattcggtattatagcagctagtggtttaagaatgcttgttgaaagtcaagtagatttcgcaagcaatcgcaacttggttatagcatcagttgtgcttgttgtcgggattggtaatcttcttatcaatttaaaaggcataggtatcaatttacaaattgaaggaatggcattatcagcactttcaggaataatattaaatttaattttgccaaaagataaaaaccaaataaattaa

SEQ ID NO: 1829 - DNA, 240 bp, Staphylococcus epidermidis
agcgacgtggaaaacttcgataaagtaaaagacatcatcgttgatcgtttaggcgtagatgctgataaggtaacagaagacgcatcattcaaagatgatttaggcgctgactcacttgatatcgctgaattagtaatggaattagaagacgaatttggtactgaaattcctgatgaagaagcagaaaaaatcaacactgttggtgatgctgttaaatacatcaacagccttgaaaaataa

SEQ ID NO: 1830 - DNA, 504 bp, Staphylococcus epidermidis
aaatttagggagtgggcatttatgattcaaataaaaggagcagtcaatttccctatttcattggatagtacgacttggatatttgacgatagaaaagttactattgatgatttagaacgtggggtatttgatggtactagacccatcaactttgatgataacaaggaatggaaccgtgctattttagaaggacaaacaaatccaccaacgcttgattctgaaattaaatataaaaaacgatcggttttagatgaaacatttgtgataaatatgacaccatttttcaaaaacgccgaacctatggaaaatgctagcacaataaaactttctaataaagattattccatcaatgtacccatggacttattaccttatttgttctttcaattttctagtaatggcaaacgtttatatagtgataatgctgttgatagtttcatatatattcctgaagaaggatactctcatcaatttaagtatgtcacacatatagaggtgatttaa

SEQ ID NO: 1831 - DNA, 153 bp, Staphylococcus epidermidis
tattatctacttttaatcagaaaaagcttcaaaaaagaaagcttagcatacctagagatactatcagttatataccctaaagttggctattacgataaaataacacatgcgcatgcatatggtggaccctcttgctgctattgcactcggtga

SEQ ID NO: 1832 - DNA, 153 bp, Staphylococcus epidermidis
tttactatactaatagaaacttcaatactcatcttcataaatgatatgtctagatatgtgaatgataaaattgaaacaattatagatactgaatttaatgaaattgaatatcattgtgatgcaatctattatatcatcgtaaaatattgttaa

SEQ ID NO: 1833 - DNA, 366 bp, Staphylococcus epidermidis
ctaggagtactaacaatgaacaaatttataaaatattttttaatattattatcttttggtctcctcgttgttccaattatttttgctactcaattatatcaaagttcagaatcggcatttgagtcatctcaaaacactaaagattctcaacgaaagtctactttaagagattcaaaagttgatcctgaaaaacaacctatatcaattttattcttaggtatagacgataatgaaggtagagaaaaaaacgggcaaagtgtagaacattctaggtcagatgctatgatattatctacttttaatcagaaaaagcttcaaaaaagaaagcttagcatacctagagatactatcagttatataccctaa

SEQ ID NO: 1834 - DNA, 147 bp, Staphylococcus epidermidis
tacacaccactgattagtttaacgattcgaccagtcttcaaaaagacacctctcatttatattttcttaatcatattatatcaaaatactagtacttataatataacaactcaattcaagctcaatgatctacctacaaatatatag

SEQ ID NO: 1835 - DNA, 519 bp, Staphylococcus epidermidis
cagatactttgttacttgaaaaaggagaataatatgagtaagacaagagcagttattcccggtagttttgatccaattacatatggtcacttagatatcattgaaagaagcgccgaccgctttgatgaaatccatgtttgtgtactaaaaaatagtagtaaaggtggaacgtttgactcagaagaacgcatgacgttgattgaagagtcggttaaacatttgcctaatatacaagtgcatcattttaatggattgcttgttgatttttgtgatcaagtaggtgcaaagacaattattcgaggtttaagagctgtaagtgactttgaatatgaactacgacttacttctatgaacaaaaagttaaatagtaatattgaaacaatgtacatgatgacaagtgcaaactattcatttataagttcaagtattgttaaagaagtagctgcatatcaagcggacatttcaccttttgtaccacctcatgtcgaaagagcattaaaaaagaaatttaatgtttaa

SEQ ID NO: 1836 - DNA, 207 bp, Staphylococcus epidermidis
aggcaactttggctaagcaaaagcatatccctcgtaaaaagagagcggaatagaattcataatgaattcattatcccaccatctcgcaatatgaccttaaatagagaatctaataaaattttcataacagaaactcagacccttaaacgttttattttaagtacatttcagggtagtcaatctactgcgaagagatttaatggctaa

SEQ ID NO: 1837 - DNA, 3465 bp, Staphylococcus epidermidis
ggagtgtcttggcttttgaaacaaataaagaaattacttgttgctaaccgtggtgaaatcgccattagaatttttagagcggcagcagaattaaatatcagtacagtagcaatttattctaatgaagataaaagttcgttacatagatataaagcagatgaatcctatctagttggaagtgatttaggacctgctgaaagttatttgaatatcgaacgtatcatcgaagtagctcttcgcgcaggtgtcgatgcaattcatcctgggtatggttttttaagtgaaaatgaacaatttgcacgccgatgtgctgaggaaggcattaaatttataggtccgcatcttgaacatctagacatgtttggagataaggttaaggctagaacaactgctattaacgctaacttacctgtaatcccgggtacagatggtcctattgaaagttttgaagctgcagaacagtttgctaatgaagcaggttacccacttatgattaaggccacaagcggtggcggtggtaaaggtatgcgaatcgttcgtgaatcaagcgaattagaagacgctttccatcgtgcgaaatcagaagccgaaaagtcatttggtaatagcgaagtttatatcgaaagatatattgataatccaaagcatatagaggttcaagttattggtgatgaattcgggaatatcattcatttgtatgaaagagattgctccgtacaacgacgtcatcaaaaggttgttgaagttgcaccttcagtaggtctttctaacaaattaagagagcgaatttgtgatgccgcaattcaactgatggaaaatataaaatacgtcaacgctggaacagtagaatttttagtttctggggatgaatttttcttcattgaggttaatccacgtgttcaagttgagcatacaattactgaaatgattactggtatagacattgtgaaaacgcaaattttagttgctaatggagaatcgttatttggagataaaatctctatgccacagcaaaatgaaattcaaacattagggtatgcgatacaatgtcgtataacaactgaagatcctactaatgattttatgccagattctggcacaattattgcatatcgatcaagtggcggttttggtgtgagacttgatgcaggggatggattccaaggtgcagaaatttcaccttactacgattcactattagttaagctttctacacatgccgtttcatttaaacaagctgaagagaaaatggaacgttcattacgcgaaatgcgaattcgtggcgtaaagacgaatattccatttctcatcaatgttatgcgtaatgataaatttagaagtggtgattatactactaaatttattgaagaaacacctgaacttttcgatattgcaccgacattggacagaggtaccaagactttagagtatattggtaatgtgacgataaacggatttcctaatgtagaaaagcgtccaaaaccagaatatgaatctaccaaaatcccaaaaatttctcaaaagaaaatcaatcagttatttggaacaaaacaaattcttgagcaacatggaccaacaggtgttacaaattgggttagagaacaagaagatgttttaattaccgatactacatttagagatgcacaccaatctttacttgcaacacgtgtaagaacaaaagatatgatgaacattgcatctaaaactgctgaagtttttaaagatagtttttcattagaaatgtggggtggtgcaacatttgatgtcgcctataatttcttgaaagagaatccatgggaacgtttagaaagattgcgcaaagccattccgaatgtgttattccaaatgttattacgagcttcgaacgcagtaggttataaaaactatcctgataatgtaattaagaaattcgttcatgaaagtgcaaaagctggtgtagatgttttccgtatattcgactcattgaactgggttgatcaaatgaaagtagcgaatgaagctgttcaagaagctggaatggtatctgagggtacaatttgctatacaggtgatattttaaatgctgaacgttccaatatttatactttagattattacgttaaaatggctaaagaactggaaagagaaggattccatatattagcaattaaagatatggctggtttattgaaaccgaaagcagcttacgaattaattggtgaattacgtgaggcaacacatcttccaattcatttacatacacatgatactagtggaaatggattgttgacatataaacaagcaattgatgctggcgtagatattatagatactgctgttgcatctatgagtggtttaacgagtcaaccaagtgcaaattcattatattatgcactaaatggatttccacgtaatttaagaactgatattgatgggttagaagagttgagtcattactggtctgtagtcagaccttactatgcagactttgagagtgatatcaaatcaccaaatacagaaatttatcaacatgaaatgccaggtggccaatattcaaacttaagtcaacaagctaaaagtttaggattgggcgaacgttttgatgaagtcaaagagatgtatcgtcgtgtcaacttcctgtttggagatcttgtaaaagtaacaccatcttcaaaggtagttggagatatggcactatatatggtgcaaaatgatcttgatgaagatacggtcatcaatgatggttataaattagatttcccagaatctgttgtgtcattctttaaaggtgacattggacaacctgtcaacggattcaacaagaaattgcaagatgttattttaaaaggacagcaaccaattactgaaagaccaggtgaatacttggagccggtcgattttgaagcaatccgtcaagaattaagcgacatacaacaagacgaggtaacagaacaagatataattagttatgtactttatccgaaggtatataaacaatatattcaaacgaaagagcaatttggtaatgtatctttactggatacaccgacattcttatttggcatgcgtaatggtgaaacagttgaaattgaaattgatactggtaaacgtctaattattaaattagaaacaatcagtgaaccagatgaaaatggtaagcgtacaatttattacgctatgaatggtcaagcaagacgtatctatattcaagatgaaaatgttaaaacgaatgctaatgttaaacctaaggcggataaatcaaatccaaatcatattggtgctcaaatgcctggttctgtaactgaagtcaaagtgtctgtaggcgatgaagttcaagctaatcagccattattaatcactgaagcaatgaagatggaaacgacgattcaggcaccatttgatggaattattaaacaaatcaatgttgctaatggagatgccattgccacaggagatttattagtggaaattgaaaagcaatcataa

SEQ ID NO: 1838 - DNA, 129 bp, Staphylococcus epidermidis
gccaacacttgtagaatttatcattacaagtgttggctcagtttagttgatatatattattgttacgacattatggattccatattaagatgtcgtgcccctcaggatttttggtttctacatctttaa

SEQ ID NO: 1839 - DNA, 234 bp, Staphylococcus epidermidis
ctagccaattgtttttggtttaggttcagaaagtttcttaaagtaatatttctatattccaatcaaaaaatacagattatgtgtagacatatagaactacttttaacaatattttacgatgatataatagattgcatcacaatgatattcaatttcattaaattcagtatctataattgtttcaattttatcattcacatatctagacatatcatttatgaagatgagtattga

SEQ ID NO: 1840 - DNA, 1353 bp, Staphylococcus epidermidis
ttatttaagtggtgtacaagagtcgttagttgggaaagttctattatgatgaaatcagtgcgaacatatgcattagaaacaatcaacgacgtcctaaataaaggtgcttatagtaatttgaaaattaatgaagttctatctacaaataacattaatacagtagataaaaatttgttcacagaattagtatatggaacaataaaaagaaaatacacgttagattatctactaaagccttttatcaaaactaaaatcaaatcatgggtgcgacaattactgtggatgagtttatatcaatatttatatttagataaaatacctaaccatgctattattcatgaagcggtagatatagcaaagaaacgtggtggctttcacacagggaatatagtcaatggtatattacgaacagtaatgcgcactgaattgccaagctttgaagatatagatgatactaaaaaaagaattgcaattcaatatagtcttcccaaatggattgttgatcattgggttacacattttggagtagaaaaaactgaaaacattgcacgatcttttttagagcctgtaaccacaaccgtgcgcgccaatatatctcgtgattctattgattcaattatctctaagttagaacaggaaggttaccacgttaaaaaagacgatatgttaccattttgtcttcatatatcaggtatgcctgtggttaattcaaacgcttttaaagaaggttatatctctattcaagataaaagttcaatgatggtagcttatgtaatgaacctagggcgagatgacaaagttttagatgcgtgcagcgcacctggtggtaaagcttgtcatatggcagaaattctttcaccagaaggtcacgtcgatgcaacagatattcatgaacataaaataaatcttataaagcaaaatattaaaaaattgaaattgaataatatcaaggcttttcaacatgatgctacagaagtatacgataaaatgtatgataagattcttgttgatgcaccatgtagtggattaggtgttcttagacacaaacctgaaattaaatatagtcaatcacaaaatagcattaagtctttagtagaattacaattacaaattttagaaaatgttaaagataatattaaacctggtggtacaatagtgtattcaacatgtacaatagaacaaatggaaaacgaaaatgtcatctatacttttttaaagagacataaagattttgagtttgaaccattccaaaatccagcgactggtgaacaggttaaaacgttacagatacttccacaagattttaattcggatggattctttattagcaagataaaaagaaaggaaagttag

SEQ ID NO: 1841 - DNA, 1152 bp, Staphylococcus epidermidis
tcgcaaaagtggaggaaatgcaaaatgaacttcagtaaacttaaatttggcgcgacaataggaatcattggcggagggcagttaggaaaaatgatggctcagtctgcacaaaaaatgggttataaggtgattgtcctagatcctaatgaagactgtccttgtcgttatgtcgcacatcagtttattcatgcaaattatgatgatgagcaagctttaaatcagttaggtgaaaattctgatgttgttacttatgagtttgaaaatatttcgtctgaacaattaaaaaaactcactcagttatatcatattccccaagggtaccaagctattgaactattacaagataggctaaccgagaagcaaacattactagaagcaaatactcaaattgttccttttgtacaaattcacacaaatcaagacttattaaaagccatagaaaaattaggctttccgtgcatagtgaaaacacgttttggtggatatgatggtaaaggacaaattttggtaagaaatgattcggaattagacgaagcataccagctagttgagaagcaagaatgtgttgctgaacaatatcttgatattcaaaaggaagtatctcttacagtaacaattggaaatgaacaacaaacaacatactttcctcttcaagaaaatgaacatcaaaatcaaatattatttaaaacagtcgttccagcaagatctgataaagaaaatgaagcacgtaaggaagttgagaaaatcactcgcgcaattcattttgtgggaacctttacagtagaattctttattgataaagaaaataacttatatgtaaatgaaattgcaccaagaccacataattctggacactattctatagaagcttgtgattattcacagtttgatacacatattttagccataactggtcaaaaacttccgcaagctattgaattattaaagccaacagtaatgatgaatttattaggtcgcgatttggatttacttgaaaatgaatttagcagacatccagattggcatattcacatttacggtaagaaagaaagaaaacctgatagaaaaatgggacacatgactttactgacggatgatgtcaatcaaacagaacaatatatgttaatgaaatttgaagggagagacaagtaa

SEQ ID NO: 1842 - DNA, 2007 bp, Staphylococcus epidermidis
tcatggaggtggacattaatgaattttccatgggatcaactactagttaaaggaaattggatgattatctcagcacaaattgctgcgccattcttagtcatcggccttatagcagttatatcttatttcaaattatggaaatatctatataaagaatggttcacatccgtagaccataaaaaaatcggtatcatgtatttaatttctgccgtattaatgttcgttcgtggtggtatcgatgcgttaatgttacgtactcaattaacaattccagataacaaattcttggaagcaaaccactataatgaagtatttactacgcacggcgtaattatgattatatttatggctatgccatttatctttggtttatggaatgttgttattccattacaacttggtgcacgcgatgttgccttccctgtaatgaataacgttagtttctggctattcttcgctggtatgattttattcaacctatcatttattgtaggtggatcaccagctgctggttggactaactacgcaccacttgctggtgaattcagtccaggtccaggtgttaactattatttaattgcaattcaaatatctggtatcggatcgttaatgactggtatcaacttctttgttacgattctaagatgtaaaactccaacaatgaagtttatgcaaatgccaatgttcagtgtaacaacattcattacaacattaatcgttatattagcattcccagtgttcactgtagcacttgctttaatgactgctgatagaatttttggaactcagttcttcactgtagcaaatggcggtatgccaatgctttgggcaaacttcttctgggtatgggggcaccctgaagtttatatcgttattttgccagcattcggtatgtactcagaaatcatccctacttttgcccgtaaacgtttattcggtcatcaaagtatgatttgggcaactgcaggtatcgcattcttaagtttcttagtttgggttcaccatttcttcactatgggtaatggtgcgttaattaactcattcttctctatctcaacaatgttaatcggtgttccaaccggagttaaactatttaactggttgctcacattatacaaaggtagaattacatttgagtcacctatgctattctcattagcattcatccctaacttcttattaggaggggttactggtgtaatgcttgcaatggcatcagctgactatcaatatcacaacacttatttcttagtagctcacttccactatacattggttactggtgtagtatttgcctgcttagctggtttaatcttctggtatccaaaaatgatgggctacaagttaaatgaaacattaaacaaatggtgcttctggttcttcatgatcggatttaacgtttgtttcttaccacaattcattctaggtttagatggtatgccacgtcgtctatacacttacatgccttctgatggttggtggttactaaacttcatctcaactatcggtgcagtattgatggcaattggattcttattcctagttgcaagtatcgtttatagtcatatcaaagctccacgtgaagctactggagataactgggatggacttggtcgtactttagaatggtctacagcatcagctattccacctaaatacaactttgctatcactcctgattggaatgactacgatacattcgttgatatgaaagaacatggtcgtcattatttagacaaccataactacaaagatattcatatgccaaacaatactccagtaggattctggatgggtatatttatgactattggtggtttcttcttaatcttcgaatctattgttccagcacttatctgtttagcaggtatcttcattactatgatttggagaagtttccaaattgatcatggttaccacatccctgcttcagaagttgcagaaactgaagctcgtttaagagaagctcgaattaaagaaagggaggctgtaagtcatgagtcatga

SEQ ID NO: 1843 - DNA, 171 bp, Staphylococcus epidermidis
aaactacttcgtatagaaataagaattaaagctattgatccgggtactaataaaactgttcctaagtatttagcagaatcaggaaaaaaacctataaatcctacaaaaaagaaaacgaaaaagacatttgtaacttcccaaactggattgaggtatctatggattaaatga

SEQ ID NO: 1844 - DNA, 1701 bp, Staphylococcus epidermidis
tgtggagaacgccgaataatgaaacaactacattcaaatgaagtaggtgtatatgcacttggtggtttaggtgaagttggaaaaaatacctatgctgttgagtacaaagatgaaattgtaatcattgatgctggaatcaaattccctgacgataatctgttaggaattgattatgtaattcctgattacacttacttagaacagaaccaagataaaattgtcggtctgtttattactcatggacacgaagaccatataggtggtgtgcccttcctattaaaacaaattaatgtacctatttacggtggtccattagcattaggtctcattcgcaataaactagaagaacatcatttgcttagaacgactgaattacatgaaatagatgaaagtagcgtaattaagtctaaacattttgaaatttctttctatctaaccacacatagtattccagaagcatatggcgttatagtcgatacacctgaaggtaaaattgttcatacgggagacttcaaatttgactttactcctgtaggtgagcctgctaacatagctaaaatggctcaattaggtcatgaaggtgtgttgtgcttactatcagactcaacaaacgcactagttccagattttactttaagtgaacgtgaagttggacagaatgtcgataaaattttcagaaattgtaaaggtcgtattatctttgcaacttttgcttctaatatttatcgtgttcagcaagcagttgaagcagcaattaaatataatcgtaaaatcgttacatttggacgttcaatggaaaacaatatcaaaattggtatggaactaggatatatcaaagcgccaccagaaacgtttatagaacctaataaaataaatagtgtacctaaacacgagttactcattctttgtactggttctcaaggtgaacctatggctgcattatcaagaattgcaaatggtacacataagcaaataaaaattataccggaagacactgtagtatttagttcttcgcctattccaggtaacactaagagtatcaatcgtacaattaatgcgttgtacaaagctggtgcagatgtgattcatagtaaaatttcaaacattcacacttctggacacggttctcaaggtgatcaacaattaatgttacgtctgattcaacctaaatacttcctgccaattcacggtgaatatcgtatgcttaaagctcatggtgagactggtgttcaatgcggtgttgatgaagataatgtatttattttcgatatcggtgatgtacttgctttaacacatgattctgcacgaaaagcaggaagaattccttccggcaatgtacttgttgatggcagtggtataggtgatattggcaatgttgtcatcagagatcgtaaattactttcagaagaagggttagttattgttgttgtgagcattgactttaatactaacaaattactatctggccctgatattatttcacgcggttttgtttatatgcgggaatctggtcaattaatttatgatgctcaacgtaaaattaaaggcgatgtcatttctaaacttaacagcaataaagatattcaatggcatcaaattaaatcttcaattatcgaaacattacatccttatctttatgaaaaaacagctcgaaaacctatgattttacctgtgataatgaaagtaaatgaagataaataa

SEQ ID NO: 1845 - DNA, 177 bp, Staphylococcus epidermidis
gataagtggcgtgtttcaatatatttaagtataaatagaccatctaaatatcatattaatctagatggtcattttaattatgattgcttttcaatttccactaataaatctcctgtggcaatggcatctccattagcaacattgatttgtttaataattccatcaaatggtgcctga

SEQ ID NO: 1846 - DNA, 1401 bp, Staphylococcus epidermidis
cctaatattttatttaggttaatatattctcatatattaatgggggtgattttattgaattccaataataacaatcatgaacaacaacgaagtttagatgaaatcaataacaccataaacttcaatcataatgatagtgcaagtcaaaaatttctggcttttttaggaccgggattgcttgttgcagttggttacatggatcctggaaattggattacatccatgcaaggaggagcacaatatggctataccttgttattcataatcttaatctctagcttatctgctatgctgttacaaagtatgactgtgagattaggaatagcaactggtatggatttagcacaaatgacacgtcattttttaaataagcctgtagcaattatgttctggattattgcagaattagcaattatcgctactgatattgcagaagttataggcagcgctatcgcattagatttaatcttcggcataccattaattgtaggcgcattaatcactgtatttgatgtatttttattattattcatcatgaaatttggctttagaaagattgaagctatcgtgggaacattaatctttaccgtattggccatttttgtatttgaagtttatatttcttctccacatataatagatatgcttaatggttttgtgcctcataaagaaattattacaaaccaagggatactttatattgcactaggcatcataggtgctactattatgccacataacttatatttacattcttctattgtacaatctcgaaaatatgatagacacagtattcatgaaaaagcacaagcgattaagtatgctaccatagactctaatatacagctatccatcgcttttgtagtcaattgcttattacttacacttggtgcagcactattttttggaactaaaactgaagatttgggtggtttttatgatctttatttggctctaaaaacagaacctgctttaggtgcaacgcttggcggtattatgagtactttatttgctgttgcccttttagcttctggtcaaaattcaactataacaggaacgttagcaggccaaattgtgatggaaggatttcttaaattatccattccaaactggttacgtcgtcttatcactcggtctttagcagtgatacctgttatcatttgtcttatagtatttaaaggaaatactgaaaaaattgaacaattacttgtcttttctcaagtgttcttgagtattgctttgccattttcgttaataccgcttcaattagctacaagtaatcaaaatcttatgggtccttttaagaataagacatggattaacatcatttcttggttactcataattgtcttaagtggacttaacgtatatcttatcattcaaacattccaagaattatga

SEQ ID NO: 1847 - DNA, 234 bp, Staphylococcus epidermidis
gttgataagcttggggctatattaacaattattaaaaattatcaatatagattaaagctttatatgataatcaatcatagattatcatatttttataattataatgattttttatttttcattagtttatacgcttgttctgctgccttttgttcggattctttctttgtctttcctttaccctctgcaactgctttattttctaaaatcacttccgatgtaaatagtctatga

SEQ ID NO: 1848 - DNA, 900 bp, Staphylococcus epidermidis
gtctgtattttgaaccagaagcaatacacatcatggtaccaggtgaaactgaagaagaatttgataagcgaattgaaagttatgaggactatcatcatgcataatatcaataaatggttactggttccttacttattatggatggttatatttattatcattccagtcattttacttgtttacttttcttttatagatattcatggtcactttagtttcacaaattatgagcaggtattttcaacaagatatttaaaaatgtttattgattcaatatggtatgccgctttaattactatgattaccttaataataagttacccagctgcgtactttatttcttattcaagatttcaaaatatactgcttatgttgttaattatccctacttggattaatttacttcttaagacctatgcatttattggtttgttggggcatgatggagttattaaccaagctctacatatatttcaaatacctaaattaaatttgttgtttacaagtggtgcatttttattggtggcgagttatatttatatcccatttatgattttgcctatatttaacagcatgaaagcaattcctaacaatattttgcaagcctctaatgatttgggcgcgagtacatttactacgtttcgtaaagtaatcgttcctttaacaagagaaggtattaaaacaggtgtgcaagtaacatttataccagctctttcactgtttatgattactaggttgattgccgggaacaaagtaatcaatgtaggtacagcaattgaagaacagttcttaactatacaaaattatggattaggttccactatagcactttttctcattatttttatggcctttttactcattattacaaaatcaaaatcatctaatgggaaggggtga

SEQ ID NO: 1849 - DNA, 168 bp, Staphylococcus epidermidis
ttggaatatagaaatattactttaagaaactttctgaacctaaaccaaaaacaattggctagttatagaaggaatatgatttgtattaaaggaacttatataagtaagatagtatatcaacaagcttattatagtttgaaaattataaaagagacaatttctatatga

SEQ ID NO: 1850 - DNA, 303 bp, Staphylococcus epidermidis
aaagttttcagaaccaaaaacaaaaagcatctacagtcaagaaaaattgatgtggagcctgtttttggatttatgaaggctattttgggttttactcgaatgtccgttcgagggataaataaagtcaaaagagaactaggatttgtgctaatggcacttaatataagaaaagtaacagctcaacgagctgaaaataatcaaaaaaataataaaaaagacaatttctatataatttcaatagaaattgtcttttttatttatcttggaactttaagtcccacactctttatttatgtgagatag

SEQ ID NO: 1851 - DNA, 129 bp, Staphylococcus epidermidis
gtacatttcagggtagtcaatctactgcgaagagatttaatggctaaaactagtcatttatatttcagattcattgacgacttatttataattattatacacaaattaatcattaaattaaaaaagtga

SEQ ID NO: 1852 - DNA, 1776 bp, Staphylococcus epidermidis
catgaggtcaggacaaattcgaacgttaatgttatgtcctggtcttctttttatggagtgatattgatgacaaaaaaagatgtaattcaattattagaaaaaatagctatatatatggagctaaaaggagaaaatacatttaaagtttcagcgtatagaaaagccgcacaaagtttagaggttgatgagcgtacattagaagagattgatgatgtaacagaacttaaaggcattggaaaaggcgtaggagaagttattaatgaatttaaaacacaaggtcaatcatcgacccttcaaacacttcaagatgaagtacctgaagggttagtgccacttttgaaaatacagggattaggcagtaaaaaaatagcaaaactatatcatgaacttcaaattacagataaagaaacacttcaacaagcctgtgaagaaggtaaggttagtactttaaaaggttttgcaaaaaagacagagcaaaacattttagaagcagtgaagtcgataggtgctaaaaaagatcgttatcctatagagctaatgagaggactcaaccaagaaattgtaaaatttattgaacagttagaaggagttgaacaatattcaactgctggtagttttcgaagatataaggaaatgagtaaagatttagatttcattattagtacatcggagcctaaaaaagttcaacaacaattacttcgtattccgaataaagtcaaagatgttgctgttggggatactaaaatttctctggaattagcttatgatgatgagacgattggcgttgattttagattgatagaacctgctgccttttaccataccttacaacacttcaccggttcgaaggatcataatattagaataagacaattagcaaaagcacgcgacgaaaaggttagtgagtatggtatcgaacaacaagatggtaagctattacaattacaaagtgaagaagcgatctatcatcattttggtgtagattggattgcgcctgccatgcgtgaagatggtagtgagtttgataaagatctgagtcaaatcattcaattagatgatatcaatggagatttgcatatgcacacaacatatagtgatggtgccttttcgattaaagaaatgattgaggcaaatattgaaaaaggttatgaatttatggtcattacagatcactcacaaagtttaaaagtagctcatggattacaagtcgaccgtctgctaagacaaaatgaagaaataaagcaattaaatgaagaatataaagaaatagacatatattcaggaacggaaatggacattttacctgatggaacattagattacgatgatgaagttttggcacagcttgattatgttatcgcagctattcatcaaaactttaatcaatctgaagacgaaatcatgaaacgtttagaaacagcatgtagaaatccatatgtgcgtcacattgctcatccaaccggtcgtattattggacgtagaaaaggttataaagctaatattgaaaagttaatgaatttagccgaagaaacaaatacaattttagagattaacgcaaatccgcatcgtttagatttaaatgcagaaatcgttcgtaaatatccaaaggttaagttgacaattaatacggatgctcatcatacaaatcatcttgatttcatgaaatatggtgttgctactgcacaaaaaggatttgtcaataaagagagggtcattaatacaatgacgaaggaagcctttcgctcatttgttgaaacgaataaatataagaaatag

SEQ ID NO: 1853 - DNA, 1722 bp, Staphylococcus epidermidis
aaaagtataaggtggcagataattatggcatatgatggcttatttactaaaaaaatgattgaatcattacaaggtttagtctcaggccgaattcataaaataaatcaaccagaaaatgacacaataattattgtaataagacaaaatcgtaaaaatcatcaactacttctatcgattcaccctagtttctctcgtttacaattaaccactaaaaaatacgacaatccatttaccccaccaatgtttgcaagagttttccgtaaacaccttgagggaggctttataaaagcaattcgacaggttggtaacgatagacgtatagagattgatatcgaaagtaaagatgaaattggtgatacaatatatagaactatcatattggaaataatgggtaaacatagtaaccttatccttgtcgatgatcaacgtaaaatcatcgaagggtttaaacatctaactcctaacacaaatcagtacagaaccgttatgcctggcttcaaatatgaagcaccaccaaatcaaaataaaatcaatccttatgaattaacaggacaagaggtattaaaatatatagactttaatgctggaaagattgccaaacaattacttaatatatgtgagggctttagtccgctaatcgctaatgaaattgtgaatcgtcgtcaatttatgactcaagaaacattacctgatgcttttgatgaagtcatggccgaaacaaaatcagcacctacccctgtctttcataaaaatcatgaaacaggtaaagaggacttctatttcatgaaacttaatcaattctatgatgatatagttgagtatcattcacttcatgaactattggatcgcttttatgatgcacgtggagagagagaaagagtcaaacaacgtgcaaatgatttagtcagatttgtacaacagcaactgcaaaaacaacaaaataaattgagtaaacttatcgatgagtatgaaagtgctaaaaacaaagaaactcagcaattatatggagagttgattacagctaatatatatcgtattcaacaaggtgacgattctgttatagcgttgaattactatactggtgaagaagtaaagattccacttaaccctacaaaatcgccatcaactaacgctcaatattattataaacaatataaccgtatgaaaacacgggagcacgaattgactcatcagattaaacttactaaagagaatattgattactttgataatattgaacaacagttaaagcacattaccgttgatgatatcgatgatattcgcgatgaacttgctgaacagggattcatgaagcaaagaaaacaaagtaaaaagaaaaaacagtctaaaattcaacttcaaacgtatcattctactgatggagatacgatattagtaggtaaaaataataaacaaaatgattatcttaccaataaaaaggcacgtaaaaatcatttatggtttcatacaaaggatattccaggatctcatgttgtcatactcaatgagagtccaagcgaaacaacgattaaagaagcggcaatgctagctgggtacttctctaaagctgggagttcagctcagattcctgtagattatacagaaattagacacgttcataaaccttctggagcaaaacctggattcgtgacatatgacaaccaaaagaccctatttgcaacacctgattatgatcatattcaacaaatgaaagaatcataa

SEQ ID NO: 1854 - DNA, 159 bp, Staphylococcus epidermidis
ctttcaacaagcattcttaaaccactagctgctataataccgaataataaaattgagacaccacccatcactggcgtaggtattgaagatattaaagcagtgaacttaccaataaatgcaagaatgatagctataactgccgcaccaccaataacgtaa

SEQ ID NO: 1855 - DNA, 513 bp, Staphylococcus epidermidis
caatccaaaagtttcgaaagggtgtacaaagtgaaagtagcagtcattatgggcagttcctcagattggaaaattatgaaagaaagttgttcgatgcttgaagaatttgaaataccgtacgaaaagaaagtcgtttcagctcatcgtacgcctcaaatgatgttcaatttcgctagtcaagcacgccaaaatggttttgatattatcattgccggtgcagggggagcagcacacttacctggaatggtagcttccatgacaacattacctgtgattggtgtgccaattgaatctaaaagtctaaaaggattagattcattactatctatcgtccaaatgcctggtggtatcccagttgcaaccacagcaattggaaaatcaggtgctaaaaatgctgggatattagcggcaagaatgttaggaataacaaatgaatcagttcaaaataatttggaaaattatgaaaaatctttagtcgcaaaagtggaggaaatgcaaaatgaacttcagtaa

SEQ ID NO: 1856 - DNA, 162 bp, Staphylococcus epidermidis
tttaatatgagaaaggttcaatgtattatttgcgatactaaagtttttattgatgaacatacagtcgaggctaaacgcttaaaaaataatcctatacgcactttcatgtgcgatgattgtaaaagtagactcgatacacctaaacaaagcaaacgagattaa

SEQ ID NO: 1857 - DNA, 615 bp, Staphylococcus epidermidis
gagaataggagtgagccccccttggctttaaaggatttatttaataatttttttgtagttgaagaagaagaggaagttgaaggacctgaagaacgtgaatcttctagatcacgtgaacgtgttcaagaacgcgaagattacaatcgtaatgagaatcaagcgacaccacaaacttttaacaataagcaacaagcgattaagtctgtacctcaaaagaacactttgagatcgaatacaacttctgaagaaaggaattatcgtatgaataataattcaaaaaataattctagaaacgttgtaacaatgaaccaagcatcacaatcatatgctgctcaggaaagttcaaaaatgtgtctgtttgaaccacgtgtcttttcagatactcaagatattgccgacgaattaaaaaacagacgtgcaactttagtaaatttacaacgcattgatcaagtatcagcaaagcgtattattgattttttaagtggtacggtatacgcaattggtggagatattcaacgcgtgggtactgatattttcttatgcacacctgataatgttgaagtagccggcagtataactgatcacatcgagaatatggagcaacactacgaataa

SEQ ID NO: 1858 - DNA, 1416 bp, Staphylococcus epidermidis
tttgtcaggaggtgcctatctatggaggaacattactatgtgagcatagatataggttcatcaagcgtaaaaacaatagtaggcgaaaaatttcacaacggaattaatgtgataggtacagggcaaacctacacaagtggtatcaagaatggtttaattgatgattttgatattgcaagacaagcaattaaagatacaattaagaaggcttcaattgcctctggtgtagatataaaagatgtatttttaaaactacctatcatcggtaccgaagtatatgatgaatcaaatgaaattgaattttatgaggatactgaaattgatggcacgcatattgaatcagttttagaaggtatccgggataaaaatgatgtgcctgaaactgaagtgataaatgtattcccaattcgttttgtagttgacaaagacaatgaagtttcagatcctaaagaattaattgcaagacattcattaaaagtagatgcaggtgtcatcgcaatccaaaaatctattttaatcaatatgattaaatgtgttgaggcatgtggtgttgacgtgttagatgtttattctgatgcgtacaattatggttctattctcacaccaacggagaaagaattaggcgcttgtgttattgatatcggtgaagacttaacgcaagttgctttctatgaacgaggagaacttgtagatgctgaatctatagaaatggccggtcgagacattacggatgatattgctcaaggactaaatactacatatgacacagctgaaaaggtaaaacatcaatatggtcatgcattttatgactctgcttcagatcaagatgtcttttcagtagatcaagttgattcagatgaacatgttcaatatactcaaaaagatttaagtgactttattgaacaaagagtcgaagatatattcttcgaagtctttgacgttttacaagagctaggacttacaaaagtaaacggaggatttgtagttactggtggatctgcaaatttactaggtgtaaaagaattactacaagatatggttagtgaaaaagtgagaattcatacaccgtcacaaatgggtatcagaaaaccagaattttcttcggctatttctacgatttctagtagtatcgcttttgacgagttattagattatgttacaattagttatcaagataatgaagaatttgaagaagaagttatcgaaactgataaagatactgaaacaaaatcaagcggttttgattggtttaagcgtaaatcaaacaaaaaagaaaatgacgaggtagcaccagaagcgcctcgtgaagagtcttatgaagaccgtgaaaatcatctagaagatgaacaacaaacagaaggcaaagccaaagaagaaagtaagtttaaaaaattaatgaaatctctatttgaatga

SEQ ID NO: 1859 - DNA, 336 bp, Staphylococcus epidermidis
aaattaaggaggattggcattatggcaatcgtaaaagtaactgattctgattttgatagcaaaattgaatctggtgttaaattagttgatttctgggcgacttggtgtggaccttgtaaaatgattgcaccagttttagaagaactagcaggagactatgatggtaaagctgacatcttaaaattagatgttgacgaaaacccatcaactgcagcgaaatatgaagtaatgagtatcccaactttaattgtatttaaagatggcgaaccagttgataaagttgtaggtttccaacttaaagaaaacttagcagaagtattagataaacatctataa

SEQ ID NO: 1860 - DNA, 225 bp, Staphylococcus epidermidis
atggtgaggaggcgtctaatggaacaaaataatgataataatcatctttacactttaataaaacattgtaatgagtttctttatagacgagatgattatagaattccatctgattctcaatcagaccattctaataatgagaatattttaaaaacaatgaatgatgaagtatttaaacattcaattgaaatttttaaacgtgccaagaaaaatttaaatcattaa

SEQ ID NO: 1861 - DNA, 150 bp, Staphylococcus epidermidis
atcaacgctggtcttttatgtaaaactttagggcattttgcatacaagtttctaagaattagcaatttaaattatatgtttcgcaggggggactctttttggctcaatcaaagaatgaattttaccttagaagattacattcgttattag

SEQ ID NO: 1862 - DNA, 165 bp, Staphylococcus epidermidis
  modified_base (8)..(8): a, c, g, t, unknown or other
ataatganttttcttaataaatctctctttcaaaatatttcaccacccaataatatatatacattccactatacacttaatttcaaattgaaatcttctaaaaataatctaaatattaagtgtccaattatgaaacaattatatatcatacttaaatttatttaa

SEQ ID NO: 1863 - DNA, 156 bp, Staphylococcus epidermidis
tatttagatggtctatttatacttaaatatattgaaacacgccacttatcttaccgttatggtattttgagtggcgtgtttctttttaattgttataaatttatagaaaaatatattattttagacttctcgtcgttcttaacattagtaaaataa

SEQ ID NO: 1864 - DNA, 1155 bp, Staphylococcus epidermidis
cgaatgttaggagagcaatatacacaaattaagcgtccagcaaatcggctaactgaaaaaatattaggttggtttagttgggtattcttactcatattaactattgtttcaatgtttattgcgctcgtatcttttagtaatgatacgtcaattgccaatttagaaaacacacttaataataatgaactcgtacaacaaattttagccaataatgatttaagtacaactcaatttgtgatttggttacaaaatggagtttgggcaattattgtttattttattgtttgtttgctcatctcgtttttagcgttaatttctatgaatataagaattttgtctggttttctttttttaatagctgctatagtcacaattccgcttgtattgttgattgtaactctaatcattcctatcttattctttatcattgcaatgatgatgtttgctagaagagatagaatagaaacagtgccatcttattataatgaatatgatcaaccatactatgatgagagaggtttttatgaaccagagtcaagaaatgaacatggatataatgatgatgtgtatgaacctatgcatactaaaaaggaagatagaaatacaagacgtcaattcaatagaaatgctcagcaacaagattcctataatggtataactgataatcaacccgatgaagatacatcttccgatcaactttattcagacgaatatgtagataatgaagataaatattctcaatttccaaaaagagcagttgaaagtgaatatgcatctcaacaaactgaagatgaaccaacagtcatgtcaagacaagctaagtacaataaaaaatctaaaaatacggattttgaagatgcgcaacaggaacatatggaaggtaatcaatttgatgacgtaggagttgttgaaccacaaattgatcctaaagaactaaaagcgcaaagaaaaagagaaaaagcagaaatacgtgctaagaaaaaagaaaagagaaaagcatataataaacgtatgaaagaacgaagaaaaaaccagccaagtgctgttaaccaacgacgtatgaattatgaagaacgtcgacaaatgattaataatgaacaagaagatacagataataacttaaatcaacaggaagattcaaaaaaagaaaattaa

SEQ ID NO: 1865 - DNA, 2007 bp, Staphylococcus epidermidis
agtatgataggtaaagtcataaatgaacgctatactattaccgataaactcggtggtggtgggatgagtattgtctacttagctgtagattcaatacttaacagaaaagttgctattaaagcgatttcgattcctccaagtgaaaaagaagagacatttaaacgttttgaaagagaagtacataattcttctcaactttctcatgagaatatagtcagtatgattgacgtagatgaggaagacgattgtttttatattgttatggaatacatagaaggtcctactttagcggaatatatacacagtcatggtccacttagtgtagaaactgctattcagtttacagaacaaattttgagtggaatcaaacatgcgcatgatatgagaattgttcatcgcgatattaaaccacagaatatattaattgataagaataaaaaattacaaatttttgattttggtattgctaaagcattgagtgaaacgtcgctgactcaaacaaatcatgttttaggaactgttcaatatttatcgcctgaacaggctaaaggcgaagctactgatgaaagtactgacatatattcaattggaattgtattatatgagatgttagttggagagccaccattcaatggagagactgcagtgagtattgctataaagcatattcaagatagtatcccaaatataacaacggataaaagagatgatgtacctcaatcattgagtaatgtcgttttacgtgctaccgagaaagataaatatcatcgctatcatactgttcaagaaatgtgtgacgatttaacaagtgctttacatgagaatcgtttgaatgaagaaaaatacgagctagataaaactaaaacggtaccactcactaaagatgatttgaatcataaaatctatgatgaacaaaatcaaaatgaccttaataaaaccatgcaaatacctattgttaacgattcaataaagcaacaagaatttcaatcgtctgaaccacgttattatcaaaaaagcgacaagaaacgttctaaaatgaaaattgcaattttatcaatcatttttgtaatattattaattggtttattttcttttgtagctatggctgtttttggaaataaatatgaagaaatgcctgaccttaaagggaaaactgaaaaacaagctgaaaaggtattagacagtcatcatctaaaagtaggtgacatatcaagaaattatagtgataaatatcctgaaaaccaaattattaaaacaaatccagatagtggagaacgcgtcgaacaagggaatagagttgatatcgttctatccaaaggaccagagaaggttaagatgccaaatgttttaggtatgtcgaaaaatgatgcgctaaaaaaattaaaggctatcggatttaaagatattcacgttgagcaagcttatagtcaaacatatgaaaaaggattaatttctgaacaaagcgttgtagctaatagtgaggttgccgttaataatcatcatattacaatttatgaatcattaggtgttcgacaagtatatgtcaataattatgaaaataagtcatatgagtcagcaaaaaaagaacttgaagataaaggatttaaagttcaagtgacaaaagaaaacaacgatgatgtcgaaaaaggtaatgtcatttctcaatctccaaaggataaaactgttgatgaaggttctactatactattagtggtttctaaaggagaaaagtctgaagaagatgatgatgaggaggacaaggatacaacgactaaaaatgagactgttaaagtaccgtataccggtaaaaaaagtaaaagtcaaaaagtagaagtatttattcgtgatattgaaaataaaggtgattcagcagttcaaacgtttaatattaaaagtgataaaacaattaatattcctttgaaaattaaaaaaggaagtgacgctgggtacaccataagagttgataataaaattgtagctgataaagatgtgagctatgatggctaa

SEQ ID NO: 1866 - DNA, 162 bp, Staphylococcus epidermidis
aaatggataggttgccaacaaaagacaactaaaaagagtgctactgctgctaaacttaatgatccatcgatagctacccaaccaattaatggtggtacagctccaggaaaacttccaacaacagtattccaagttgtatggcgcttagaccaaattgaatag

SEQ ID NO: 1867 - DNA, 288 bp, Staphylococcus epidermidis
ctgtacaaaggagagtttaatatggaacaaaaatcatatgtaatcacagacgaaacagggattcatgctcgccctgctacaatgctagtacaaactgcatcaaaatttgattcagatattcaattagaatataacgggaagaaagttaatttaaaatcaatcatgggtgtaatgagcttaggtgtaggtaaagatgctgaaataactatttatgctgacggtagcgatgaaactgacgcaattcaatctatcactgatgtcttatcaaaagaaggtttagctgaataa

SEQ ID NO: 1868 - DNA, 1248 bp, Staphylococcus epidermidis
ggttatgaaggaggaacaagcatgagtttttttaaacgtctgaaagataaattttctagtaaaagtgaagatgatattcaaaaagacctagatgaaactgtagattcaaatgctaatagtgactcagattcaatggacccgaatgattctgatgaacaagtcaaacccaaaaagaaacctaaaaaattaagtgaagctgattttgacgaagatggtttgatatcgattgaagattttgaagaaattgaagctcaaaaaattggagcaaaattcaaagccggtttggaaaaatcacgtcaaaacttccaagaacagttaaataatttaattgctcgatatagaaaagttgacgaagatttcttcgaagctctggaagaaatgcttattactgcggacgttggttttaataccgttatgaaattaactgatgagctacgtacagaagcacaaagacgtaatatacaagaaacagaagacttaagagaagttatagttgagaagattgtagaaatctatcatcaagaggacgattattctgaagcaatgaatattgaagatggacgtttaaatgtcatactgatggttggtgtgaatggtgtcggcaaaacaacaacaattggtaaattagcttatcgttatcaacaagaaggtaaaaaagtaatgttagccgctggtgataccttcagagctggagcaattcaacaattaaacgtctggggagaacgtgttggtgttgaagttgtgagtcaaaacgaaggttctgaccctgcagcagtagtatatgatgcgattaatgccgcaaaaaataaaggcgtagatattttaatttgtgatactgcaggacgcttgcaaaataaatctaatttaatgcaagagttagataaaatgaaacgtgtgattaatcgtgcaatacctgatgccccccatgaagctttattatgcttggatgcaacaactggtcaaaatgcactttcacaagcacgttcatttaaggaagttacaaatgtctcaggtatagttttaactaaattagacggtactgctaaagggggtattgtattagcaattcgaaatgagttacacattccagttaaatatgttggtttaggcgaaaaaatggatgacttacaaccgtttaatcctgaaagctatgtatatggattatttgctgatatgatagaacaaaatgaagatattcctgaagaaatctctagaaattcatccgttgaatctgaagaaggtaactaa

SEQ ID NO: 1869 - DNA, 1149 bp, Staphylococcus epidermidis
agaagtgaaggttttaatcgttgccacagcttcatatttataggaggaaactgtatgaatccattgctttcttttaaagatgtcagtaagggctttgaagatgtacaaatactaaatgaaattaatattgatattgaaccaggctatttttatacactattaggtccctcaggttgtggaaaaacaacaattttaaaactcatagcaggatttgaatatcccgatagtggagatattatatataaagataaacctattggtaaaatgccaccgaataagcgtaaggtaaatactgtattccaagactatgcattgtttccacatttaaatgtattcgacaatattgcatatggtttaaaattaaaaaaattaagtaagtcagaaattaagcgtaaggttactgaagcacttcagttggtgaaattaagtggttatgaacataggcaaatacaaggtatgagtggtggacaaaaacaacgtgtagccatagcacgggcaattgttaatgagcctgaaatattattattagatgagtctttatccgcattagatttaaaattacgaactgaaatgcaatatttattgagagaacttcaatcccgtttaggtataacctttatatttgtaactcatgatcaagaagaggccttagcattaagtgattatatttttgttatgaaagatggcaaaattcaacaatttggcacaccaatagatatatacgatgaaccagttaaccgatttgttgctgattttataggagagtccaacatagttcacggtacaatggttgaagattttgtcgttaatatttatggtcaaaattttgattgtgtagatatgggaataaaagaaaataaaaaagttgaagttgtaattagacccgaagacatttcacttgtttcacaaaatgatgggctatttaaagccaaagttgattctatgctatttagaggtgtacattatgaaatttgttgtaaagatagaaaagggtatgaatgggtaatacaatcaacaaaaaaagctaatgtaggtagtgaagtaggtctgtattttgaaccagaagcaatacacatcatggtaccaggtgaaactgaagaagaatttgataagcgaattgaaagttatgaggactatcatcatgcataa

SEQ ID NO: 1870 - DNA, 609 bp, Staphylococcus epidermidis
ttcatagaaggagagaatgatatggaagatattgttattgcaactaataatcaaggtaagataaacgattttaaagctatttttaaaaatcaacatgttattggaatttctgagttaattgaggattttgatgtagaagaaacaggtgccacatttgaagaaaacgctaggttaaaatccgaagcggcagcacatgcattaaataagcgtgtcattgcagatgatagtggacttgaagtgttcgcattaaatggagaaccaggcgtatattcagctcgctatgcaggattaggtaagaatgatgaagataatattgaaaagttgttaacgaacttagaagatgttcaagaccgtcgtgctcaatttgtttgtgtgattagtatgagtgcgcctaatgaaaaaacaaaaacatttaaaggaacagtttctggagtgataacaactgaacgacatggaaagaatggttttggttatgatccaatattttttgtcccagaattaaataaaacgatggcggaaattacaaatgatgaaaagggtaaaatcagtcatcgtggaaatgctattcgactgttaaaagaatatttagagggtgaacaacatgtctaa

SEQ ID NO: 1871 - DNA, 2208 bp, Staphylococcus epidermidis
aaagttggagggaacaaaatgtctaaatttatcgaaccaagtaatgaagagattaaacttgaaaaactttatcaagatataggattaagtgataaagaatatgacaaagtggttgaaattcttggtagagaacccaacttcacagaagtaggaattttctcagtgatgtggagcgaacattgctcatataaacattctaaaccatttttaaaacaatttcctacgacaggagagcacgtattaatgggaccaggagaaggtgcaggtgttgtagatataggcgataatcaagccgtagtatttaaagttgagtctcacaatcatccatctgcaattgaaccatatcaaggtgcggcaactggagtcggaggtattattagagatattgtttcaattggtgcccgtccaattaatttactaaatagtcttcgttttggtgagttaactgtaaaacaaaatcaacgattacttaaaggtgttgtaagtggtattggtggatatggcaactgtattggtattcctactacggctggtgagattgaatttgatgaacgctatgatggcaatccattagtcaatgctatgtgtgtaggaatcattgatcatgatatggtccaaaaaggaacagctaagggtgttggtaattccgttatatatgtaggtttaaaaactgggcgtgacggtattcatggtgcaacatttgcatctgaagaacttactgaggaaagtgaaagtaaaagaccttcagtacaaattggagatccatttgtaggcaaaaagctaatggaagcaacattagaagcaattacttttgatgaactagtaggtatacaagatatgggagcagctggtttaacttcatcttcatctgaaatggcagctaaaggtggtagtggtttacatttaagacttgatcaagttccaacaagagaacctggaatttccccatatgaaatgatgttttcagaaacgcaagaaagtatgctgttagttgtagaaaaaggtacagaacaaaagtttttagatttattcaataaacacgaactagatagtgcagtaatcggtgaagtaacagacactgatagattcgtgcttacatacgatgatgaagtgtatgcagacattcctgtgcaacctcttgctgatgaggcaccagtgtatattttagaaggagaagaaaaggaatataatacatcaaaaaacgattacagcaatatagatgtacatgatacatttatcaagttattacaacacccaacaatagcatctaaacatcatttatatgaacaatacgatcaacaagtaggagcaaatacaattattaagccaggtttacaagcttcagttgtgcgcgtagaaggaacacaaaaagctattgcttcaactatagatggtgaagcacgttatgttttcaaccaaccttatgaaggtggaaaaatggttgttgctgaagcctatcgaaatttaattgcagtaggggcgacaccattggctatgactgattgtctaaactatggttctccagagaagaaagaaatctatcaacaattaatagattcaacaaaaggtatgtcagaagcttgtaaagtgcttcaaactcctgtagtttcaggaaatgtttcattatataacgagacacgtggaacctctatcttccctacacctgtcgtaggtatggttggtcttattgaagacgtgagctatctaaaagagtttaaacctaaagcaggagataagatttatttagttggtgaaacgcgtgatgactttggtggtagtcaattggaaaaattgttgtatggatcagttaatcatgagtttgaatctattgatttaagtgatgaagtttcaaaaggaaaattaatcaaacaggctattcgtaatggcattgcatctcatgtacaaacagttggtaagggcggcttattagttactttagctaaaattagtgcccattatgatttaggtatgcaagctcaattggatgttaccaatgcacaattatttagtgaaactcaaggacgatatattgttgttgttaaagaagggcaaactttggatatagatcaagctcaagaaattgggcatttaactcatcagcagttatttgatatatctaattcagacgtaaaaataaaagaaaacgtttcagatatcaaacaaaaatgggaaggggctatagttcaatgtctaactactcaggattaa

SEQ ID NO: 1872 - DNA, 147 bp, Staphylococcus epidermidis
gataaaacgggcaaaaatactgtcatatcaaggatttataatcaaatgatcaaacgagtaagaaagtggtggataggtggagggactgaacacatctatcccaaaatcattcataatttgaagtggattccaaactctttcttgtag

SEQ ID NO: 1873 - DNA, 189 bp, Staphylococcus epidermidis
ataaacaagggcgtattaatattccgcaaaaatttaaggaaatatgccaatttaagtaaggaatgtacagtaattggtgtctcaaatcgtattgagatttgggacagagaaacttggaatgatttctatgatgaatctgaagaaagtttcgaagacattgctgaagatttaatagattttgatttttaa

SEQ ID NO: 1874 - DNA, 1260 bp, Staphylococcus epidermidis
aaagaaaggggtaatctattgaaagttttaatagttggagctggtggacgtgaacatacattagcttctaaaatcaatcaatctccaattgtagataaggtttacgcgattccaggaaatgatgcaatggtcaatattgctgaagtgcacagtgaaattgctgaatcagatcatcaagctattttacattttgctcagcataacgcaattgattgggtaatcattgggcctgaacaacctttaatagatgggttagctgatttattaagaaatgcaaatattaaagtgtttggtccaggacaagatgccgctcaaattgaaggttcaaaattatttgccaagcaattaatggacaaatatcgtattcctacagcagaatataaagaagtaagttcacgtaacgaggcgttgcaatatgttgaaacttgtgatttaccaatcgtaataaagaaagacggtttagcagcaggtaaaggggttattattgcttttacgagagaagacgcattagaaggggtcaaaaaaatttatcaagaagaaaaagggaaagtcgttttcgaaagttatttagaaggagaagagttttctttaatgacttttgtaaatggagattatgcggttcctttcgactgtattgctcaagatcataagcgagcatttgataatgatcaaggaccaaatactggtgggatgggcgcatattgccctgtaccccacattgatgcatctgttcttgaacaaaccaataaggagattgctcaacctattgctaaagctatggcacaagaaggtcatgacttcttcggattactatatattggtgcaattttaacaaaagatggacctaaagttattgaatttaatgcacgttttggtgatcctgaagcacaagtattattaacacgtttagaaagtgacttaatgcaactcattatcgatttggaaaattgccaacccattcattttaactggaaagatgaagctgttgtaggagtaatgctagcatctaaaggataccctggttcatatgaaaaagggcatgaaataagtggttttaatctagattctcattattatgtgagtggattaaagaaagaaggtcaatgttttgtgaattctggtggaagagttatcctagctataggggaaggtccaacagttgaaaaagcacaagcaaatgcatatgaacatgcacgacaaataaaaagtgataatcttttttatcgtaatgatattgggaataaagccatcactaagtaa

SEQ ID NO: 1875 - DNA, 222 bp, Staphylococcus epidermidis
tgtgtatttatatttattaaaggaggtactttcatgggtaaacaatgtttcgtaacaggtcgtaaagcttcgactggtaatcatcgttcacacgctttaaatgcgaataaacgcagatggaacgctaaccttcaaaaagttagaatccttgtagacggcaaaccaaagaaagtttgggtttctgcacgtgctttaaaatctggtaaagttactagagtttaa

SEQ ID NO: 1876 - DNA, 1176 bp, Staphylococcus epidermidis
actaaaattattggtaagccctacatttgtagtattaggaggtcaaaaaaagtgtcaaaatttaagtctttgcttctattatttggcacactaattttacttagtggttgttcaaatatagaagtttttaatgcaaaagggccagtagcaagcagtcagaagttcttgattatctattcaataattttcatgcttgttattgttgctgtagtgctttccatgttcgctatttttatttttaaatatagctacaaaaagaatagcgaatctggtaagatgcaccacaattctctaattgaaacaatttggtttgtggtacctattttaatcgtaattgctttagctattcctacagttaaaactttatacgattatgaaaaaccaccagaaaaagacaaagatccacttgtcgtttacgcagtaagtgctggctataaatggttctttgcctaccctgatcaacatattgaaactgttaacacattaacaattcctaaagatcgaccagttgtattcaagcttcaatctatggatacaatgacaagtttctggattccacaattaggtggtcagaaatatgccatgactggtatgactatgaattggactttaacagctgatcaattaggtactttcagaggtcgtaactcaaacttcaatggtgagggattctctcgtcaaacatttaaagttcactctgtaagtcaaaatgattttgataagtgggtaaaagaggctaaaggtaagaaaactttaagtcaagatacttttgacaagcaactcttaccaagcacatctaacaaagaattaacatttagtggaactcatatggcgtttgttgaccctgcggctgatccagagtatatcttctacgcttacaaacgttacaactttgaacaaaaagatcctaacttcacagctgaagaggatttatacaaagatgtaaaagataaaccaatcaaacctgctcgtaaggttcatataacaaaccctaactatgaacgtcacggtatgaaacctatgattctcggcaacaatgaaaaatacgataatgagttcaaaaaagaagaggatcataactctaaagaaatggaaaaaatttctaagggagcaaaagacgaaaatgcgtctaaacttcacaaaaaagaacacgatgatcatggaggtggacattaa

SEQ ID NO: 1877 - DNA, 129 bp, Staphylococcus epidermidis
cctaaagttattcgattatcacaatatataggcgatttaattccagagctccaagtaaataaatcatttggagataatgaaactgcctctatgtctaacaatgctttagcaatatttttagccatttaa

SEQ ID NO: 1878 - DNA, 135 bp, Staphylococcus epidermidis
gcaggaattttcgcttttgtgattaatatgtataaaagtgtaccaatacctgatgccaacaaagctgctgatataggcagatgtgttaaaaatggtacaagtacagttgatccaaacattgcaaataaatgttga

SEQ ID NO: 1879 - DNA, 177 bp, Staphylococcus epidermidis
ggaaaatctatccatttcgcttgtgctattggagcaaatttaactatgcccatgaaaatggatacaatatatcccactataatacctataagtacaggtattagtgataaaaatcctttgaagaatccttggacgatgatggttactgctaatgtaatcaaagcaacaattaagtaa

SEQ ID NO: 1880 - DNA, 1086 bp, Staphylococcus epidermidis
agggactatataaggaggaattcagtcatgactcaaaatgatctaatgtctgagttgaagcaacaagctttagtggatataaacgaagcaaaagatgcgcaagcgttacaagaagtaaaagtgaaatatttaggtaaaaaaggttctgttagcggcttaatgaaaaatatgaaagatttgcctaatgaagacaaacctgcgtatggtcaaaaggtaaatgaattaagacaaactattcaaagtgaattagatgaaagacaaaagctaatcaaagaagagaaattaaatcaacagctttctgaagaaacaattgatgtcacattgccaagtcgtcatattgaaattggatcaaaacatcctttaacacgtacagttgaagagattgaagacttgttcttagggttaggttatgaaattgttgatggttatgaagttgaacaagattactataattttgaagctttaaacttacctaaatcgcatccagcacgtgatatgcaagatagcttttatatcacagaagaaattttaatgcgtacacatacttcaccagtacaagcacgtactatggaaaaacgtaaaggacaaggaccagtcaaaattatttgtcccggtaaagtttatcgacgtgactcagatgatgcaacacatagccaccaatttacacaaattgaaggtttagtagttgataaagatattaaaatgagcgatttaaaagggactttagagttagttgcaaaaaaattattcggtgcagatcgtgagattcgtttacgcccaagttatttcccgtttactgaaccatcagttgaagtagatgtatcatgtttcaaatgtaaaggacagggttgtaatgtttgtaaacatacaggttggattgaaattttaggagcgggcatggttcacccgaatgtattagaaatggccggattcgattctaaggaatattctggcttcgcatttggtatgggaccagatcgaattgcaatgttaaagtatggtattgaagatattcgtcacttttataccaatgatgtccgtttcttagatcaatttaaagctgtagaagatagaggtgaacaataa

SEQ ID NO: 1881 - DNA, 255 bp, Staphylococcus epidermidis
gaaatgaatataattcctagaacgagtttaattatttatttaaaacatatgaaacatgagcgacaaattagaaaatatggacacatcgtgcactcaaaccgtcaacgaaaatatgttgtgatgtatataaatgaagcagatgctgacaatattgttcataaacttatgcaactcaagtacgttcacgaaattcaaggttccccatataaatatttgaaaaaaacatatgaaaaagaaaaacatgaaatacaatag

SEQ ID NO: 1882 - DNA, 126 bp, Staphylococcus epidermidis
atatatttcattttagtctctttacattctactgattgtaaagagactttttttatgaaaggaaatgaatcaacatggaaaatgagcaaatgtttgagcgtaccgttcagccagttcttgatgtaa

SEQ ID NO: 1883 - DNA, 1329 bp, Staphylococcus epidermidis
acgatcttcatatataataattttgaggtgaacagtatgtcttttcttaggaaacacaccgaaattatatttagttatatcatcggtatcgtttcactttttacaggtctcattatttttattaacttacctttaatcaaacaatttaaaggtgacaaaaaggttgatacgcatgtgcataacgtatgggaattcctaaatgccttttttgccgagattataaaagtgatgagtaaatttattggtggctttccaattacaagtgccatagtaatcatcgtatttggtattctagtgatgctgttaggtcacactttatttagaactattaaatacgattatgacatttcaattttctttttagttattggcattatgtactttatcattacattattgctaatgacacaagtgtatggcttttttgctatcgtctttattattccttttacagttcatattggttacatagtttataaagatgagttgaaccaagacaatcgaaagaaccattatatgtggattattgtaacttatggaatgagttatcttattacccaaatttcgctatatggacgtattgacgcaaatgaaattgaatcaattgatattttaagtgtaaatacattcttcattattatgtggttattaggtcagatggctatatggaatttcttattcctaagacgttcattaccactcactaaagaagaattaggcgaagaggaacctgaactttcaagaactaataaaggcaatgtatctaatcaaactaaagttcacttaaaacaactacaaaataagacaaccgagtatgcacgtaagactagaagaagtgttgatttagataaaattagagccaaaagggacaaatttaagcaaaaaattaacagcatagtagatatacaagaggacgatattccaaattggatgaaaaaacctaaatgggttaaacctatgtatgttcaattgttttgtggtgtaattattctgttttttgcttttctagaatttaataatagaaacgcattattcttaactggtgaatgggagttatcacaaacacaatatgtagttgagtgggtaacattattattgctacttttcattattattatttatattgcaactacattaacttattatttaagggataaatattattatttacaactctttatgggcagtattttattctttaaatttcttacagaatttatcaatattatggtacatggattattattatcaattttcattacgccaatcttattattaatgcttattgcaatgattgttgcttattctttacagttgagagaaaaataa

SEQ ID NO: 1884 - DNA, 306 bp, Staphylococcus epidermidis
aaaatgttcatgggagaattcgatcatcaattggatacaaaaggacgtatgattataccgtccaagtttcgttatgatctaaatgaacgttttattatcacaagaggccttgataaatgtttatttggttacactctagaagagtggcagcaaattgaagagaagatgaaaaccttacctatgacaaaaaaagacgcgcgtaaatttatgcgtatgttctcctcaggtgctgtagaagtagaattagataaacaagggcgtattaatattccgcaaaaatttaaggaaatatgccaatttaagtaa

SEQ ID NO: 1885 - DNA, 144 bp, Staphylococcus epidermidis
gtaaagatcatattaataaatgtgaaaaagttatcaataacttatagaagtgttataatcgtctcgaggtgcaaaatttatatgttgaaaacgattttaaacgaattgaatttagctataggttttggtaaagttaagttgtaa

SEQ ID NO: 1886 - DNA, 1716 bp, Staphylococcus epidermidis
gacaactacattcaaaggagagattacattatgaaaaaatctagtaaattttcaaaagattttcctactagaaaaaatcattacgcaattagaaaattcacagttggcactgcttcgattatcgtaggatcattcttatttttcggacaaacacaagctcatgctgaacaggctgaagaattcgaaagagtaacaactggtacagttgatacaggtggacagcctgctagagcagatcaaggacaagaaggaccacaagcaggcgcggatacgcacaatacagcaagtcaacctggtgttacaggtcaagatgcaccaaatgaaaatcatgctggtgaccaaaatgctgcagtaacacatccggctaatcaagaaaataatgcacctcaagttggggctggtactcctggcgctgagaacacaccacaagccggtggcgaaaatcataatcaagatactgcagtaacttcagcaggtactaatggggaacaaaatggtggtaaaccagctacgtcaacaactggtcaagatgccgcgcaatccaatggacctcaaggtacttcagtagcccaacctggtaatgatgcttctagccaaggtcatgatacacctcaagctgatgctggtactcacaatacagaaggccaacctgctgtaactactggtgagcaaactggtggtaagcctgctgcaacgaaacctgaaggtgccagtgcagaaactgcgccagcgcctaataatgctgatgaaaatcacgctcaaccttcaccgcaaacaggaggtactacagcaacacaagctggacaagtaaaaccatccggtgattctacgcctaccggtgagccaaacaaagcagacgatcaagatacacaaattaaacctacaagtaaccaaggtactacagcaacaactaatgaaattggaaatcaaaaaccaagtggtcaaacaggtaatactgagaacacgcctaatgatggtactcaagtaaaacctaataatgacccagctgtgactggtacgccaaatactaatggagaacaaactggacaacctaatgcaacagtaacaccaggacaaggtaatgaagagattaacggagctagtaaacctggagaagtgtctccgaaacctgaagaaaacaatccaactgccactgaacctggtacaactgcacctggaaatactaatcaagacacacaagtaaaacctaatacagatcagactgctactggtactccagctggtactgataatcaaaatacgcaacaaggcaatactgaacaaaataaccaaaatgctcaaccatcagcacctggaacaactgatcaagccggtgctacggttaaacctggatctgctccaaatcaagatactgaagcaacccctaatccagatcaaaataatacaccaactaatggtcaagacggggatcaaacaaatcaaagtacacaagatgataatgataatcaaaatacgcaacaaggtaatactaaacaaaacaatcaaaatgctgaacaaggtaatactggcggtacagataaagatgctaaagtaaatactaatgatgatgaaacaaaaacagatgttaaaaatgatactgaattacctgaaacaggactaagtaatgaatatgattatacaactacagtatttggttctatcgctttaatatcttcacttttattactaagacgacaaagaaaagaatctaaataa

SEQ ID NO: 1887 - DNA, 411 bp, Staphylococcus epidermidis
cacatggacataccaaaaattacgacgtttttaatgtttaatgatgaagctgaagaagcaattcaattatacacaagtttatttgaagatagtgaaattattacaatggtgaagtatggcgaagaaggaccgggcacacctggatcagtacaacactccatctttacgctaaatggccaagtatttatggcaatagatgcaaatagtggagaagagttgcctatgaatccagcaatgtcactatatgtcactgttaaggatactatggagatggaacgtttatttaatggtttgaaaaatgaaggcgccattttaatgcctaaaacagaaatgccaccatttagagagtttgcatgggttcaagataaatttggcgtgagttttcaacttgctttaccagaaaacaaatag

SEQ ID NO: 1888 - DNA, 2358 bp, Staphylococcus epidermidis
agggattgcatgagacaaaaaacattagatgtcttggaatttgaaaagattaaatcatttgtggctgatgaaactataagtgatttaggtcgtgaaaaagtacaagagatggctcccgctagtaatttcgatacagtagaatttcaaatgaatgaaacagatgaaatttcacaaatctataacaagcatcgattaccaagcttaagtggtctagcaaaagtgtctccacttgttcatagggctagcataggaggcgttttaaatgtgggagaattaaacagaattaaacgcctagttcaagtgcaaaatcaatttaaaacattttacaatcaaatgctagaggaagatgaagaggttaagtatcctatactgcatgataaaatgaatcatctaccgatacttacagatttatttaaagaaattaatgaaaaatgtgatgcacacgatttatttgaccatgcgagttatactttacaaagtattagaagtaaaatttcaagaacaaatcaacggattcgtcaaaatttagatagaatagtgaaaaatcaagggaatcaaaaaaaactatctgatgcaattgtaacagtaagaaatgatcgcaatgttattccggtgaaagctgaatatagacaagatttcaatggtattgttcatgaccaatcggcatcaggacaaacactatatattgaaccgaattctgttgtagagatgaataatcaaattagtcgtttgcgtaatgatgaagcagttgaacgtgaacgtatattgactgaattgacgggattagtttcggcggaatctgatgcattactcgttgctgaatcggtcatgggtcaaatcgattttttaattgctaaagctcgttatgcgcgcactataaaaggaacaaaacctacatttaaagaggatcgaacgatatatttacccaatgcatttcaccctttattagacaaagatactgttgtagcaaatacaattgaatttattgacgatgtagaaactgtcattattactggaccaaacacgggtggtaagactgtcactttaaaaacgctaggtttgataattgtcatggcacagtcaggattgttaattcctacactggatggaagccaattaagtatctttgaaaatgtgtattgtgatattggagatgaacaatctatagaacaatcattatcaacgttttcatctcacatgaaaaatatagtggaaatattacaggatgcagatcaaaatagtctaattttatttgatgaactaggcgcaggtacagatccaagtgaaggtgcggcactcgcaatgagtatcttagattatgtacgtcgtttaggatctttagttatggcgacaacacattaccctgaattaaaagcttatagttataatcgtgaaggtgtcatgaatgcgaatgtggaatttgacgttgatactctgagtccgacttataaattattaatgggtgttccagggcgatctaatgccttcgatatttcaaaaaaacttggtctaagtctcaacatcattaataaagctaagacaatgatagggacagacgagcaagaaatcaatgccatgattgaatcattagaacacaattcaaaacgtgttgaccaacaacgaatagaattagatagacttgtgagagaagcacaggaaactcacgatgccttgtctaaacaatatcaacagtatcaaaattatgagaaatctttgatggaggaagctaaagaaaaagccaatcagcgtgtgaaatctgcgactaaagaagcggacgaaattcttaaagaacttagaaatctaagagatcataagggcgctgaagtaaaggaacatgaattaattgataaaaagaaacaacttgatgatcaatatgaggcaaaatcaattaagcaacatgttcaaaagaaaaagtatgatacgattcatgctggagatgaagtgaaagttctatcttacggtcaaaaaggtgaagtgcttgaacttgtaggtaacgaagaagcagttgtacaaatgggaattattaaaatgaaattacctattgaagatttagaaaaaacgaaaaagaaaaaagaaaaacctacaaaaatggtaacaagacaaaatagacaaactattaaaacagaacttgatttaagaggatatcgttacgaagaagctttaaatgaattagatcaatatcttgatcaggcggttttaagcaattacgaacaagtttatattattcatggtaaaggtacgggagcacttcaaaaaggtgttcaacaacatttgaaaaaacataaaagcgttagacaatttagaggaggtatgcctagtgaaggtggatttggtgtcactgtggcagaactcaagtaa

SEQ ID NO: 1889 - DNA, 186 bp, Staphylococcus epidermidis
ggaggattaatcatggcagtaccaaaaagaagaacgtctaaaacaagaaaaaataaacgccgtacacattttaaaatttcagtacctggtatgactgaatgccctaactgtggcgaatacaaattatctcaccgcgtatgtaaaaactgtggttcatacaatggtgaagaagtagtttctaaataa

SEQ ID NO: 1890 - DNA, 3636 bp, Staphylococcus epidermidis
tttttaataattgttaatatagccccaagcttatcaactcaacacgactgtgataaggagaatacaatggtttatttaaaatcaattgatgccataggatttaaatcttttgccgaccataccaatgttcaatttgataaaggtgtgacagctattgttggtcctaatggaagtggtaaaagtaatattactgatgcaattaaatgggtactaggtgaacagtctgccaaatcactacgcggtgctaaaatggaagatatcattttttcaggtgctgaacatagaaaagctcaaaattttgctgaagtaaaacttaaattagataatcattcacaaaaactacaaattgattctgaggaattagttgtcacacgccgtctctatcgaagtggtgagagtgaatattatttaaataatgatcgtgcacggttaaaggatattatagatttatttctcgattcaggacttggaaaggaagcatttagtattatttctcaaggaagagtagatgaaatattgaatgcaaaaccaatcaatcgtcgacaaattattgaagaatctgccggagtacttaaatataaaaaacgtaaagctgaatcgattcaaaaacttgaccatactgaagataatcttaatcgagtcgaagatatcttatatgatttagagggacgagtggaaccgttaaaagaagaggcggccattgctaaagaatataagcaattatctaaagagatggagcaaagtgatgtcatcgttacagtatctgacattgatcattatactgaagataatcagcgattagatgagcgtttaaatcacctaaagagtcaacaggctgagaaagaaggtcaacaagctcaaatcaatcagttactacaaaaatataaaggtaaacgtcaacaaaacgattatgacattgaaaagttaaattatgaattagttaaagcaactgagaattatgagcaattatcaggtaagctaaatgtattagaagaacgaaagaaaaaccaatcagaaacaaatgcaagatatgaggaagaattagataatttagaatcacaaattgattctattaaaaatgaaaaagcccaaaatgaaaaattattagctgatttaaaaaataagcaaaagcaattaaacaaggaagttcaagaattagagtcacttctttatatatccgatgaacaacacgacgaaaaactagaagaaattaaaaatagttattatacattgatgtcagaacaatcagttgttaataatgatataagatttttagaacatacaatcaatgaaaatgaagcaaaaaaatcacgattagattcgcgtttagtagaggctttcaatcaacttaaagacattcaacaaaatattactcaaacacaaaaggaataccaaagttctaagaaatctatggaaaaagtagaacaaaatattcaacaattagaacaacagttgacagattctaaaagacttctatctgaatatgaaaataaactatatcaagcctatcgttataatgaaaagttaaaatcaagaattgatagtttagctactcaagaggaagattacacgtatttctttaatggtgtaaagcacattttgaaagcaaaagataaagaattaagaggaattcatggtgcggttgcagaagtgattaacgttccttcagaaatgacacaagcgattgaaaccgccttaggtgcatcgttacagcacgttattgttgataatgaaaaagacggtcgtcaagcaatccagtacttgaagcaaagaggtttaggtcgtgctacttttttaccattaaacgtgattcaaccaagacatgtagctgctgacattaaagatgtagctcgtggttcacaagggttcattaatattgcatctgatgccataaatgtatctgctaaatatcaaaacatcattgaaaatttattaggtaataccatcattgtagaaaatttaaaacatgcaaatgaacttgcacgtgccattcgatatcggacaagaatagtaactttagaaggtgatgttgtaaatcctggtggttccatgacaggaggaggagcacgtaaaacaaaaagtatattgtcacaaaaagatgaattatcaacaatgcgaaatcaacttgaagattatcaacgacaaacagcagaatttgaacgtcagtttaaagaacaaaaaacacaagctgaacaattaagtgaacaatattttagtgcaagtcagcagtacaacaatttaaaagaacaagtacatcatcacgaattagaactggatagactaaaaacacaagaagcacatcttaaaaatgaacatgaagagtttgaatttgaaaaaaatgatggatatcaaagtgataaaagtaaagaaacattaaaagaaaaacaaaatcatttaattgagatacaacaacaattgaagcaactagaaagtgatattgaaagatatacacaattatcaaaagaaggaaaagcttcgacacatcaaacacaacaacaactacatcaaaaacaatctgatttagctgttgttaaagagcgaattaaatcgcaaaagcaagtttatgaacgtttagataaacaacttagcgattcagaacgtcaaaaaattgaagtaaatgaaaaaattaaattgtttaattcagatgaaatgatgggtaaagatgcttttgaaaagttgaaagagcaaattcagcaacaagaaaatgtaagacaaaatttaaatcaacaacttagtgagattaaacaacaacgtaaagatcttaatgagaaaatcgaaataaatgaaagtcagcttcaaaaatgtcatcaagatatactttctatagaaaatcattatcaagatattaaagcaaaacaatcaaagctagatgtattaatcaaccatgcaatagatcatttaaatgacacgtatcaactcacagtagaacgtgcaagaatggaatatgattctgatgaaacaattgacaatttgcgtaaaaaagtaaaattaacgaagatgtcaatcgatgaattaggtcctgtaaatttaaatgcaatagaacaatttgaagagttgaatgaacgatacacatttttaaatgagcaacgaacagatttaagagaagcaaaagaaaccttagaacaaatcattcatgaaatggataaagaagttgaaggacgttttaagacaacatttcatgcggttcaagatcattttacgacagtgtttaagcaattatttggtggtggacaagcagaacttcgtttaactgaagatgactatttgtctgctggcgttgatatcatcgtacaaccgccaggaaagaaattacaacatctttcattattaagcggtggtgaacgtgctttaagtgctatagcattattgttcgccattctcaaagttcgttcagcaccttttgttatactagatgaagtagaagcggcattagatgaagcgaatgtgatacgatatgcccaatatttaaatgaattatctacagaaacacaattcattgtaattacacatcggaagggaacgatggagttttctgatcgtttatatggtgtaacaatgcaagagtctggtgtttctaagttagttagcgtcaacctaaatacaatagatgaggttatgaaggaggaacaagcatga

SEQ ID NO: 1891 - DNA, 2337 bp, Staphylococcus epidermidis
tgcgtaataatggcgaagcgaaaaattaaaattaaaaaaaataaaataggagcagtcctacttgttggtttattcggactgctcttttttatattggtgctaaggttttcttatgtaatgattactggccactctaatggtcaagatttaattatgaaagcaaatgagaaatacttagtcaaaaattctcaacaaccagaacgaggtaagatttatgatcgtaatggtaaagttttagcagaagatgtagaaagatataaacttgttgcagttgtggataaaaaagcaagtaaagaaagtaaaaagccgcgacacgtggttgataaaaaaaagacagcaaaaaaattagctgaaatcatagatatggacgctgacgaaatagaaaaacgacttaataataagaaagcctttcaaatcgaatttggtcagaaaggtactaatttaacttatcaagaaaaagaaaaaatagagaaaatgaaattacctggtatagcactttacccagaaactgagcggttttatcctaatggtaattttgcctcccatttaataggcatggcacagaaagatcctgatactggtgaattaaatggtgcattaggtgttgaaaaaatattcaatagttatttaaatggatcaagaggtgcacttaaatatatacatgatatatggggctacatcgcacctaatacgaagaaagagcagcaacctaaacgtggagacgatgtacacttaacaattgattctaatatacaagtctttgtggaagaagctcttgatgacatggttgaacgctatgctccaaaagatttatttgcagtagtaatggacgcaaaaactggtgaaatacttgcatatagccaacgtccgacttttaaccctgaaacaggtaaagattttggcaaaaagtgggcaaacgatttatatcaaaatacatatgaaccgggctctacttttaaaacatacggcttagctgcagcaattcaagaaggtaaattcaaaccggatgaaaagtataaatcaggtcatagaaatattatgggctctgaaatttccgattggaataaaactggttggggacgtatacctatgtcgttaggttttacttattcatcaaatacgttgatgatgcacttacaagatttggttggtgccgataaaatgaaatcttggtatgaacgctttggatttggcaaaaaaacaggtggtatgtttgatggagaagctgcaggtaatattggttgggcaaatgaattacaacaaaaaacatcagcatttggtcaatccacaactgttacccctgctcaaatgattcaagcacaatcggctttctttaataaagggaatatgcttaaaccatggtttgtaagtagtattgataatccaataactaaaaagaattattactctggtaaaaaagagtttgccggtaaaccagtaacggaagaaacagccaataaagttgaagaagaacttgataaagtagtaaatagtaagaagagtcatgctatgaattatcgcgtaaaaggttatgatattgaaggtaagacaggaacagcacaagtagctgattcaaatggaggcggttatgttaaaggtgaaaatccttactttgtaagcttcattggggatgcacctaagaaaaaacctaaagtcattgtctatgcaggtatgagtcttgctcaaaaaaatgatcaagaagcatatgaaatgggtgtgagcaaagcatttaaaccaattatggagaatacgctgaaatatttaaatgttggaaaatctagtgatacttcatcaaaaactgactttagtaaagtgcctaacgtgcaaggagatgaagttcaaaaagcagaggatagcgtcaatgctcaatctcttaaacctattacgattggtaatggcaaacaaattaaacaacaatcagttaagtcaggtaccaaagtcctaccacacagtaaagtaatgttaatgacagacggggaattaacaatgccggatatgaccggatggacaaaggaagatgtacttgcttttgaagatttaacgaaaattaaagtttctactaaaggtaatggatttgtcacgaatcaaagtatctcaaaaggtcaaatcattaaaaataaagataagatagaagtgtcattatctgctgaagatacggatgatgaccaagagaaaactgatgaggactcttcggataacaaatcaaagaaagataaagctgatgaggatcattcaaatacatcttcgtcaactaagaatgataagtcaaacgccgactcgaaaaatgattctgatgacagcacaaatgaaacatcaggttctgagagaaataattaa

SEQ ID NO: 1892 - DNA, 846 bp, Staphylococcus epidermidis
tatgtagtaataggagatgatacgatggctttatatgattttgcaaaagggttgatactagaagcaggaaataaagtaaggttgatgatgcaagaagagttagacattaaaactaaatcgaacccaaatgatttagttacaaatgtggataaggcgacagagaattatctatatgaaacgattcttcataattatccagatcatcaggttattggcgaagaggggcatggtcataatctcgagtatttaaagggggttatttgggttattgatccaattgatggaacacttaattttgttcaccaaaaagaaaattttgccatctctattggtatttatcatgatgggaagccttatgcaggttttgtttatgatgtcatgaaagatgttttatatcatgcaaaggttggacagggtgcatttgaaaatacacataaacttgaaatgattcaaaatactgaacttaaaagaagtattataggtattaatcccaattggctgtcgaaaccaatactcagtgatatttttagttcaatagtgaatgaggcaagaagtgcacgagcatatggtagtgcagcattagaaattataagtgtagcgaagggtcaattggcggcttacctaacacctagactacaaccgtgggattttgcaggtggattgttgattttgaacgaagtaggtgggataggaactaacttattaggcgataaattagacttcaatcaaccgaattcaatattaatagcaaatcctagccttcatcgtgaaatattaaatcatcatttaaatcagcaaagagatacacttattacactccatgaaaaaaggtttggaaagagatag

SEQ ID NO: 1893 - DNA, 2418 bp, Staphylococcus epidermidis
gtggcagtaatgattgcaaaagtaattgttgatattccgtcgaaaagtgtcgattttaaatttgattatatcgttcctaaaaatttagaacgtgtgattcaaattggcgttcgcgttgtggtaccttttggccctagaactatacaaggatacgttatgaatattcaacaagaaccagatggaaatatggatatatcgaaactaaaagaaataaaagaagtgcgtgatattaaacctgaattaacatccgaactgattcaattaagcgaatggatgagccattatcatgtgatgaaacgtatttctgttttagaagcgatgttgccaagtgccattaaagcaaagtataagaaagctttttcaattatcgatccaaaaaatttatcttcaaaaaccaaagcgctatttaacaatgacggttattacttatataaagaagctcagcaaaacaatgatttagaagaaatgttgactttgttaaatcaaggattgattgaagaggtcacgatactttctcaaaacacaaaaaagaaaactcaaaaagctgttggcgtagttaatacgttgaatggtgatgaagtacttgcaaaactcgagaaatatacaaaacaatatgatttgtatgcatttttattagaagagtctcatcgaacagtgtttttaaaagaaatcaatgatatgggcttctctcactcgagtttagattctttaatcaaaaaaggttatattgaaaaatataccgccgaggttttcagagatccttatgcaaatcgtatatttgaacaagaacaaaagaggatattaactaaagaacagcaagatgcatttgaagctattcaacattatattcatgatgaaaaagaaagaacatttttattacacggagtcacaggttcaggtaaaaccgaagtctatcttcaaacaatagaagaagttcttaataaaggtaaagaagccatgatgttagtgccggaaatcgccttaacacctcagatggtgctaagatttaaacgtcgatttggagatgatgtagcggtattacattccggactttcaaaaggtgaacgttatgatgagtggcaaaaaattagagacggtcgagctcgagtgagtgtaggtgctcgttcaagtattttcgcaccgtttaaaaatttaggcatcattataattgatgaagaacatgaatctacatataaacaagaagattatcccagatatcatgcacgtgatattgcacaatggagaagtcaatttcatcattgtcctgtagttttaggtagcgcaacaccgagtcttgagtcatatgctagagcagaaaaaaatgtttacgagttgttgtcattgccacatagagtcaatcaacaagcgttaccgcatattgatattatagatatgagagaagaattaagtgaaggtaatcgttccatgttttctatagcactaagacaagcgatacaagaacggttggataaaaaagaacaaatagtactattcttaaatagaaggggatatgcttcatttatgttatgtagagattgtggttacgttccccaatgtccccattgtgatatttcgttaacatatcataaaacaaccgatcaattaaaatgtcattactgtggttatcaagaaaatccaccatctcaatgtccaaattgtgaaggtgatcatatcagacaagtcggaactggaacgcaacgtgtagaagaattattacaacaagaattccctcatgctcgtattataaggatggatgttgatacaacttcaagaaaaggtgcacatgagaaattgttaaatgactttgaagcaggaaaaggagatatcttattaggtacgcaaatgattgctaaaggtttggattatcctaacattactctagttggtgtgctcaatgctgacactatgttaaacttacctgactttcgtgccagtgaacgaacataccaacttttaactcaggtatctggacgcgcaggtcgtcatgaaaaagaaggacaagttatcatacaaacgtacaatcctgatcattattcaataaaggatgtgaaattaaacgattatctttctttttatcaaaaagaaatgaattatcgaaaattaggaaaatatccaccttactattttttgattaactttaccatttcacatactgatataaaaaaggtcatgatggcttctaagcatatacatcaaattttagtacagcacttaagtgaaaaagcattcgtgttaggcccttcaccagcagcactagcaagaattaacaatgagtatcgttttcaaatactagtaaaatataagagtgagcctcaattacatccagcgttacaatatttagatgattattatcatgatcaatatgtaaaggataaactatcattaaaaattgatatcaatccacaaatgatgatgtga

SEQ ID NO: 1894 - DNA, 135 bp, Staphylococcus epidermidis
aatccctcaatagagtatcttacaattagataccctattgagggattttttgactggatgattaagaggtggcagcctatttcatatatagaactaaatgactgttatacacctctatatgtacagttgccttaa

SEQ ID NO: 1895 - DNA, 129 bp, Staphylococcus epidermidis
agtattccaattcatcgtacaattgtacttcaccttcaatgcatatttgaaataattatattcaaatcaataaattctacacgcattatttacgataaatcaaaggttataataattactcaaaattaa

SEQ ID NO: 1896 - DNA, 141 bp, Staphylococcus epidermidis
ttatttcaaatatgcattgaaggtgaagtacaattgtacgatgaattggaatactctagtgatttttcttctcagcttatttccacaattcattctgactttataataaaaatttactatgatttcgaagttaattcataa

SEQ ID NO: 1897 - DNA, 225 bp, Staphylococcus epidermidis
tcatttaaaattatttcaattataatcatcattgaaaagttacactacaaatttattattaatttatcattagttgttactcatttagccatcatagctcacatctttatcagctacaattttattatcaactcttatggtgtacccagcgtcacttccttttttaattttcaaaggaatattaattgttttatcacttttaatattaaacgtttgaactgctga

SEQ ID NO: 1898 - DNA, 135 bp, Staphylococcus epidermidis
atgattaaaatttatctctttgttgacttaataaaacacatcgctactaaaaagcgttcttatctattatatacttcaacgtatctattaaacaaatataaacaaatagatttacctttaaaacccatgatttaa

SEQ ID NO: 1899 - DNA, 645 bp, Staphylococcus epidermidis
atggttaaaattttaccatcacttttatctatagattttttaaatttaaaagaagagcttcaattgttagaaacagcaaaggtagacggattacactttgatgtaatggacggtaaatttgtccctaatatttcaatcggtattccgattttggatgctgttagacaacaatctcatttgccaatagatgttcatttaatgattgagcaacctgaaaattatattaatctttttgccgaacatggtgctgatatgatttctgttcatgttgagtcgacaacacatatacatagagcaattgaacaaattaaacaattagggaaaaaagcaggtgtcgtcatcaatcctggaacatctgtagaaacaattttacctatattgagtattgttgattatgttctagtaatgactgtaaatcctggttttggtggacaaacattcatagaacaatgcgtgactaagattgagcaattaaatcaacttaaacatgaaaatcatttaacttttgatattgaggtagatggaggcattaacgatcaaacgagtaaacgatgtgtagaacagggtgctacaatgttagtcactggttcatacttctttaaacaagaggattatgcaaaagtaacatctttattaaaggaatga

SEQ ID NO: 1900 - DNA, 633 bp, Staphylococcus epidermidis
agcaataaaatctttgagtatctattaatgtacttgtgtctatcttatctgatatattatttaataaggaaggtgtatgacatgataacaatgaaagatattataagagatggtcatccaacacttcgtgaaaaagcgaaagaattaagcttcccactttctaacaatgataaagaaacattgcgcgcaatgcgtgaatttctaatcaatagtcaggatgaagaaaccgcaaaacgttatggtttacgttctggcgtaggtttagctgctccacaaattaatgaaccaaaacgtatgattgctgtctacttacctgatgatggaaacggtaaatcgtatgattatatgctcgtaaatcctaaaataatgagttacagtgtacaagaagcttatttaccaactggcgaaggttgtctaagtgttgatgaaaacatcccaggtttagtgcatcgtcatcatagagtcactattaaagctcaagatattgatggaaatgatgttaaattacgtctcaaaggctatcctgcaattgtatttcaacacgaaattgatcatctaaatggcattatgttttatgattatattgatgccaatgaacctctaaaaccacatgaagaggccgtagaagtctaa

SEQ ID NO: 1901 - DNA, 936 bp, Staphylococcus epidermidis
gtgagtaaaatgggtaaaatagcagttgtcttccctggccaaggtgcacaaaaagtagggatggctagtgacttatataatgaagaggaacgctcgactcgagtattaaatttagctcaagagacagtagactttgatttgctagaaacgatgtttactgataatgatgggaaattaggagaaacagaaaatacacaacctgcactattaacacatagtgttgcgttactagaatcattaaatcatttaaaagtagattatactatgggacatagcttaggagaatattcaagcttagtttctagtgatgtattatcttttgaagatgcggttagaattgtgcgtaaacgtggccaacttatggctcaagcgtttcctaacggtgttggaggtatggcagcagtattaggtttggattatgatgatgttgataagatatgtcaaacgttatctacaaaagaacagttaattgaacctgctaatattaactcaccaggtcaaatcgtggtgtctggacataaatctttaattgatgaattagtagaaaagggcaaagaacttggtgctaaacgtgttcttccattagctgtttccggtccttttcattcttcaatgatgaaagttattgaagaggattttgctaatttcattaatcaatttgaatggcataatgctaattatccagttgttcagaatgttaatgcaaagggagaaaccgatgctgaagtaattaaacgcaatatggttaaacaattatattcacctgttcaatttattcaatcaacggagtggttgattaatcaaggtgtcgatcactttattgaaattggaccgggaaaagtattatctgggcttatcaaaaaaataaatcgagatgtaaaaatcacttcaattcaaacactcgaagatgtgaaaggatggaataatcatgaataa

SEQ ID NO: 1902 - DNA, 1149 bp, Staphylococcus epidermidis
aaaggagaaatgcaaatgaaaagtgttggactgataactgaatataatccttttcataacgggcacttatttcacgctacattgtcaaaacaacgctctgaaactaatgtaactattgctattatgagtggcaattttgtgatgcgtggagaaccagcaatctaccataaatttaaacgcactaaaatggctttatccgccgtagatttagtcgttgagctaccattgataggtagcctatcttctagtgatacctttgcggaaatagctattaaaacagctcagtatctcgatatagatattatatcttttggcagtgaaagtgcatccttaaaagatttacaatatcttgcaacacaaatgattgactatgaaaaacatccagattttaaagagaaattaaaacaaggtaaaagctatccacgaatcttaagtgagttaacacataacgacacacttttacaatctccaaacaatattttaggaataagctaccttaaagcaatgcagcaatttgcgcctcacatgtcagcattgactattaaaagagaaggttcacttcatcatcaaaaagtaattgatcaccatcattttgcaagtggaacatctattaggcgttcgctaatgaatgataatgtagactggaaaaatgtggtcccaaatcaaatacaatctttatattgtaaacctcatactacggttgaggatacatttccttttatcaaacaccaattaattacacaaccaaaagagagccttcattctatttacacaataaatgaggggtttgaaaatcgcttgcaaacaatgattcatcgaagcgattcctttgagtctctattatcaaaccttaaaacaaaacgttatacgcagacatatattcaacgtgtattaatgaatgtgttattaaatataacaaaagatgatgttaacaaggaaattaacgctgttagagttttaggaatgagtgaaaaaggacgctcatatttaaaatatttaaaagctaattatccaaatcgtcactacattactaatgtaaatcaaaagactgcacactattttaaaaatgaaattaaagcgactcatgtatataatctattaagtaatcaatcacagacagactttaacacacctttagtacgcatttaa

SEQ ID NO: 1903 - DNA, 750 bp, Staphylococcus epidermidis
aaggatggaataatcatgaataaaagtgctttagttacaggtgcttctcgtggtattggtagaagcattgcattgcaattagcggaagaaggatataatgtagctgtcaattatgctggaagtaaagataaagcagaagcagttgttgaagaaattaaagctaaaggtgtagaaagctttgcaatacaagccaatgttgcaaaaggcgatgaagttaaagaaatgattaaagaagtggtaagtcagtttggttctgtagatgtattggttaacaatgcagggataactaaagacaacttacttatgcgtatgaaagaacaagaatgggatgacgtgattgatacgaacttaaaaggcgtgtttaactgtattcaaaaagtaacgccacaaatgttgcgtcaacgtagtggtgcaatcattaatttaactagtattgttggtgcaatgggtaatcctggacaagcaaactatgttgcaacaaaagcaggtgtcattggattaacaaaaactgcagcacgagaactagcatcacgaggtattacagtgaacgctgtagcacctggtttcatcgtttcagacatgacaaatgctttaagtgatgatttgaaggatcaaatgttagagcaaattcctttaaaacgttttggagaagatacagatatagctaatactgttgccttcctagcttctgataaagctaaatatattacaggccaaacaattcatgttaacggtggaatgtatatgtaa

SEQ ID NO: 1904 - DNA, 141 bp, Staphylococcus epidermidis
tatagtttgattcttaatttgattgatagttcgattaagattggaggcgttgttatgctcatacattatggtgtgccattattaatatttgcattagttctattaattggatggctaatgactaagatgtttatacgttaa

SEQ ID NO: 1905 - DNA, 231 bp, Staphylococcus epidermidis
aatggtctgattgagaatcagatggaattctataatcatctcgtctataaagaaactcattacaatgttttattaaagtgtaaagatgattattatcattattttgttccattagacgcctcctcaccattcatatattacgataagttatctcgccaatcaactaatgtttggatatcatttaaagagattttaccttcatctttcgcaacttctataagctcattataa

SEQ ID NO: 1906 - DNA, 1023 bp, Staphylococcus epidermidis
aacaaaatgatttacgcttatatcggtataacagtattatgggtatttttattttgttatattattatcgcctccattgattttggtgcaggatttttcgcattgcattctaaaatgacaggtaatgagaaaaaggttaatcatttaatccatagatacctcaatccagtttgggaagttacaaatgtctttttcgttttcttttttgtaggatttataggtttttttcctgattctgctaaatacttaggaacagttttattagtacccggatcaatagctttaattcttatttctatacgaagtagtttttatgcttttgaaaattatggtcaagatactaaactgccctggattgtattatatggtttaacagggctgttaattccagcttctctagcaactgctctaacaatttcagaaggtggttatatctatgagcatggcacacatattgatttagactggatacaattattattaagtccatttgcatggtctgtagtattcttagccattgtttcagttctttatatttcatcaggttttttaacatattatgctcataaagcaaatgatcaacctgcttatgatatgacacgacaatggcatattttttgggggccacctatgattgtgatttcattatttgttttcttatctcttagaattcaaaattctgatcactttagaactgctatttttaattattggtggatgtttgcaatcagctttatattttttataatagctggattactgactatatttaaaaagaaacacggtctagcttttatcatggttatattgcaaatgttatttgcattctttggctacggaatgagtaaacttccatatttactttatccgtttattaaaattacagactcccatgtcaatccggaaatgggattatcattagttattgtttttgttttaggtttacttttattaattccatcgttaatattattattaagattatttgttttcgacaaagcatatgtggaaggaaagaaataa

SEQ ID NO: 1907 - DNA, 939 bp, Staphylococcus epidermidis
gaggattcgattatggctcattcaaaaaaatggtttattaatggtacgttggcaacagccggtattataagcagtctattttactttttaaaaaataaaaataaatcaccgcaacaattaaaatctattccacctttcttctcaggacaagcaccttacatatttgcacatagaggtggcatggcaatgcgaccagagcaaacacagttggcatttgataatgctgttgaatatggattggatggctttgaaacagatgtacgactaactaaagatgaacaactcattgtttttcacgatgcacttgtcgaccgtacaactaatggttcaggtaaagtgagtgaacatactctagctgaactaaaacgattagatgcgggatatcattttactgacatcaataatcaaacaccttatcgcgggcacgataaagctaagattttatcattcgaggaactgcttgaattgtaccctaatatgtatatcaatgtggatttaaaagatgcgccagacacatatgaaggtcgtatcgcaccaaaagtgatttacgataatatcatcaaacatggggcgcaacatcgagtgctcgttacaagcttccataaaaaacaaattcaacgtttcactgagtataaccaagctgacattgctatcggtgctagtgaaggcgaagttgctgaaggttttattaaatttaacggcatgttaggtcacacatttaaaccacaagcagacacattccaaatgccagttgcatataaaggaatttcattaacttctaagcgtttcattcaatggcttaacttaaataatattgtacccggttactatggtgtgaatagtatagatttaatgacagatttatatcataaaggtgttcatactttagttacagatcgcccagatttaggtcaacaatttaaagaaactttaaaataa

SEQ ID NO: 1908 - DNA, 129 bp, Staphylococcus epidermidis
tatatatcgatggttatctactccttttatgttgaaaaatttttaaaacactacgactataacactgtcaacaataagtcatatgataaaacgaggtcaaagtctagctactttgcctcgttatgttaa

SEQ ID NO: 1909 - DNA, 708 bp, Staphylococcus epidermidis
aaggagaagatgagtgtgagaaatctacccattatagcattagattttaaatcagcagacgaggttcatacatttttaaataaatttaatgaaccgttatgcgtcaaaattgggatggagttattttatcaaacagggccagctttaattaagtccattaaaaaaagaggtcatgatatctttttagatttaaaattacatgacatacctaatactgtgagtaaagcaatggaaggcttagcacgtttagatgtagatttagtcaatgttcatgctgccggtggtattaaaatgatggaagaagctaaaaaagggttaagaaaacataatgctgatattaaaatcattgcagttactcaattaacttcaactactgaaagacaattacatgaagaacaaaatattcaaacctcaatagaggaggcagttttaaattatgctcgtcttactaaaaaagctggtttagacggtgtcgtatgttctcctcttgaggctgagatgatttctaaagaactaggtactgactttttaaaagtgacaccaggtattcgcccgaaaggcgcagctcgtaatgatcaacaacgaattacaacaccagaggaagctaaaaccttggggtcaacacatatcgtagtaggtcgacctatcactcaaagtgagcatccaattgacagttatcataaaataaaagaaagttggttaagttaa

SEQ ID NO: 1910 - DNA, 147 bp, Staphylococcus epidermidis
aaaaatgactttaaattaatgtacatatttttacttttaacttattatatcaagaatcacatttttaagtgtgtcacaaaattgacgatttctaatgtcgtaaaagtgtcacaatttaattttataaaacccaatctttttgtgtga

SEQ ID NO: 1911 - DNA, 204 bp, Staphylococcus epidermidis
gatggcactgtttctattctatctcttctagcaaacatcatcattgcaatgataaagaataagataggaatgattagagttacaatcaacaatacaagcggaattgtgactatagcagctattaaaaaaagaaaaccagacaaaattcttatattcatagaaattaacgctaaaaacgagatgagcaaacaaacaataaaataa

SEQ ID NO: 1912 - DNA, 492 bp, Staphylococcus epidermidis
gtgatgactgtaaagaaattagtaaaatcaacacatcctattttgaataaaacaattcaacctgtaagcacgtatgatcaaaaactaaaagtgttattggaagatttggaagatacattatatcatgaggaagctgctgcaattagtgcacctcaaattggagtagatcaaagtgttgcactcatcgatatggaacaagaagggttattacaacttattaatcctgtcgttaaaagtcaatctcaagagactgtttctgacttagaaggctcaatcagtttacctcatatatatggagaagttaaacgtagcaaaatgatcactgtacaaagctatgatatcaatggaaatgcagttgaattaactgcatatgacgatattgcacgcatgattttacatatgattgatcatcttaatggaattcaatttaccaaaagagcacatcatatattaaatgaaactgaagtggaggcgtattttgacaatgagtaa

SEQ ID NO: 1913 - DNA, 288 bp, Staphylococcus epidermidis
ggggaatatgtcatgtctaaccaatcgaagttaaatagtgcggcatatgaccaattgaataaagatgcagacagaatattacatctaattaaagttcaaatggataacttaactttaccttcttgtccactttatgaagaggttttagatactcaaatgtttggtttacaaaaggaagttgatttcgcagttcaacttggattagttgataaagaagatggtaagcaattaatgttaagacttgaaaaagaactttctaaattgcatgaagcatttacgaatgtttaa

SEQ ID NO: 1914 - DNA, 672 bp, Staphylococcus epidermidis
tttatggatgttaaagaaaatcttgctaagattgaaaaggaaattgatgcaagcattaaaaaaagtgcgcattcagcacaacctcacgtgattgcagtaacaaaatatgttacaatagagcgagctagagaagcgtataaagtaggaataagacatttcggtgaaaatcgattagatggattcaaagagaagaaagaatctctaccaagcgatgttaaattacatttcattggttctttacaatcaaggaaagtaaaagatattataaatgaagtcgattattttcatgctttagatcgtttaagtctagctaaggagattaataaaagagcaaatcatgttataaaatgtttcttacaagtaaatgtttctggagaagaatctaaacatggcatagctcttgaagaagtgaatcaatttataaatcaaattaaagaatatgaaaatatccaaattattggattaatgacgatggcaccattgactgatgatttatcgtacataagaaatttatttaaagaattaagacataaaagaaatgaaattcaacaattcaatttagcacatgcaccttgtacagaattatctatgggaatgagtaatgattatcaaatggcagttgaagaaggtgcaacctttgtcagaattgggactaaacttgtaggagaatag

SEQ ID NO: 1915 - DNA, 1404 bp, Staphylococcus epidermidis
ttgttacgtgttaaaaatttacgtttaaagtatccgaatggtgataggaaaatattcaataacttaaatcttgagattaaaaataaagaaaaagtgcttttactcggtccttccggatcaggtaaaagcacattacttaatgtattaagtggaatagtacctaatttaattgaacttccgatgaaatatgatgaattgaatattgatcatgatagtggcgttatatttcaagatccagataatcaattttgtatgccaaaagtatatgaagaacttgcatttgttttagaaaatagaaatattcctagaagtgagatggatcaagaaatcgaagacgcactaaagtctgtagaccttaatgttactcataaaacatatgtcaataatctaagtggtggcatgaaacagaagttagctattgttgaaacaatactacaaaaatcaaagacactttttttagatgagcctactgcaatgctcgacgtgaaagcaactgaagatttatggaagaaattaatcaatctttgggaagatcaaacagttttaattgttgagcataaggttgaacatatttggcaacatgttgaccgcgtattgttattaaattatgatggtgaaattgttgctgacgacaccccagaacaaatcttggatcattatgaagcgttattaactgaatatggagtttggcaccctagagcatggcacagtgcaccacgccccatcccattacctaatcaaacaaagaacctcttatttcattttgacgacgggcaaattattagaggtaaaaagacacttttttcatccaaggagcttaaactgtattcaggtgaatggttaacaatcactggtaaaaatggtgctggtaaaacctctttactagaagctatgttacaactgattaaatatgaaggtgacatgttttatcgcgatcaattattatctaaaattaaacaagcggcaaagcatatgtatttggtatatcagaaccctgaattacaatttattactaattctgtttatgatgaagtgtatattcattataatcacttagatcctaagcatgcgaatgatgaaaccatggatctgttaaaattattacatttagatcaagttaaggatcatcatccttttgaaatatcaacaggtcaaaagcgtcgtttaagtgttgcaacagcattaagttcaaaggcagagattattttactagatgaaccaacattcggcctagatagtcataatacatttcaacttattaagttatttcaagaacgcgttaatcaaggtcaaacaattatcatggtgacacatgatccagaaattattaaacgatatccaacaagacgattacgcgtggaagatggatgtcttaaagaaatggaaggtgaacacattgtttga

SEQ ID NO: 1916 - DNA, 414 bp, Staphylococcus epidermidis
ggagtaagtgtaatggctgtagaaaaaatttatcaaccttatgatgaagcgacacaaaccagtatcccacaaagacaaccacaatcgagtcctgaaaaacaaaccgttaaaagaaaagttgttgttcaacttactagatttgaaaaaattttatacatagctttaataactgtaattgctctaataagtatttatatgctatctttaaaaatggatgcgtacgatacgcgaggaaaaattgcagatttagatcaaaaaatagagaaacaatctagtgagaacagcgcattaaagtctgaaattaagaaaaattcttcatatgaacgcatttacgacaaggctaagaagcagggcatgagcctagagaacgacaatgtaaaggtagtgcgtaataatggcgaagcgaaaaattaa

SEQ ID NO: 1917 - DNA, 891 bp, Staphylococcus epidermidis
atgagaggtgtctttttgaagactggtcgaatcgttaaactaatcagtggtgtgtatcaagtagacgtagaaggtgagagatttgataccaaaccacgtggtttattcagaaaaaagaagttttcacctgtggtgggcgatatcgtagattttgaagttcaaaatacaaaagagggctatattcatcatgtacatgaccgaaataatgaactaaaacgaccacctgtaagtaatattgacgagttagttatagtaatgagtgcagtcgagcctgaaatttcaacacaattattagatcgctatttagtgattgctcattcttatcatctcaaacctagaattttaatcactaaacatgatttagcttccgaacaagaaattcttaaaatcaaagacacaataaaaatatatcaaaaaataggatatgctacgcagtttattggaaaagatagtaattatactgctactgttgatgaatggtctgacggtttaatagtattaagtggccaatctggagtgggtaaatctactttcttaaatagttatcagcctcagttgaagttagaaacaaatgatatttctaagtcattgaataggggtaaacatactacaagacatgtcgaattatacgatagaaaaggtggttacatcgctgatacaccggggtttagtgcgttagattttaatcatattgaaaaagaacaactaaaagatttttttattgatattcatgaagctggagagcaatgtaagtttcgtaattgtaatcatataaaagaaccacaatgtcatgtcaaagcactcgttgaaaaaggagaaattccacaattcaggtatgatcattatcagcaattatataatgaaatttccaatagaaaggttcgatactaa

SEQ ID NO: 1918 - DNA, 222 bp, Staphylococcus epidermidis
aataaatgcttatatattttcctagctaaaatgataatgacttttttatttaatcacacgactacacttaaacgattaaaagattttaaatactttaactgtaatttaataatactttggttatctgtgacacatccagttacttttaagaattacaatgcaactaatattatgatattcataatgtcaacgaatacaaatacttgttcaagaacgttataa

SEQ ID NO: 1919 - DNA, 2784 bp, Staphylococcus epidermidis
agttcttttttatcattacaaggagtgaatttaatgaattacaaagataccctattaatgccgaaaactgattttcctatgagaggtggcttaccgaataaagaaccacaaattcaagaaatgtgggataatgatgagcaatatcgcaaagcgttagaaaaaaataaaaataatccatcattcattttgcatgacggaccaccatatgctaatggtaatttacatatgggacatgcattaaataaaatcataaaggattttattgttcgttataaaacaatgcaaggcttttatgcaccgtatgtgccaggttgggatactcatggtttaccaattgaacaggctttaactaaaaaaggcgttgatcgcaaaaaaatgtcagttgcagaatttagagagaaatgtaaagaatttgcattaaagcaaattgacattcaaaagaaagattttaagcgccttggtgtacgaggtgattttaataatccatacattacattaacacctgaatacgaagccgcacaaataagattatttggagaaatggcagacaaaggtttgatttataaagggaaaaaacctgtgtattggtcaccttcaagtgaatcatcacttgcagaagctgagatagaatatcatgacaaacgttctgcatcaatttacgttgcttttgacgtcaaagacagtaaaggtaaagttgattctgatgcccaatttattatttggacaactacaccatggacaattccatcaaatgtggcaattacagttcatccagagctaaaatatggtcagtataatgttgatggacataaatacatagttgcccaagcattatcagaagaagtcgcagaagcattaggttgggataaagattctatacaattagagaaagaattcacaggtaaagaattggaatttatagaggcacaacatccattcctagatcgtgtatcattagtaattaacggtgaacatgttacgacagacgctggtacgggatgtgtccatacagctcccggtcacggggaagatgactatattgtaggtcaaaaatatgatttaccagtaattagtcctttaaatgataaaggtgtattcactgaagaaggtggaccatttgaaggaatgttttacgacaaagcaaacaaagctgtgactgatcttttaaaagaaaaagacgcactacttaaacttgactttattacacatagttatcctcatgattggcgtacgaaaaaacctgttatctttagagctacaccacaatggtttgcatccattaataaagtaagacaggatattcttgatgcaattgaagacacgaactttaaagtagactggggtaaaacacgaatttacaatatgattcgcgatcgtggcgaatgggtaatttctcgtcaacgtgtatggggcgttcctttaccggtattttatgctgaaaatggcgacatcattatgactaaagagacagtaaatcatgttgcagatttatttgaaaaatacggttcaaatatttggtttgaaaaagaagctaaagaattacttcctgaaggatttagtcatcctggaagccctaacggtgaatttactaaagaaactgatattatggacgtttggtttgattctggttcatcacaccgtggtgtattagaaacgagacctgaactttcattcccagcagacctctattttgagggtagtgatcagtatcgcggttggttcaactcttcaattacaactgctgtagctactcgtggtcaagcgccgtataaattcttgttatcacatggctttttcatggacggtgaaggtaagaagatgagtaagtcattaggtaatgttatagttcctgatcaagttgttaaacaaaaaggcgcagatattgcacgtttatgggtaagtagtactgattacctttctgatgtgcgtatttccgatgaaattcttaaacaaacgtctgatgtatatcgaaaaattcgaaatactttaagatttatgttaggtaatattaacgatttcaaccctgaaacggatagtattgctgaaacaaatttacttgaagtagatcgctatttgttaaatcgtttacgtgaattcacagcgagtacgattaataactatgagaattttgattatttgaatatttatcaagaagttcaaaactttatcaatgttgaactaagtaacttctatttagattacggtaaagatatactttatattgagaaaaaagattctcataaacgtcgtagcatgcaaaccgttttatatcaaatacttattgacatgacaaaattactagcaccaattttagtgcatacagctgaagaagtttggtctcatacgcctcatgtaaaagaagaaagtgtacacctttcagatatgcctaaagttgttgatgtagatgaagaattgttagaaaaatggaatacatttatgaatttacgtgatgatgttaaccgtgcattagaacaagcacgtaatgaaaaagtaattggtaagtcattagaagctaaagtggttattggaaacaatgaaacatttaatacagcggaattcttacaacaatttaatgacttacaacaattattcatcgtttcacaagttgaagttaaagataaagtaaatgatggtgtatcctatcaatatggagatatccatattaaacatgctgaaggtgaaaaatgtgaaagatgttggaactatacagaagaattaggttcagtaggtgaacttgaacatttatgcccacgatgtcaagaagtagtaaaaactttagtataa

SEQ ID NO: 1920 - DNA, 1356 bp, Staphylococcus epidermidis
atggattcagtagaaatagctcgattgttgacgggtatgacacttgcagtgcatatcatatttgcaacaattggtgttggtatgccacttatgtttgcaatagcagagtttattggcataaagaaaaatgatgcgaattatatcacattggctaaaagatggtcgaaaggctacacgataaccgttgctgttggagtcgttacaggtactattattggtttacaactttcacttgtctggccaacatttatgaaaatgggcggtcatgttatcgcattaccactattcatggaaacttttgcattcttttttgaagcaatctttttaagtatttatttatacacttgggaaagatttaaaaataaatggacacattttttcatatctatacccgttattataggaggttcattctcagcattctttattacatcagtcaattcatttatgaataccccagctggttttgaaattaaaaatggtcgtatggtaaatgttcagccattagaagcaatgtttaattcatcgtttatggttcgtgctttacatgtagttgcaactgcaggtatgacgatggcgtttatattagcagccatcgcagcgtttaaattattacgtcataatcatacagaagatagaacataccatacaaaagctcttaatttaagcatgattgttggattcatcaataccgttctttcgatgattgcaggagatttatctgctaaatttttacacaaagttcaaccagataagcttgcagcatatgaatggcattatgatacgcaatctcatgcgaatttagttcttttcggtgtattaaatgaaaaaacacatgaagtttcaggagcactagagattcccggattacttagttttttagcagataatagctttaatacaaaagttaaaggtttaaatgaatttcctaaaaatgaattacctcctatgatagtgcattactttttcgatttgatggtatcaatgggaatattctgttttatcatttcaggactatatatgttatttttaattgttaaaaagttacgtaaatatgtaactagtaatatgatgttatacgctatcttgttaactggtcctgcatcaatgttagcgatagaatttggttggttcttaactgaaatgggtcgtcaaccgtggattatacgaggatatatgcgcgtatcagaagctgctacccaggcggggggaatcacattagtaacgacgctattcggtttactatatcttttattactagttacttcggcttatgtactaattagaatgtttaaaaatcaacctgcttataaagatgtagaaaaagtgattaaagagagaggtgaaacaaaatga

SEQ ID NO: 1921 - DNA, 147 bp, Staphylococcus epidermidis
tcctgttcagttaactttaacgtattacacttcatgtatttactccttcattatcactattcctcatatagtataaagattatatttctcattgacaatttaacggcttataaattaatttatctaaattttttacaaatcaactaa

SEQ ID NO: 1922 - DNA, 309 bp, Staphylococcus epidermidis
aaaataaaagtatatgaaggagaggacactatggaatatcaatatccattagatttacattggactaatgatgaaatgatgaaagtaattcatttctttaataaaatcgaaaattattatgaggcatctgtaaaaggtgacgaagttttaaatgcttataaaaattttaaacatattgtgcctggaaaagctgatgaaaaacagatttttaaagaatttgaaaataaaagtggttataatagttacaaagtagttcaagaaattaaaaaaaatccaaatcaaactttatttagtaaagatttcgactaa

SEQ ID NO: 1923 - DNA, 1026 bp, Staphylococcus epidermidis
tttttaaaggtaaattcaaaatgtactatacaagtgaggatgaatgaaatggttaaaattgcagtagatatgatgggcggggatgatgcgcctggtattgtattagatgcagttaaaaaagctgtcgaggactttaaagatttggaaattattctttttggtgacgaatcacaatacaatttaagtcatgagcgaatagagtttagacattgtactgaaaagattgaaatggaagatgaaccagtacgtgcaattaaacgtaaaaaagatagctcgatggttaagatggctgaggcggtaaaatcaggagaagctgatggttgtgtatcagctggaaatacaggagctttaatgtcggctggattatttattgttggacgtattaaaggcgtagcgagacctgcattagttgtaacattgcccactactgatggcaagggatttgtgttcttagatgttggtgccaatgctgatgctaaagcagaacatttactacaatatgcgcaattaggaaatatttacgctcaaaaaattcgtggtattcaaaatccttcggtgtcacttcttaatattggcactgaagcagctaaaggaaattctttaactaaaaaagcatatgatttatttgagaaaaatcaatcatttaactttacaggtaatattgaagcaaaaacacttatggatggaaatgttgatgtcgtagtaacagatggttatacagggaacatggttcttaaaaatcttgaaggtactgcaaaatctataggtaaaatgttgaaagaaacaataatgagtagcttcaaaaataaattagctggtgcagtattgaaaaaagatttagaaacatttgctaagaaaatggactactctgaatacggtggatcagtattattaggtttagatggtacggttgtaaaagctcatggcagttcaaacgctaaagcattttattctgcaattagacaagcaaaaattgctggtgaagagaatatcgttcaaattatgaaagatacagtaggtgagtaa

SEQ ID NO: 1924 - DNA, 831 bp, Staphylococcus epidermidis
tgggaaggggtgattagtgtgaaatggtacggaaaattatatatagctctattaataagtgtgctttatattcccattttctttttaatgatttattcttttaattctgcgggtaatatgagtcacttcgaacattttactttagaacattaccactccctttttcataatgatcggttgatgtcggtgatttttaatacagttgcagtggcacttttatctgcatcgattgctacagttataggtacatttggtgcgatcgctttatattacttacgcaacaaacggtttaaggttacgctattaacgatgaataatgtattaatggtatcttcagacgtagtcattggtgcttcttttttaattatgttcactgcaataggacatttcacaggtttaggtttaggattttcaacagtgctagcatctcatatagcgttctgtattccaattgttgttatcatcgtcttaccccaattatatgaaatgaatgataacatgttaaatgcagcaagagatttaggtgctaatgaatcacaattattaactagcattatcatacctaatattatgccctcgattataggaggattctttatggcattaacatattctctagatgattttacggtaagcttctttgttactggaaacggatttagtgtattgtctgtagaagtttatgctatggctcgaaaaggtataagtatggagattaatgccatttctacaataatatttattgctattatgtttggagtatttggatattactttattcaacatatcgttaatcgtcagaaaaagatgaagcgaggtgttaatgaatga

SEQ ID NO: 1925 - DNA, 1512 bp, Staphylococcus epidermidis
ctaaaatcattaaatagaggagtatcttatagaatgaaaaaagcaatattaagcgtttctaataaaagtggaattgtagagtttgcaaaagcattaactaatttagactatgaactgtattctacgggtggtacaaaacgtgtattagaagatgcgaatatcaatattaagtccgtgtcagaattaacacaatttccagagattatggatggtcgtgttaaaacactacatccagcagtccatggtggtattttagctgatcgagataaagaacatcatttagagcaattacgagaacaacatattgatttaattgatatggtagtagtcaacctatatcctttccaacagactgttgctcaacctgatgtaacagaaactgatgcaatagaaaatattgatattggtggacctacaatgttaagagcagctgctaaaaactttaaacatgttacaactatcgtacatccttccgattacaacgaggtaattgagagaattaaaaatcatcaattggacgaagcatatagaaaatcgctaatggttaaagttttccaacatacaaatgaatatgatcatgctattgttaactatttcaaagacaataaagaaacactaagatatggcgaaaatcctcaacaatctgcatattttgttagaacatctgatagcaaacatacgattgctggtgcaaaacaattacatggtaaacaattgagttttaataatattaaagacgcagatgcagcgctcagtttagtaaaaaaattcaacgagccaactgctgtagcagtaaaacatatgaacccgtgtggagtaggaattggacagtcgattgatgaagcatttcaacatgcatatgaagcggataatcaatcaatatttggcgggattatagcattgaatagaacggtagatgttaaattagctgaagcattacattctatctttttagaagtagttatcgcacctcaatttactgaggaagctttaaaaatattgacacaaaagaaaaatattcgtttattacaaatagatatgacaattgataacgctgaacaagaatttgtttccgtttcaggtggttacttagtacaagataaagataataaagatgtgactcgaaatgacatgactgttgctaccgacattcaacctacagaagcacagtgggaagctatgctcctaggttggaaagttgtaagtgccgttaagagtaatgcagtgatattgagtaacaacaaacaaacagttggtataggtgcagggcaaatgaatcgtgtaggttccgctaaaattgcaatcgaaagagcaatagaaattaacgataatgttgcgcttgtttcagatggtttcttcccaatgggagatacagttgaatatgctgccgaacatggtattaaggcaattattcaaccaggtggttcaattaaagatcaagattccattgatatggctaataaatatggcattacaatggttatgacaggtatgcgtcattttaaacattaa

SEQ ID NO: 1926 - DNA, 396 bp, Staphylococcus epidermidis
cgtaatacattatccgcttctttaaatgcttccatcattggcgtagatttgtcaacgatatctaataagcgatcatttggaataacaattaatgtatccactgctgctttcatagattctacgccagctgccgcttgtgtttggcgcttacgaccttcgaaaccgaatggacgcgtaacaacacctacagttaaagcacccatttcttttgctattttagcaacaaccggtgcagcacctgttccagtaccgccacccataccagcagttacgaataccatatcagcaccttggatagcgtcttcaatttgttctcttgattcttctgctgctttcttcccaatttcaggattagcaccagcacctaatccacgtgttaatttctcaccaatttga

SEQ ID NO: 1927 - DNA, 156 bp, Staphylococcus epidermidis
aaagatacatttagtaagtcggatatcgagtgtcgttttgagtatcatatcggtttttatatatttacaaattggactttatttattatcgctatatccgcattcatttatacagtaccaattatctcaatcgctagtaagtcgagttgtgattga

SEQ ID NO: 1928 - DNA, 939 bp, Staphylococcus epidermidis
tactttaaattaatgatggggtgtttatcattgtttagaaagcaaaaccttaaatggttaggtgttttagctacgattattatgacctttgtacaattaggtggcgccctcgtaactaaaacgggatcagaagatggttgtggctcgtcttggcctttatgtaacggcgctctacttccagaaaatttaccaatacaaacaattatagaactgagtcatcgtgcagtatcagccatttcacttatagttgtattatggcttgtaattacagcttggaaaaacattggatatattaaagaaatcaaaccactctctattattagtgttggttttttattagttcaagcacttgtaggtgctgctgctgtgatatggcaacaaaatccttatgtattagcgctacattttggtatttcacttatcagtttctcttctgttttcttaatgacattaattattttctcaattgacaaaaaatatgaagctgacattttatttattcacaaacctttacgtatcttaacttggttaatggctatcatcgtatacttaactatttatacaggtgctttagttagacatactaaatcaagtcttgcttatggtgcttggcctattccatttgatgatatcgttcctcataatgcgcatgattgggtacaattttcgcacagaggtatggcgttcatcacttttatctggattatgattacatttatacacgctattaagaattattcagataatcgaactgtacgttatggttatactgcatcatttatacttgttatccttcaagttattacaggtgctttatcagtcataactaatgtcaatttaattattgcgttattccatgctttgtttatcacttacttattcggaatgattgcttattttattttactaatgttaagaacgacgagaagtctaaaataa

SEQ ID NO: 1929 - DNA, 651 bp, Staphylococcus epidermidis
caatttaaattatatgtttcgcaggggggactctttttggctcaatcaaagaatgaattttaccttagaagattacattcgttattaggggttattccgataggtgcatttttaattgtacacttaatggtaaaccatcaagcaacgcaaggtgctgaagcttttaatagagcttcaggatttatggaatctttaccattccttattgtgatggaatttatacttatttatataccattgttataccatggtttgttcggtttacacatcgcattcactgctaaggagaacatcgggcattactcattatttagaaactggatgtttttcttccaacgtgtaagtggtattttagcatttgtttttattgcaatgcacttatggcaaacacgtttgcaaaaagctttttatggtaaatctgtggactataatctaatgcatgaaacattacaacatccgttatgggcaatcttttacattatttgtgtcattgctgttgttttccattttgctaatggtttatggtcattttgtgtaacatggggctttttacaatctaaaaaatcacaacgtgtttttacttggatttcactcatagtatttttagtgatttcttatattggtgttgcagccgttattgcgtttatataa

SEQ ID NO: 1930 - DNA, 129 bp, Staphylococcus epidermidis
ataattaaattgcaatttgaatgttattttattaatcatataacaaatgcccggttacacttcagattgaagttccgggcattcgttatatataatttattgaagactaaccttgtaaatatggaataa

SEQ ID NO: 1931 - DNA, 180 bp, Staphylococcus epidermidis
atatcaacttctttgattaaaggattctgttttaagttcctaatcgctttatttttactaaaagtatacattcgtgatcgcgaagtaacgttaagttctttctttattttactcgtacttacgttgttattacctttaacatttacatttgatattttactcagtggtgtaaccatatag

SEQ ID NO: 1932 - DNA, 1185 bp, Staphylococcus epidermidis
atgttagaatttgaacaaggatttaatcatttagccacattgaaagttatcggtgtaggtggtggcggaaataacgccgttaaccgtatgattgaccatggtatgaataatgtagaatttattgccatcaacactgatggacaagctttaaacttatcaaaagctgaatcaaaaattcaaattggtgagaaattaacacgtggattaggtgctggtgctaatcctgaaattgggaagaaagcagcagaagaatcaagagaacaaattgaagacgctatccaaggtgctgatatggtattcgtaactgctggtatgggtggcggtactggaacaggtgctgcaccggttgttgctaaaatagcaaaagaaatgggtgctttaactgtaggtgttgttacgcgtccattcggtttcgaaggtcgtaagcgccaaacacaagcggcagctggcgtagaatctatgaaagcagcagtggatacattaattgttattccaaatgatcgcttattagatatcgttgacaaatctacgccaatgatggaagcatttaaagaagcggataatgtattacgtcaaggtgtacaaggtatttcagatttaattgcagtatcaggtgaagtgaacttagactttgcagacgttaaaacaattatgtctaatcaaggttctgcgttaatgggtatcggtgtgtcatctggtgaaaacagagcagtcgaagccgctaaaaaagcaatttcatctccattattagaaacatcaattgtaggtgctcaaggtgtacttatgaacattacaggtggagaatcactgtctttatttgaagctcaagaagcagctgatattgttcaagatgctgcagatgaagatgtgaatatgatttttggtacagttattaacccagagcttcaagatgaaattgtagttactgttatcgcaactggttttgaagataaaccttcttcacaaggtcgtaaagctacaagtactggttttggttcaagtgtaaatagtagttctaatcatcaatctggtgctagtgctaaagaagattcattctctgcacacacttctcattcacaatcaagtgaaagtgtaaatgaaagaagccacactactaaagatgatgatattcctagctttattagaaatagagaagaaagacgttctagaagaactagacgctaa

SEQ ID NO: 1933 - DNA, 141 bp, Staphylococcus epidermidis
aaaaattattctagctactctagttcaaaacaaaaaatccaacaacctcacatgagattgttggatttatttcttgtgttctattatttagaaactacttcttcaccattgtatgaaccacagtttttacatacgcggtga

SEQ ID NO: 1934 - DNA, 597 bp, Staphylococcus epidermidis
tacacctattcatttattggaggtagaatagtgaccaatatagcgatttttgcctcaggatcaggtagtaactttgaaaatattgtaaaacatatccaaacagggcaattatctggtatcaatgtaacggcactgtatacagataatgaaggggtaccctgtattgatagagctaaaaatttaaatattccaattcatattaacaagccaaaagacttttcatccaaatctttatatgaacagcatctacttaaattattatccagtgaggaagttcagtggattgtattagctggttatatgagactagttggccaagacttattacaagcttatgaaggacggatattaaatatacatccctcattattgcctaaattcaaaggtttagatgccataggtcaagcgttagaaagtggagatactgtaactggatcaactgtccattatgtagatagtgggatggatacgggagaaattattgaacaacagcaatgtgatataaaaccggacgatactaaagaacaattagaagatagagtaaaacatttagaatatgaactttatccaagagttatagctaaaatcattaaatag

SEQ ID NO: 1935 - DNA, 1188 bp, Staphylococcus epidermidis
gagaggtattcatttatgaaacttgctacgctaaataaaggcaaagaaacaaagtatttaaaccactatccattaatagatgaagaagatttatttgaacatgatcatcttaaagaaggtgatttgataacactggtgacagagcaacaacaatatatagctactggatatattggaagacaacataaaggattaggatgggtattgagttataatcaaaatgaagagattaacactttgttttttaaacgtttatttgaagctgcattagaagagcgacaatactatttcaacatagaaggtacaaatgcatttagattatttaatgctgaaggtgacggtgtaggtggcctgacaattgataattataacggacatcttttaattcaatggtattcgaaaggaatatataaatttagatttcctatcttagaagcaatcaaagaggtatatgaatacacttcaatttttgagaaaatgcgttttaaaggtacttcctacactggtggctttgtagaaggtaatgctcctgaatttcctatcgttgtagaagaaaattttaccttttataatgtagacctaaacgatggtcttatgactggtatatttttagatcaaaaagaagttagaaaaaaattaagagatcagttttcagaaagacgacacgtacttaacttattcagttacactggagcgttttcagtaatagcagctgaaaatgcaaactcaacaacaagtgtagacttagcaaatcgctctagagggctaactgaagaaaattttggtttaaatggtattaatcctaaatctcaatatatttatgttatggatacgtttgatttttataattatgcaggacgacatggacatcaatacgatacaattgttattgatccacctagctttgcgagaaataagaaaaaaacattctctgttcaaaaagattataatttattaattgaaggagcccttaacattttatcgccaggaggtacattactattatgtacgaattcaagtgcattttctcttaaggcatttaaaaacgtaataaagaaaacattagcccaaaataatattgtatatgaaataaatgaagtaatggggttacctaaagattttaaaactcatcctcactacaaaccttcaaaatatttaaaagcagtatttgtaacaataaaacattaa

SEQ ID NO: 1936 - DNA, 228 bp, Staphylococcus epidermidis
tgtaataattcaatgaatgtgggtcaagcgcgagttgcacattacatccaccttcaatacctaaagcacgaattacttttaaagatacgtctcgtagcatttgatattctacatctgacagtgtttgactcggtgcaacaacgattgaatctccagtatgaatgcctacaggatctatgttctccatattacatactacgattgcgttatcatttttatcacgcataa

SEQ ID NO: 1937 - DNA, 1242 bp, Staphylococcus epidermidis
gtaaagtttttagcttctcaattattcaaaggaggtttttttatcgattacttaggtgttgatattagtaaaagaagtagtgtagttgcacattataaaaatggaaaattccaaaaagagtttttcatccaaaataataaaaatggttacaattatttactcaagtatttgaatgacttagaccacccacaactcatttttgaatctacaggtatctattcaagaggtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgcttaaacaaacagacaacttacctatacatgagttaatattctttgaattaagagaacgcgtccgttttcatctagaaatcgagaatgaacaaaatcgacttaaatttcagatccttgaattactccatcaaacattccctggtttagaaagattgtttagtagtcgatattcaatcattgcactcaacatcgcagaaatctttactcatccagacatggttcttgatatcgacaaggatgtactgattacacatatattcaattctacagataagggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 1938 - DNA, 822 bp, Staphylococcus epidermidis
aaggagttgtccacaatggatccgagtttgattttaccttatttatgggtacttttagtacttgtatttttagaaggattattagcagctgataatgcaattgtaatggcggtaatggttaaacatctaccacctaaacaacgtaaaaaagcacttttttatggcctattaggtgcattcatttttagatttattgctttatttttaataagtattattgcaaacttctggtggatacaagcagcaggtgctgtttacttaatctatatgtctattaaaaatttatggcaatttttccatcaatcaaatgaaaaacatcataaagaaacaggagacgaacatcatttcgatgaaacaggcaacgaaaaagaagtaggccctaaatctttttggggaacagtatttaaagttgaattcgctgatatcgcgtttgcaattgattcgatgcttgccgcattagccatagccgttacattaccaaaagttggcatacattttggtggtatggacttaggccaatttattgttatgttccttggtggaatgataggtgtcatcttgatgagatttgcagcaacttggtttgtagaattgttgaataaatatccaggacttgaaggtgctgcgtttgcaattgtaggttgggtaggtattaaacttattataatggtacttgcacatcctgatattggcgttttaccagaagcatttccacatagtgctttatggcaaacaatcttctgggtagtattagttggcttagttttaataggatggttaacttcagcaattggcaacaagaaaaaaggtaatcaaaaataa

SEQ ID NO: 1939 - DNA, 162 bp, Staphylococcus epidermidis
tatcaaaggtcacaccaccactttagatatacaatttacagaaattttaaaatatatataaaagcttttataacagtatttcaaacaaaatatctaaatataatcagatttaaaaatgaatatttatgtaaaataatggttttattttcattatcaatctga

SEQ ID NO: 1940 - DNA, 126 bp, Staphylococcus epidermidis
ctaaatgggtcagcagtacacttagataaacaaatgaacccagaattctattcagagctagaacaaatacaagaacaaaagaatcaaaaacggatagaggtatgcatttataacatgcacatatag

SEQ ID NO: 1941 - DNA, 816 bp, Staphylococcus epidermidis
gtgagattgttaatgttacattataatttttatgaatctaagaaccaaagtaagcaattattggtgatgttgcatggttttataagtgatgctactacttatcattcacatatagaacgcctcgtagaacatacaaacgtgctcacaattgacttgcctggccatggcttagatacttcatctatggacgaagtgtgggatttcccgtttattacacgtcaacttgatgaagttttaatacaatatcaaacatatgatgtgtttcttctaggttactctatgggtggccgggtagcactttattatgctatacatggtaatgaaacgctatcagggttgctcttagtgagtacttcagcaggtattcaaaatgagacggataaagtagaacgtgcccaagtggatgctgcacgtgcaaaagtacttgaaattgctggtttagatatttttgtgaatgattgggaaaagttaccactttttcgttcgcagtataatctagcacctgagatacgccaaagtattcgcaataatcgcttgaatcaagatgctaataaattggccaaagcacttcgtgattatggtactggtcatatgcctaatttatggccacatctatcattgatacgcattcctactttaattttagtaggggaaaaagataaaaagtttgttcagataggacaacaattagagaatcacttacaagatagtcataaagttcaaatttctaatgtcggacatacaattcatgtggaagatagtacggaatttgatacaataatattaggttttttaaaggaggagcaaaatgactag

SEQ ID NO: 1942 - DNA, 168 bp, Staphylococcus epidermidis
agaggcgcccctgctaagggtgtaggtcgcgagagcggcgcgagggttcgaatccctccgtttccgttatttgtttatacctcgttaaatcccgtaaaacaaaacgttgatttgacggggttttgttatatcttgttatctatcgttaaacctcgtaagttaaactaa

SEQ ID NO: 1943 - DNA, 825 bp, Staphylococcus epidermidis
tatatgcaaccttatttaatttgtctagatctagatggtacattattaaatgacaataaagaaatctcaccttacactaaacaagtattaaccgaattacaacaatgtggacactacgttatgattgctactggaagaccttatcgcgcaagccagatgtattatcatgaactaaatatgagcacacctgttgttaactttaatggagcatttgtacatcatccaaaagcaaacgatttcaaagtgatacatgaagtacttgatgtagaaatttctaaaaatattattacagcacttcaacaatctcatattacaaatatcattgctgaagtaaaagactacgtctttataaatagttatgatccaagacttttcgaaggtttttcaatgggaaatcctaaaattcaaacgggtaatttacttgaaaatcttaatgaagcacctacgtcattacttgttgaagcagaagaagaaaatattcctgaaattaaagatatgttaacacatttttatgcagaaaatattgaacatcgtcgttggggcgcaccgtttccagtaatagaaattgtgaaacgtgggattaacaaagcacgtggaatcaagcatgttcaaaactatttaaacatcgccgacgatcatatcattgcgtttggtgatgaggacaatgatatagaaatgataaagtttgcgacccatggcattgcaatggccaatggcttgaaagatttaaaagaaatagcaaatgagactaagtttagtaataatgaagacggaataggtcgttatttaaatgacttttttaatttgaaaatgcgttattattaa

SEQ ID NO: 1944 - DNA, 1122 bp, Staphylococcus epidermidis
tgcattcgacccaaaaatgcgaaaataaaggaggtaaaagtaatgacagaaacggtattagaagtaaatgatttgcacgtttcctttgatattgctgcaggagaagtgcaagctgtcagaggcgtggattttcatttaaataaaggggaaacgttagccattgttggagaatctggatctggaaaatctgtaacaactaaggcaattacaaaactttttcaaaaggatacaggaagaataaaaaagggagaaatcttatttttaggtgaggacttagctcagaaaagtgaaaaagaactgatacagctaagaggtcgagatatttcaatgatatttcaggatcctatgacttctttaaatccaacaatgcaaatcggaaagcaagtcatggaacctttgattaaacataagaaattaagtaaagcaaaggccaagcaaagagcattggaaattttgaatttagttgggttacctcgtgctgaaaaacgatttaaagcttatccacatcaattttcaggaggacaacgtcagagaatagttattgcaatagcattggcatgtgagcctaaaatattaattgctgatgagcctacaactgctttagatgtgacaatgcaggctcaaattttagatcttatgaaagaactacaaaataagattgaaacttcaattatctttattacgcatgatttaggcgttgtagcaaatattgcggacaaagtagccgtaatgtatgggggacagatggttgaaacaggggatgtgaatgaaatattttatgatcctaaacatccctatacctggggattgctttcttcaatgcctgatttaacaaccagtaatgacacggacttaattgcaattccaggtacaccaccagatttacttcatccaccaattggtgatgctttcgcacgtagaagtcgatatgctttagatattgattttaaagaagaaccaccttggttcaaaatttcacccacacattttgttaaatcttggttattagatgcaagagctccaaaagttacgccaccttcaatggttcaaaaacgattaagaacaatgccaagtaattatgaacaaccacatagagtagagagggtggcttttaatgagtaa

SEQ ID NO: 1945 - DNA, 240 bp, Staphylococcus epidermidis
ataaagaagccagtaaatgaatttatgaaaactcatttactgtctattttgataggaattatgtcccaggctcatcgcagtgtggagaaaccttcagtattatcgttaatacttttacgtggtgataataataaacatacacatttgtttgtagaatttgaggagttcgacagagcaaatgaagaaaaacacgcaaaagttgaatatcatagttctaaaaataaaacagatacattataa

SEQ ID NO: 1946 - DNA, 129 bp, Staphylococcus epidermidis
gtctattatacacgttttattatcgttgataaatttataattataagtcttattaatttatttttaatcataattgacgtaatatatccgaatcacgttctattagatagtgataaaatcattcattaa

SEQ ID NO: 1947 - DNA, 240 bp, Staphylococcus epidermidis
aataaccatacggaggtagacataatgaaagttaacaaaacaatttatattatagttgcattgattttaggtggtctgggcgtgcataaattttatgccgaccaagttggacaaggtattctacatctcgtctttttctggactggcattccaagtgttgtcgcaatcattcatgctatcattgttatttttactaaaaaagcagatgaatacggctacataacttttgataaaaaataa

SEQ ID NO: 1948 - DNA, 621 bp, Staphylococcus epidermidis
tcaagaaggttaattaaaatgaaaaatgtttctaaagctttgatttggtttgttataagcttcatcatctttcacgcaatattatttgtgatgtggggagaacatcaagaatactggtatttatatactggcattatgttaatagctggaataagttatgttttttaccaaagagacattgcatctaaacgattattaacttccataggcatgggtataataacgagtgtcgcacttattattatacaattaattttttcacttatttcatcagaattatcatacgcatctttaatcaaagaattatcacgaacgggtgtctactttaaatggcaaatgctcgttactttattatttgtgataccttgtcatgaattatatatgagaactgttttacaaaaggaattaataaaatataacttaccgaaatgggctagcattttaattgttgcaatatgttcaagttcattatttatatacttagataattggtggattgtattctttatttttgtagctcaattcattctatctcttagctatgaatatacgagacgtattgctacgactacaattggtcaaattgtggctatcattttattattgatattccacggataa

SEQ ID NO: 1949 - DNA, 1722 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattcccgagactgaattcgatgaattcagacatcatcgaggtgcaacatcataccatccaaaaatgatgttaaaagtagttttatatgcctacacccaatctgtgttttcaggacgtaagatagaaaaattactcaatgatagtatccgaatgatgtggctatcacaaaatcaaaagccttcttataaaacgattaatcgatttagagtaaatcccaaagtagacgctttattagaatcattatttattcaatttcatagtcagtgtttgaaacaaaatcttattgatgatcaggccatttttattgatggtacgaaagttgaggcaaatgccaatcgatatacatttgtatggaaaaagagtattcaaaaccatgagtcaagaatgaatgaaaactctaaagcactctatcatgaattggtgataaataaaatcatacctgagattaaaaaagatcatgataatgacttaacaaaagaagaaatagatttgattggtagtcatttagataaagaaatcgaagatttaaaccaacatatcgataatgaaaaatgtactaaaataagaaaacaaatacggctcaaaagaactaaaattaaaaaatacaaaaagcaaattaatgattactctcagcgaaagcataaatacgaagtccaaaaatctattttaaaggatagaaatagttattctaaaacagatcacgatgccacatttatgagaatgaaagaagatcatatgaaaaatggacaacttaaaccggggtataatttacaaatagcgacaaattctcaatttgttttattttatgatgtgtatcaaaatccgactgatacaagaacaatgataccttttttaaatacaatacaagagacctacggtcatttacctgaatatattgtagctgacgcaggttatggtagcgaagccaattatatggcaattatagataattttaatcgaacgccactcataacttatggaatgtttataaaagataaaactaaaaaatataaaagtgacatctttaatactcaaaattgggattatgacgaaattaacgatgaattcatttgtccgaataataaaagactaggatttaaaagatatgcctatcgtcatgataaatatggttttaaacgagactttaaattatatgaatgtgatgattgttcagaatgccctctgaaacaacaatgtatgaacttcaattcaaaaacaaataaaaaaataatgaaaaattataattgggaatattttaaagcccaaattaataaaaagctttcagaaccaaaaacaaaaaccatctacagtcaaagaaaaattgatgtggagcctgtttttggatttatgaaggctattttgggtttcactagaatgtccgttcgagggatagataaagccaaaagagaattaggatttgtgctaatggcacttaatataagaaaagtaacagctcaacgagctgaaaataatcaaaaaaataataaaaaagacaatttctatattatttcaatagaaattgtctttttttacttatcctgggactttatgtcccacactcattatgagcaaaaggaaatctgttttaataaataa

SEQ ID NO: 1950 - DNA, 153 bp, Staphylococcus epidermidis
aataaattaacgaagttccttatgtataaagattataataagactcaacttactttaccaatagaaacttcagttcttatccccacaaatgatattcacgacatgtacctgactcattctttttttggtgatgaactaattatgaatttataa

SEQ ID NO: 1951 - DNA, 1356 bp, Staphylococcus epidermidis
gtacttataacaggaggcaataagatgactcacattcaattagactatggcaaaactttagaattttttgataagcatgaactagatcagcaaaaggatattgttaaaactatccatcaaactattcataaaggtacaggagcaggtaatgactttttaggttggttagatttaccagttgattatgataaagaagaattttctagaatcgtcgaagcatctaaacgtatcaaatcaaattccgatgtacttgttgttatcggtattggaggttcatacttaggtgcacgtgctgcaatcgagatgcttacatcttcatttagaacaaatacggaataccctgaaattgtatttgtaggtaatcatttatcctcaagttatacaaaagaattacttgattatttacaaggaaaagatttttcagttaacgttatttcaaaatcaggtactacgacagaaccagcagttgcatttagattatttaaacaattggttgaagaaaaatatggaaaagatgaagctaagaaacgtatttatgcaacgacagataaatctaaaggtgcacttaaacaattagcagacaatgagggttatgagacgtttgttgtacctgatgatgtgggaggtcgttattctgttcttacagctgtaggattactaccaattgcaactgcaggtatcaatattgaatcaatcatgattggtgcggctaaggcacgtgaagagttatcttctgatgatttagatcaaaatatcgcatatcaatatgcaactattcgaaatattttatacagcaaaggttatactactgaaatgttaattaattacgaaccctctatgcagtatttcaacgaatggtggaaacaattatacggtgaatcagaagggaaagatttcaaaggtatttatccatcaagtgcgaattacacaactgatttacattccttaggacaatatgttcaagagggccgtcgtttcttattcgagacagtggttaaggtcaaccatccaaaacatgatatcaaaattgaagaggatgcagatgatttagacggactgaactatcttgctggcaaatcaatcgatgaagtgaatactaaagcatttgaaggtacattacttgcacataccgatggtggcgttccaaatatcgttgtaaatattcctcagttagatgaagaaacatttggatatgttgtttatttctttgaattagcttgtgcaatgagtggatatcaattaggtgttaatccatttaatcaacctggagttgaagcctataaacaaaatatgtttgcgctattaggtaaaccaggctttgaagataagaaaaaagaattagaaaatcgtttataa

SEQ ID NO: 1952 - DNA, 126 bp, Staphylococcus epidermidis
aatgaaaaaactagtatgaaattaatttgtatacgagcttgctataaatttaaaagtattataagtattgatacaatagtattaacattacaagggagcatcggtttatgtcggagtttaaagtag

SEQ ID NO: 1953 - DNA, 168 bp, Staphylococcus epidermidis
acacttgaaacgctatatcaaacagtaaaaatagaagagttggatgagtttatatttattatattcaatcaactcttttctcatcctaggttctttcaatataaaaatgttgaacatcataacaagaaattttatacatctaaagatttagctttatctgttatttga

SEQ ID NO: 1954 - DNA, 165 bp, Staphylococcus epidermidis
aaattgatgacagtgtttcaatttaaaatatgcggaacgttaatattaaataagtgtaaatgttccgtatatttttttaatataactcttgaaaaattcaacaagattgatataataatacttgtgcttgatagagacagattaattattatttatccgcagtag

SEQ ID NO: 1955 - DNA, 135 bp, Staphylococcus epidermidis
ttgacaaagaccaaattgttggaaaggtatcgctcagatattggcctttcagtgaatttaaatctaactttaatccaaataacactaaaaattaaatatcaatcaactttggagatttctattcatgcgttttaa

SEQ ID NO: 1956 - DNA, 1023 bp, Staphylococcus epidermidis
aaaaggagagcgtttatgacagccatcaaagatagggattattttttcgataatgctcgagcaatattgatatttctagtcgtattaggacatttattacagccttatacatctgaagataaatttttacaagctttatatttattaatatatagctttcatatgcctacctttctgtttatctcaggctattttgctaagaatttagataaacctaactatttagaaaaaattgcaaaaaaattacttcttccttatgtaatattttttgcgtttttctcactttattactatttcactggtaaagaagatgcaattcaattagacccatttaatccggtttttgcattgtggtttttactcaccctttttttctttcacgttgttttagttatagtgagaaggtataatccgtatattgtattattcatatccatacttgtttctgtattagctggtttctctggcaatatcgatagttatatgagtatatcaagaaccattgtgttcttccctatcttctttataggacatttggttacacaatcacatacggaaaaacttagaaataaaaaatggatccccatttcaataatcattctgattaccttctttataggatacacaatccatcctattaatggagattggttattaggaagtacaccttatacttctttagaaagtaacggggaggatgtttatagtcctctaaaacgcttattactctatatcattatacttttaactatgtgtgcatttctaaatctaatgccacaaactaagcgtatttatacatatataggacagcgcacaatgtttgtttatttattacacggtatcgttataggagtcattcgcgggtttgatttatatccatttaaggatcagatttctatctttacctatctttatttatttatcagtgcgagtgtgattgtattaatattatcttcaaaatgggtttgcaaatggacgaatccgttcattaatttaaaaaggccctctcaatttaaaaattaa

SEQ ID NO: 1957 - DNA, 804 bp, Staphylococcus epidermidis
aaatacatggctgaagaattaagaatcatggagaataagagtcgtgaagatactaatctatcacctgttagcaaaatagaaatctattctttttttgatccttttagcaaagattgttttaaattatctgcaatcttatcaaaattaagaattgaatataataaatatataaagataagacatattttaaacccttctttaaaggtattaactaagtgtcaagctcaaagtacttcagattttgacaatattgcacttgcctataaagccgctgaacttcaaggtcgtatcagagcagaaagatttatacatttaatgcaaaatgaaatcattccaaaacgtgatattattaccgaagatatgatttctgattgtattaataatgccggcattgactatcaagtttttaaagaagacttgcaaaaggacaagttgactgacagcttgaaagttgatcttcacattgcaagagaaatggaaatagaacaagctccctcacttgtttttttcagcgaaaatgttcatgaagaaggtttaaaagtcgaaggattatatccttatcatatttatacttacattattaatgagttaatgggacaacctatagagaaaaatcttcctccaaaattagaatactacattcaaaagaaacaactagtaacaatggaagaacttttaacgatctatgaatggcctgaaaaattgctaaataaagaattaaagaaactcacacttcaacaaaaagttgaaaagttgcaatatccagagggagaattttggaaatctaaaatgcctcagtgttaa

SEQ ID NO: 1958 - DNA, 228 bp, Staphylococcus epidermidis
gcacttaattttgtgagaaagggagatagatttgttgtagagtctattgaccgtttgggacggaattatgatgaagtgattcataccgttaattatttaaaagacaaagaggttcaattgatgattaccagcttccctaggatggatgaagtcattggcaagccattactgtatatagaaagccatgcgctatgtgtatggttcagaaaaggttttaccgttatctaa

SEQ ID NO: 1959 - DNA, 141 bp, Staphylococcus epidermidis
atacaaaatttttttgaacaggctaaagaatttttagaacaagaatacgggaaagataatttgttatacgcaaagcttcatatggacaaacgcctcacgtgcactttgaaattgtaccaattacagaagatggacgattaa

SEQ ID NO: 1960 - DNA, 126 bp, Staphylococcus epidermidis
cttgttttttattgttatccactagaagaccactcctatagtttctttaactcattctttatctgtaaaattcaagttattttaatactatatatcatcatcattttaaattcgtttataatctaa

SEQ ID NO: 1961 - DNA, 372 bp, Staphylococcus epidermidis
gaagctctttattttggagcaacaggtgttttaagctatcgaaaatttttcccatttatttataatttgtttcaaaaaggatactttgaaaattcactaacaattattggcagtggtttaaatgagttaactactgatgaatttagagaaaaagtcaaaaatgctattcaaaataatattgaaaactcaaaggaaattggtgcgtttttaaaacgtttattttataaacaacaggacgctaatagtaaagatagctaccaaaaatttttggaaatgagtttagaactagatgataagtttgacctaaaagaaaatcgattgttctatcttgcaatgtcccctaaatttttggagttgcaacaaaccacttga

SEQ ID NO: 1962 - DNA, 159 bp, Staphylococcus epidermidis
gtaaccatttatagccaccctccgttaatttttaaaatttataataattgtaacgtattttcatgcattgtaaaaggaaaagaagtgtaccatttattgtatttaaatactataaataaggcgtacaataccatgctttgtcgtaaatttgctttataa

SEQ ID NO: 1963 - DNA, 906 bp, Staphylococcus epidermidis
atgaaatttctatcattcaaacataatgacagaacttcatatggtgttaaagtaaaacgtgaagatgctgtttgggatttaccaatggtttttgctgagtttggggacaaagactttaatcctaaaactttaattgcaggtttacagcaaaatcaaactttagactttcaagagcaagttcgaaaagcagttgtcgcagcagaagaaagtggaagagatgaggaatttaaacttttattcactgatattgattttctaccaccagtgacacctcctaataatgtgattgcatttggtagaaattatgaagatcatgctagtgaattaaatcatgaagttgatagtttatacgtatttactaaagcggcttcatctttaactggtgatgaagcaacaattcctaatcataaagatattacagaacaattggactatgaaggcgaacttggaattgtaattggaaaatcaggcgaaaagattcctagaggattagctttagattatatttatgggtacacaattatcaatgatattacagatcgtactgcgcaaagttcacatgatcaagcattcttatcaaaaagtttaactggggcatgcccaatgggcccttatatagtaaccaaagacgaattacctgcgccagagaatgtaaatatcgtaacaaaagtgaataacgaaattcgacaagatggcaacactggtgagatgattttaaaaatagatgaactcatcgaaaagatttcaaaatatgtagctttacatccaggcgatatcattgcaactggtacacccgctggtgtgggtgctggtttacaaccaccacaatttttacaaccaggtgatgaagtcaaagtaactatagataatattggcactttaacaacatatatatctaaaaattaa

SEQ ID NO: 1964 - DNA, 246 bp, Staphylococcus epidermidis
agagcttcttattcagtagaaacaaagtataaagccgttgaaatgaaagcagcagaattttcaacaaaagaaattatgaaagaattaaatattagaaatagaacacaagtaaaaagttggtggctatggtatcaaaatgaggaaagtatgtttgttttatatctttatcctcagtcattaattatttgtctatctttgcatttctctactaaccagtgttataatctagataatgaaaatgattag

SEQ ID NO: 1965 - DNA, 813 bp, Staphylococcus epidermidis
atcatgcgttatacaatccttactaaaggtgattcaaaatcgaatgcattaaagcataaaatgatcaatcatatgaaagattttcaaatggtagaagatagcgaaaatcctgaaattgtcatttcagttgggggagatggaacgttactacaagctttccatcaatatagtcatatgttatccaaagttgcttttgtcgggatacacaccggtcatttaggattttatgcagattggttacctcatgaagttgaaaagcttattattgaaattaataattcggagtttcaagttattgaatatccacttttagaattaatagtcaggtataacgataatggttatgaaacgagataccttgctttaaatgaagcaacaatgaaaactgaaaatggctcaacattggttgtagacgtcaatataagaggtaaacatttcgaacgatttagaggagatgggttgtgtatatctacaccttcgggttcgacagcttataataaagctttaggtggtgcgctcatacatccatcacttgaagcgatgcaaattgctgaaattgcatctattaataatagagtgtttagaacagtaggctcgccattagtacttcctaaacatcatacgtgtttaattacgccggtaaatcacgatacgattagaaccacaatcgatcatgttagcattaagcacaaaaacgtcaatgcaatacagtatagagttgctaatgagaaagtgcgttttgccagatttcgtccatttccgttttggaaaagggtacatgactcatttatttctagtgatgatgaacgatga

SEQ ID NO: 1966 - DNA, 1002 bp, Staphylococcus epidermidis
aaacatgaatatgttaaattaatacctggtattaaaaattttttaagaaggtgtacaaccatgaatgtgggtattaaaggttttggtgcatatgcacctaaaaatattatagacaatgcctattttgagcagtttttagaaacttcagatgaatggatttctaaaatgactggtattaaagaaagacattgggcagacgaagatcaagacacatctgatttagcatacaatgcaagtattaaagcgatagaggatgccggcattcagccagtagatatagacatgattatcgttgctacagctactggggatatgcctttcccaagcgtggctaacatcttacaagaaagactaggaacaggtaaggttgctactatggatcaacttgctgcatgttctggctttatgtattcaatgattactgctaaacaatatatacaatctggtgattacaaacatattttagttgtgggtgctgataaattatctaagattaccgatatgactgaccgttctactgctgtattatttggagacggtgctggagctgttgtcatgggagaagttgctgaaggtcgtggtatcattagctatgaaatgggttcagacggtagtggtggtaaatacttgtacttagatagagaaactggcaaactcaaaatgaatggtagagaagtatttaaatttgctgtgagaattatgggtgatgcatctacgcgtgtagttgagaaagctggtttatcgtctgaagacatagacttatttgttccacatcaggctaatattagaattatggaatctgcgagagagagattaggaatagaaagagaaaaaatgagtgtctcagtaaataaatatggtaatacttcggctgcctcaataccattaagtattaatcaagaattgcaaaatggaaaaatcaaagatgacgatactttagtcttagttggcttcggtggaggtctaacttggggcgcaatcgttattaaatggggaaaatag

SEQ ID NO: 1967 - DNA, 126 bp, Staphylococcus epidermidis
ataacaagatataacaaaaccccgtcaaatcaacgttttgttttacgggatttaacgaggtataaacaaataacggaaacggagggattcgaaccctcgcgccgctctcgcgacctacacccttag

SEQ ID NO: 1968 - DNA, 426 bp, Staphylococcus epidermidis
aacaacatgtataaacaacttgaaaaacttatcacactgacaaataatgatttgaatttagttaatagacgctttggtcaacgaactgacattacttctgaacaattagagttactacgtattttatataattatgatcgtttatctcaatacgatttaactatgaagattagtagggaacaatcaattgtatcaagatggattaaaaagttagtccaaaaaggttatatcatgagtcaacaatctcatgaagatttacgatgtaaagaactgatattaactgaagaagcaagggctttaattcagcaaatcaacacggcgagatgcgagttaattgaagcgagatgtcaatgtctatcttcagacgaaattgcaagtttaaatcaattattaaacaaacttaatagtagacacattttcatctga

SEQ ID NO: 1969 - DNA, 1239 bp, Staphylococcus epidermidis
gtcactcatctcaaccggatgaaatctatggaaaggttcctttgtatgcaagattcttcgtcaagtaattactcaagtaacagaaactttgttatgatgttggtaattctgtttctgatggaatttgcaagaggtatgtacatactaagttatataaactttttacctacagtgacctctatcgcaatagcaatcacatcatttgctttttccattcactttatcgcagatgctgcaacaaattttgtcatcggctttttacttaaaaaatttggttcaaaattagtacttacatctggattcttacttgcttttataagcttgtttttagtgatatggttcccggcatcaccattcataattattttcagtgctattatgttaggaattgctgtgagtccgatttgggttatcatgttatctagtgtagatgaaagaaatcgcggcaaacaaatgggttatgtctacttttcatggttgctaggtttattggtgggtatggttatcatgaacttgcttattaaattccatcctactcgttttgcatttttaatggccttggttgtgcttattgcctgggtactatactattttgttaatatcaacttaacaaattacaatactaaacctgtgaaagcacaattaaagcaaattgtagatgttacacaacgtcatcttattctatttccgggtatcttgttacaaggagcagctatagcagcacttgtacctattcttccaaaatatgcaacgcaagttgtgaaagtatcaaccgttggatatacagtagcaatcattattggtggcataggctgtgctttctctatgttatttttatcaaaaatcatcgacaataatagcaaagggtttatgtatggagttatttttagtggctttatactatatacaattcttatattcgggctatctacaattacaaatatatatatagtttgggccataggactttttattgggctaatgtacggtatcctcttaccggcttggaatacctttatggctgggcatattaatcctaacgaacaggaagaaacatggggcgtgttcaacagtgttcaaggcttcggttcaatgataggcccactagtcggaggtctaattactcaatttactaataatttaaataataccttttacttttcagcgatgatttttcttgcacttgcagtattttacggatattactttattaaaacaaacagaagggttaaaccttaa

SEQ ID NO: 1970 - DNA, 213 bp, Staphylococcus epidermidis
aaattgtctcaagcgtcgccaaagctatggttcaactggtcaagaatcagtaaaacatcaactaaaagtcgcaaaagcattattaaaagacaacgaatcaaaatagttattaaaaataatagccatctaaaattacaaaaatttaattttgtattaagttatcaaagtttatataaaaaaaatgtaaaattccctttcatcctttcaaattga

SEQ ID NO: 1971 - DNA, 1176 bp, Staphylococcus epidermidis
atggttactcaaaataaaaagatattgattattactggatcatttggtaacggtcatatgcaagtcacgcaaagtattgtcaaccaattgaatgagatgaatctcaatcatttatcagtcattcaacatgatttgtttatggaagctcatccaattatgacttctatatgtaagaaatggtatatcaatagctttaaatattttagaaatacatataaacgattttattatagtcgccctaatgagctcgataaatgtttttataaatattatggattaaataaactcatcaacttacttattaaagaaaagcctgatctcatattattaacatttccaacacctgtgatgtcagtattgaccgaacaatttaatataaatatccctattgcgacagttatgacagattatcgcatgcataaaaattggattacaccatattcacaaagatattatgtagcaacaaaagatactaaagatgatttcattgaagctggtgttcctgcttcatatattaaagtgacgggcattcctattgctgataaatttgaagaatctattgataaagaagaatggttatcgcaacaacatttagacccttcaaaacctactatattaatgtcagcaggtgcatttggtgtttcaaaaggctttgactatatgattaataatattttagaaaaaagtccaaattcgcaagtggtcatgatttgtggacgtagtaaggaacttaaacgttcattaaaagctaagttcaaagataatccaagtgtaataatattaggatatacaaatcacatgaatgagtggatggcatcaagccaactaatgattacaaaacctggtggtatcacaatttccgaaggacttagtcgttgtattcctatgatttttttaaaccctgcacccggtcaagaacttgaaaatgcatattactttgaaagtaaaggatttggaaaaatagcagacactccaaatgaggcaattgatattgtttctgacttaacaaataacgaagagactttaaaggttatgtcatctaaaatgctagaatcaaaggtaggatattctactagaaagatttgtaaagatttattagatttaataggtcactcatctcaaccggatgaaatctatggaaaggttcctttgtatgcaagattcttcgtcaagtaa

SEQ ID NO: 1972 - DNA, 1194 bp, Staphylococcus epidermidis
tttttcagtcatcatggctacaacgatattattcagtactttatttattgtttcgatctttattgtagacattttatatggtgttatcgatccaagaattcgtgtacaagggggcaagaaataatgagtaataaagaagatgttacaaacattaatggcgatatttctaatgcaacgatgtcacatacaagtaatgatatttcgaatacagattttattattagagatttagacttgaatcaagagccagaaatgccacgtcaaagtaagaatttttggcaagatgcttggtcacaattgaaacgtaataaattagcagtaatcggaatgataggtttgttgcttatagttattatggcatttataggaccattaatgaataaacacgattttgctgagcagaatgttgatcatcgtaatctcccagcaaaaataccattattagatcatgtttcatttttaccttttgacggtaaaggtacggacggtaaaaatgcttacaaagaagcaggtgcgaaagaaaactattggtttggtactgatcaacttggacgtgatttatggacacgtacttggaaaggtgctcaaatttcactttatattggtgtagttgctgcattattagatatttgtattggcgttgtatatggagccgtttctggtttctttggaggcagggtagatgatgtgatgcaaaggattttagaaattattgcttctatacccaatttaattgtcgttattttattcgtacttatttttgaaccatcaatttggactattatattagctatgtcaattactggctggctggggatgagtagagtggtacgtggagaatttttaaaattgaaaaatcaagaatttgttttggcatctcaaacattgggtgcttctaaattcaagttaatctttaaacatatattacctaacacattaggagcaattgtcgttacatcaatgtttactgttccaagtgcaatatttttcgaagcatttttaagctttattggaataggggtgcctgcgcctaagacgtcattaggatctcttgtcaatgatgggcgtgcaatgttgttgatacatcctcatgaattatttattccagcaatcattttaagtttattgattttattcttctatctatttagtgatggactacgtgatgcattcgacccaaaaatgcgaaaataa

SEQ ID NO: 1973 - DNA, 123 bp, Staphylococcus epidermidis
gcgtcattacagaaaagactaggtcatgcaaatattgaaattacttggcgtgtttatagtcatttattaaaagtattaaaaagtgaagaagttgcaatgccggataatataatatatttttaa

SEQ ID NO: 1974 - DNA, 147 bp, Staphylococcus epidermidis
aatatcaaacaaaatataaggggagttaacatgcagaatattattaagagagttattagaattttagtttccggttatattgtcaaaatgatacgaaaccttattttcaaaaattctaacgatagcaataaaaacaatcacaaatag

SEQ ID NO: 1975 - DNA, 525 bp, Staphylococcus epidermidis
aacatgaaacatttgattaaatatttgatttccttcacttttgcaattattattgtaatattcattcaatcatttataatcgtaggcgctgtgatatcaaataatagcatgacacctaccttgcaaacgggagatagagtaatagttaataaaattaaagtcacgtttgaccttattcaacgtggtgatataatcatgtacaggcataataacaaaacctattttagcagaattataggaaagcctggggagtctgtgagtattaaatcacagcgtattaatatcgatgatagacaagtaaatgaaccatatatgaaagacaggcatattaaagacattacattaagagaaattaaaaattctgatggtgatacgattccaccgggagcattttttgttttaaatgataataataacaaacattctgattcaagaacctatggtttaatagataagaaagatatcattggagatgtcagtttaaaatattatccatttaaagaatttaactatcaatttaaataa

SEQ ID NO: 1976 - DNA, 129 bp, Staphylococcus epidermidis
aatatgttgcaacctttgatacatggactattattagctttaggtttaattttacctttaggggctcaaaatgtgtttgtatttaatcaaggagctaaccaaaaaaaattagtaaagcattacctgtaa

SEQ ID NO: 1977 - DNA, 954 bp, Staphylococcus epidermidis
gaggttgtgcatatcatgtcagatcaatatcaacaatattccactgttaagaagtactggcaattgatgagacctcatactttaacagccgctgttgtccctgtactcgttggtactgcagcagctaaaatatatttactcggtagcgaagaccatctgaaattcagtcttttcttagctatgttgcttgcatgtttgttaattcaagctgcaacaaacatgtttaatgaatactatgactttaaaaaaggtcttgatgatcatacctctgtgggtattggtggcgctattgtacgtaatggtatgagtcctaaacaagtaatgaatttagcaattgctttttacatcattgcagcacttttaggtatctttttagcaatacaaagctcattctggattattccagtaggcatagtttgtatggcaattggctatctatataccggtggccctattccaatttcatggacaccttttggtgaactattttcaggattatttatgggtatgattatcatactactttcatttttcatacaaaccggtaatgttcaaggatatgccgtatggttaagtattccaatagtcatcacaattggtttaatcaatatgggtaacaatattcgtgaccgtgttaaagacaaggctagcggtagaaaaactttgcctatacttttaggtaaacgtgcttcagttatttttatggcaataatgtatgccatcgcatacatcattgtcatcattacagccttttttaaacctgcgggatcactattttacttgttagttttattatcattcccaatgcctattaaagcagtgagacgttttaataaaaatgatacacctgaaacaatgatgcctgcgatggctgcgacaggtaaaacgaatacattctttggtttattgtatgcattaggaatctatattagtgcacttttaggtgcaatctaa

SEQ ID NO: 1978 - DNA, 129 bp, Staphylococcus epidermidis
atgtattttaacttaatattagaaaagggtagatttttatattgcaaaagtaagagaataaaacaaaaaaagtcatttatctatatttactatagtactgtaatgcaaaatgatattgcaattgtataa

SEQ ID NO: 1979 - DNA, 603 bp, Staphylococcus epidermidis
tacaaccctaagaaaggatttgatgtattgtcgctttctcagttagaagaatggtttgacgcatttcgacaattcggatatattcctgggttcattatgctttatttaagagccattgtacctgtgttgcctctcactttgtacgtcgtgctattaatacatgcgtatggattgtttccaggtataattatcagttggctaggtatcgtctcaggtacttttactgtctttcttatctgtaagaaatttgtgaatacaataagaatgaaaaaattaaaaagtagaaagtctgttcaaaggctaattagcttcatagatagacaagggcttatccctttattcgtattattatgctttccatttacacccaatacattaataaatattattgcgagcttatctcacatcaaaataaaatattatttttttgtattagttatttctaagttgatttcaattactattctaggagtaatgggaaaagaaattttcaccatatttactaatccattaagagcgcttattatgattgtgttactcgtagtattatggtttattagcaaaaaggtagaaaagcattttatgggttctaccaaggagtaa

SEQ ID NO: 1980 - DNA, 126 bp, Staphylococcus epidermidis
acactttataaagcaaatttacgacaaagcatggtattgtacgccttatttatagtatttaaatacaataaatggtacacttcttttccttttacaatgcatgaaaatacgttacaattattataa

SEQ ID NO: 1981 - DNA, 141 bp, Staphylococcus epidermidis
gaaagtcataaactatataactataaatctcttttggaaatagatggtcgtttagacctaaaaagtaattttgataatcctaaactaatattgaatactaaagttaataataaaagtttaaatcaatatttaatattttag

SEQ ID NO: 1982 - DNA, 183 bp, Staphylococcus epidermidis
aattctaataactctcttaataatattctgcatgttaactccccttatattttgtttgatattttatacccagtttttgtaggagctaaaagtaaaatttgttattttggaaaatatgaagaaatatttttagatgttattttttatcaaaagttatgtagccgtattcatctgcttttttag

SEQ ID NO: 1983 - DNA, 1248 bp, Staphylococcus epidermidis
cgtatgaataaaaataatagagttgttataacgggtatcggagccttatctccaattggtaacgatgctaaaacaacatgggacaatgcactaaaaggtgttaacggtatagataaaatcacaagaatagatactgatgattataatgtacatcttgctggtgaattgaaagattttaatatagaagaccacattgatagaaaagaagctcgccgtatggatcggtttacacaatacgcggtggttgctgcaagagaagcggttaaagatgcacaattaaatattaatgaaaaaaatgccgaccgtattggtgtatggattggttctggtatcggtggtatggaaactttcgaagttgcacatacaacacttgtagaaagaggaccacgtcgagtaagtccatttttcgttccaatgttaattcctgatatggctactggtcaagtttctattgatttaggtgccaaagggcccaatggttctacagtaacagcttgtgctacggggactaattcaataggtgaggcatttaaaattattcaacgtggtgatgcagatgcaatggtgactggtggaacagaggcacctattacacatatggcaatcgcagggtttagtgcaagtcgtgcattatctacaaacaatgaccctgaaacagcttgtcgaccattccaagaaggccgtgatggctttgttatgggtgaaggggcaggtattgttgtacttgaatcattagattcagctaaagagagaggcgctgaaatttacgctgaagttgtaggttatggttcctctggcgatgcacatcatattacagcacctgcgcctgaaggtgaaggtggctcacgagctatgcaagctgctttagatgatgctggaatcaaagctcaagatgtacagtatttaaatgcacatggcacaagtacacctgttggagatttatatgaggttcaagcgattaaaaatacattcggtgatgctgcgaagtcattaaaagtaagttcaactaaatcaatgactggacatttattaggtgctacaggtggaattgaagctattttttctgcgctatcaattcgtgattcaaaggtagcccctacaatacatgcaatcacaccagacgaagaatgtgatttggacattgttctgaatgtagcccaagacttagacattacctatgcaatgagtaatagtttaggatttggtggacataatgcagtgttagtatttaaaaaatttgaagactaa

SEQ ID NO: 1984 - DNA, 399 bp, Staphylococcus epidermidis
ttatcatgtaacagtatcatagcattttattggcgttttgtcggatatttgatatattggtgtaaagaaaattttaaagaggtgatactgatggaagaagcactaaaagatagtatcttaggcgctcttgaaatggtaatagatcctgagttagggatagatatcgttaatttaggtttagtatataaagttgatgttgatgatgaaggtttatgtacagttgaaatgacattgacttcgatgggatgtccattaggaccacaaattattgaacaagttaagagtgttttggctgagattcctgaaatttctgatacagaagtgatgattgtatggagtccaccttggaataaagatatgatgtcacgatatgccaaaatagctttaggcatcggataa

SEQ ID NO: 1985 - DNA, 138 bp, Staphylococcus epidermidis
ttagatgtccttggcttttttatacacgtaagcaatgaaacatgtcctcttattaaactccgtcatttctactgtttatatggaattatgcatttaataaaatttataacctccgatacatttctaacaacaaaataa

SEQ ID NO: 1986 - DNA, 222 bp, Staphylococcus epidermidis
cgaataaacaagtggaggttatataatatgagatacctcatgacattcatttgggcagtattgttacttcaaatggttaatttcgtattgaatagcttaaatagtggaccagaactaaatgtaattaatccaattattattgctgtcatcttcactattgttgtagctattttagatccaattcttaagccgtctaaaggttcaaatcaatacgaatcttaa

SEQ ID NO: 1987 - DNA, 315 bp, Staphylococcus epidermidis
agtggaaacaataggagtatcatatatttaaaagaaggttcccaaaagttaatgattatcaatcgaggacctattgtagatatagataatcaaaaatatatatttgattattcagcatgtaattatcctgtcggtgtcgtagaagatcaaatatactattttaacgaagacaatatcgataaagtcgtttttgaaggttattctgatcaagatgagatgagatttcaagaattatttaaagaaatgaaaaataatttagatgatgatattcaacaaggtattgttcaaaagcaagataatttaggtttaatttaa

SEQ ID NO: 1988 - DNA, 150 bp, Staphylococcus epidermidis
aatcaatgcaactataatataaattgttttgttaactttcattatgtctacctccgtatggttattttagtttttagtcttatctttatttttacagataattatttagtttatcaaagtaaaagtattaaagaagatgttatgatataa

SEQ ID NO: 1989 - DNA, 831 bp, Staphylococcus epidermidis
aggaggagcaaaatgactagacagtgggaaacacttagagaatatgatgaaattaaatatgaatttttcgaagggattgccaaagtaacgattaatcgtccagaagtaagaaatgcatttactcctaaaacagttgctgaaatgattgatgcattttcacgtgcgcgtgatgatcaaaatgtatcagtaattgtattaactggtgaaggggacaaagcgttttgttcaggtggagatcaaaaaaaacgtggacacggtggttatgtaggtgaagatgatattcctcgtttaaatgtattagatttacaacgtttaattcgtgtgattcctaaaccagtaatagcaatggttagaggctatgcaattggtggaggaaatgtacttaatgttgtttgtgatttaactatcgctgcagacaatgctatttttggacaaactggaccaaaagtaggctcatttgatgctgggtacggttctggctacctagctcgtatagttggccataaaaaagcaagagaaatctggtacttatgccgtcaatataatgcacaggaagctttggatatgggcttagtgaatactgtagttccattagaacaagttgaagacgaaacagttaaatggtgtaaagacatcatgcaacactcaccaactgctttacgtttcttaaaagcagcaatgaatgctgatactgatggtttagctggtttacaacaaatggctggagatgcgactttactttactatactactgatgaagcgaaagaaggacgtgacgcgtttaaagaaaaacgtaatcctgattttgaccaattccctaaattcccataa

SEQ ID NO: 1990 - DNA, 168 bp, Staphylococcus epidermidis
tatttattaaattttacgaaagggccttatttttttaaagtatttcaatgtgaaattacatataaacataaagtttttggcgagactcttgagggaacaggtcaagctgaagactacaggttgaagctgtcccctaagaaagcgagaaaacaatacgaagtattataa

SEQ ID NO: 1991 - DNA, 135 bp, Staphylococcus epidermidis
ctggacgtaaagaacccgaaaaatatagctatcctaaagaacgtatacaaattggatagtcaatacactattagcaaagacatacgtgcacctttgctaatagtttttttatttagaatgatatcaatgcgataa

SEQ ID NO: 1992 - DNA, 258 bp, Staphylococcus epidermidis
gtattcaaaaatcatgttcaaagagaaaatattaattatgaaaatgaagatatagaccattcaaaaaaacatctaaattatgatttgataaatgacggaaaacaaaattttaatgatttgattgatgaaaaaattgagcggaactatacaggcaaaagaaaaattagaaaagacgcagtaaaacatatagacggaatgattacatcagataatgaattttttagtaatcagacaccagtaaatacaaaatttttttga

SEQ ID NO: 1993 - DNA, 393 bp, Staphylococcus epidermidis
agtttaaaaaatccaatgcaattttattatagtaattgtgaacagaatgcatcaaacttattagtcatcaacgtacaacctaatgaaggattttctttatgtgtgaatggtaagaaaagtaatcaaaataatgaaatgcaaaaagtgaagctttcttatactatgccgattaaagataaaatgaacacagttgatgcatatgaaaatcttatttacgatacattaattggagaacaaacaaactttactcattgggaagaattaaaaattcttggaaatttattgatgatattgaaaatgtatggaaacaagaatagccacagtttcctaattatgcctttggatgctatgggcctaaagaaagtgaaaaattacttagtgaagacggattga

SEQ ID NO: 1994 - DNA, 579 bp, Staphylococcus epidermidis
actttgaaaaaagaaattttagagtggattgttgccatagccgttgccattgcacttattgccataatcactaaatttgtcggaaaatcatattctattaaaggtgattcaatggatcctacattaaaagatggggagcgtgtagtggtaaatattattggctataaattaggtggcgttgaaaaaggaaatgtcattgtatttcatgctaataaaaaagatgattatgttaaaagagttattggaactccaggagatagtgttgaatataaaaatgatacactctatgttaatggtaaaaagcaatcagaaccatacttgaactataatgaaaaacgtaagcaaactgagtatatcacaggtagtttcaaaacaaaaaatttaccaaatgctaatcctcaatctaatgttattcctaaaggtaaatatttagttttgggggataaccgtgaggtaagtaaagatagtcgttcattcggtttaattgacaaagaccaaattgttggaaaggtatcgctcagatattggcctttcagtgaatttaaatctaactttaatccaaataacactaaaaattaa

SEQ ID NO: 1995 - DNA, 4008 bp, Staphylococcus epidermidis
atggcgaaaaaattcaattacaaattaccgtctatggttgctttaacgttatttggcacagcttttactgcacatcaagcaaatgctgctgaacaaccacagaatcagtctaatcataaaaatgtattagatgatcaaactgccctcaaacaagcagaaaaagctaaaagcgaagttacacaatcaactacaaatgtatctggtacacaaacatatcaagaccctacccaagttcaacctaaacaagacacacaaagtactacatatgatgcatcattagatgaaatgagtacttataatgaaatttcatcaaatcaaaagcaacaatctttatcaacagatgatgcgaatcaaaatcaaacgaattctgttacaaaaaatcaacaagaagaaacaaatgatttgacacaagaagataaaacatccactgatacaaatcaattacaggagacacaatctgtagcaaaagaaaatgagaaagatttaggagctaacgcaaataatgaacaacaagacaagaagatgactgcaagtcaaccttccgaaaatcaagcaattgaaactcaaactgcttctaatgataatgaaagccaacaaaaaagtcagcaagtaacttctgaacaaaatgaaactgctacacctaaagtatcaaatacaaacgcatctggttataattttgattacgatgatgaagacgatgatagctcaacagaccatttagagcctatctcattaaacaatgtgaatgctacatctaaacaaactacttcatataaatataaagaaccagctcaacgtgtaacaactaatactgtaaaaaaagaaacggcatctaatcaagcgactatagatacaaagcaattcaccccatttagtgcaactgctcaaccgagaacagtttattctgtatctagtcaaaaaacatcatcattaccgaaatatacaccaaaggttaattcttcaataaataactatattcgtaaaaagaatatgaaagcaccaagaattgaagaagattatacgtcatatttccctaaatatggctatagaaacggtgtgggacgtcctgaaggtatcgttgttcatgatactgcaaatgataactcaacaatcgatggcgagattgctttcatgaaacgtaattacacaaatgcattcgtacacgcatttgttgatggcaatagaattatagaaacagctccgacagattacttatcttggggtgcaggtccatatggaaatcaacgttttatcaatgttgaaatcgtccatacacatgattatgattcatttgcacgttcaatgaacaactacgctgattatgctgcaacgcaattgcaatattataatttaaaacctgatagcgctgaaaacgatggaagaggaacagtttggacacatgctgctatctctaacttcttaggaggtactgatcacgctgaccctcaccaatatttaagaagtcacaattatagctatgcagaattatatgacttaatttatgaaaaatatttaattaaaacgaagcaagtagcaccttggggcacaacatctacaaaaccgtcacaaccttctaaaccatcaggaggaactaataataagttaactgtgtctgctaatcgtggtgttgctcaaattaaaccaacaaataatggcttatatacaactgtttatgacagtaaaggtcataagactgatcaagtacaaaaaactctatccgttactaaaactgcaacattaggaaataacaaattctatttagttgaagactacaatagcggtaaaaaatacggttgggttaaacaaggtgatgttgtttataacactgctaaggcaccagtaaaagtgaatcaaacatataatgttaaagcagggtcaacactttacacagttccttggggtacaccaaaacaagttgctagcaaagtatctggtactggaaatcaaacatttaaagcaactaaacagcaacaaattgataaagcaacgtatctttatggtacagtgaatggtaaatctggttggattagtaaatattacttaactacagcatctaaacctagcaatccaactaaaccttcaacaaacaaccaattaacagtgactaacaatagtggtgttgctcaaatcaatgcaaaaaatagtggcttatatactacagtttatgacactaaaggaaagacaacaaatcaaatccaacgtacattgtcagtgacgaaagctgccacacttggtgataaaaaattctatcttgttggtgattataatactggtacaaattatggttgggtaaaacaagatgaggtcatttacaacacagctaaatcacctgtaaaaatcaatcaaacatacaacgtcaaacctggtgttaaattacacacagtaccttggggcacatataatcaagtggctggaacagtttcaggtaaaggcgatcaaacttttaaagcaactaaacaacaacaaattgataaagcaacatatctttatggtacagtgaacggtaaatctggttggattagtaaatactatttaactgcaccatcaaaagttcaagctttgtctactcaatcaacaccagcacctaaacaagtaaaaccatctacacaaactgtaaatcaaattgctcaagtgaaagctaataattctggaataagagcatctgtatatgataaaacagccaaaagtggtacgaaatacgctaaccgtacattccttatcaataaacaacgtactcaaggtaataacacgtatgtactacttcaagatggaacaagtaatactccattaggatgggtaaacattaatgatgtgacaactcaaaatatcggaaaacaaactcagtctataggtaaatattcagtaaaacctacaaataatggtctatattctattgcttggggtactaaaaaccaacaattactagcacctaatacgctagctaatcaagcatttaatgcttccaaagctgtttacgttggtaaagatttatatctatacggtacagtcaataacagaacaggatggattgctgctaaggatttaatccaaaacagtactgacgctcaatcaacaccatataactatacttttgttatcaataatagtaaaagttatttctatatggatccaacaaaagcaaaccgatattctttaaaaccatattatgaacaaactttcacagtcattaagcaaaaaaatattaatggcgttaaatggtactatggtcaacttttagacggtaaatatgtttggataaaatcaactgacttagttaaggaaaaaattaaatatgcatatactggaatgactttaaataacgcgataaatatccaatctcgtcttaaatataaaccacaagtacaaaatgagcctttgaaatggtcaaatgctaattatagtcaaattaaaaatgctatggatacaaagcgtttagctaatgattcatccttaaaatatcaattcttacgtttagatcaaccacaatacttgtcagcacaagctctcaataaattattaaaaggcaaaggtgtacttgaaaaccaaggcgctgcatttagccaagctgcacgtaagtatggtctaaatgaaatttatcttatctcacatgctttagtagaaacaggtaatggaacttcacaacttgctaaaggtggagatgtttcaaaaggtaaattcacaactaaaacaggtcacaaataccataatgtctttggaattggtgcatttgacaataatgcacttgtagatggtatcaaatacgctaaaaatgctggatggacttctgtctctaaagcaattattggtggcgctaaattcattggaaattcatacgtgaaagcaggacaaaatacgctatataaaatgcgttggaatcctgcaaaccctggtacgcatcaatatgcaactgatattaattgggcaaatgtcaacgcacaagtattaaaacaattttatgataaaattggtgaagtcggtaagtacttcgaaattccaacatacaaataa

SEQ ID NO: 1996 - DNA, 174 bp, Staphylococcus epidermidis
ggcgtagaaaaatatggctctctagtaacagtatactctatatttgctgatagccaaggaaaccttgagagtgcaactgaacgtgtcaaaaaagataatccaaatttaaattcattagggctaattccactagcatcatactgcattgcattcatcaacttaatcataggatga

SEQ ID NO: 1997 - DNA, 159 bp, Staphylococcus epidermidis
attatacgaaagggccttatttttttaaagtattttaatgtaaaattacatatgaatacaaagtattttggcgagactcttgagggaacaggacaagctgaagactacaggctgaagctgtcccctaagaaagcgagccaacaatacgaagtattgtaa

SEQ ID NO: 1998 - DNA, 1557 bp, Staphylococcus epidermidis
catttaatgaatggtacatgttacactaaattcaaggagaggagtggctctatggaaaaaaatgaaaataaaatagttgatgtgattgcaacttctgatatgcatagtcacttcttaaatggtgattatggctcaaacatttatcgggctggtacttatgttaatgaagctcgaaaaaataatgaaaatgtcatattactagatagtgggggaagtttggcgggatcacttgcagcattttattacgccgttgtagcaccatataaacgtcatcctatgattaagttgatgaatgcaatgcagtatgatgctagtggaattagccctaatgaatttaaatttggattatcttttttgacacgttcagttgcactctcaaggtttccttggctatcagcaaatatagagtatactgttactagagagccatatttttctacgccttatacaatcaaaatgtattcagatttgaaaattgctatcgtaggtttaacatcagatggattaatgaagaacgagtacgcagaaatggaagaagatgtctgtattgagaagactttggtttcagctaaacgttggattagatacatacatgaagttgaagaaccagacttccttattgttatttatcatggtgggttaaataaaattagtagtgccaataaaagaaatgaaaaaaatgcaaacgaagctgaaaaaattatggaagaacttggtgttattgatgtaattattaccgctcatcaacatcaaacagtagttggaaaagatcatggaactatatatgttcaagcaggtcaaaatgctgaggaattagtacatctttcaattaaatttaagaaacgtacaacttcttatgagattgagcacatcgactcaaaagttattgacttaaatgattaccatgaagatgagcaattattaaaagaaacatattatgatcgtaaggcagtcaaacactgggcaaattcagtagtttcaaacaaaaacaatggcttaacagttcaatgtattgaagatattatttgtaagccgcatccttttactcaattattacatgatgcaattagattagcctataattatgatatttcttgtgtgcatatacctaagaatggtgaggaagggttaaaaggaactataagaaatagagatatatacgatgcataccctcatccagataaacctatagatatcactgtcaaaggtaaaaatatcaaagatatacttgaatacagttatgcgcatattgattttaataagcgacaattaagtatgacaatgatagatgaaacgttatttacagtttggcaagggtttgattattgtatagacatgtcacaatcaccgtttaatagagttaaattaaatggtctaaatgaagaagattcgtatagaataacaatgacagattattgttatagaaactacaaaatgtatttacaagaagctatcgttcacgacacatattcggaaacgatgggtggattgattagaaaaaatttaaaatgtgacatgtattctgtgaaattaaatcataattttaaagtttattaa

SEQ ID NO: 1999 - DNA, 642 bp, Staphylococcus epidermidis
aacaaaatgaaccagtgggatcaatttttaacgccatataagcaagctgttgatgagttaaaagtaaaacttaaaggattaagaaaacaatatgaagtgggagaacataattcaccaattgaatttgtgactggaagggtaaaacctatttcaagcgttatagacaaagcgaacaaaaggggtatcccttttgattgtttacatgaagaaatgtacgatatagctggtcttagaattatgtgtcaattcgtggatgatattgacatagttgttgatatattaagacaacgtcaagatttcaaggttatagaagaaagagattacattcgaaatacaaaagcaagtggctatcgttcttatcacgtgattattaaatatcctattgaaacactaagtggacaaaagcacatcttggctgaaattcaaatcagaaccttagcaatgaacttctgggctacaatcgaacatacattaaggtataaatatgatggggcatacccagatgagattcaacatcgtttagaaagagcagcagaagcggcatatttattagatgaagaaatgtccgaaattaaagatgaaattcaagaagctcaaaagtattacacgcaaaaacgtgctaagaaacatgaaaatgattaa

SEQ ID NO: 2000 - DNA, 1263 bp, Staphylococcus epidermidis
aaagaggcgaataggatcatgactgagaataataatttagtaacttccactcaagggattattaaagaagcattacacaagttgggctttgatgatggtatgtatgaccttataaaagaaccaattagatttttacaagtgcgcattccagtacgaatggacgatgggacagttaaaacatttactggataccgtgcacaacataatgatgcagttggccctactaaaggtggcgttcgtttccatccagaagttgatgaagaagaagtgaaggcattatcaatgtggatgactttaaaatgtggcattgttaatttaccttatggtgggggtaaaggcggtattgtttgtgatccacgtcaaatgagtatacacgaagttgagcgtctatctcgagggtatgtaagagctatatctcaatttgttgggcctaacaaagatattccagcaccagacgtttttacaaactctcaaattatggcttggatgatggatgagtatagtgcattagataaatttaattcgccaggttttataacaggcaaacctattgtattaggtggatctcaaggacgtgatcgctctacagctttaggtgtagtcattgcaattgaacaagcggcaaaacgtcgtggcatggatattaaagatgccaaaattgtgattcaaggtttcggcaatgcaggtagtttcttagctaaattcttatacgatttaggtgctaaagtagttggtataagtgatgcatatggagccttacatgaccctaatggacttgatatagattatttattagatcgacgtgatagcttcggtacagttacaaatctattcgaagatacaatttctaacaaagaattattcgaattggattgtgacatccttgttcctgctgcaatttccaatcaaatcactgaagataatgcgcacgatattaaagcaagcattgtagttgaagctgctaatggccctacgacgcctgaagcaacacgtattttaacagaaagagatatattactagtgccggatgtacttgcaagtgcaggaggtgtgactgtatcttatttcgagtgggtacaaaataatcaaggttattattggactgaagaagaagtcaatgacaaactacgtgagaagttagtaacagcatttgatacgatttatgaattgtcacaaaatagaaaaattgatatgagattagcagcatatatagtaggtattaaacgtactgctgaagcagcaagatatagaggttgggcataa

SEQ ID NO: 2001 - DNA, 366 bp, Staphylococcus epidermidis
ataaaaaagaacatttataataacgtgattgcgttattatttgattggtttgttatttttagtagtattttaatttctgtaacttttaataacattttgatctatcttgtagctattatattaattggtagtagaatgagagcatttgataatttaatgcatgaagcttgtcatcgatctttatttacaaataagttttggaataaatggataacttgtttatttgttgcatttccagtatttactagttatacagcatatcgaaatgctcatcattgtactggattttttaaaactacattgcctggcttttatagtgtagttaaagatatttttacaccgaactatgaaaggaaagagagttag

SEQ ID NO: 2002 - DNA, 1146 bp, Staphylococcus epidermidis
ctgagttttgatatatacttattgagtatgaaaaagaataaaataggaggatcacaatctatgttcaataaggtttggtttagaacaggaatattttttattatgctgttcatactcatcaaactatttatggaagtgcatgaagtatttgctccaatagctactatcattggttcagtcttccttccatttttaattagtggatttctcttttacatatgtttaccttttcaaaacatattagaaaagtggggctttccacgttgggctagtataacaacaatattcataggattaatagctatcatcgctattgtggtatcatttatagcacctatcattatttccaatattaataacttaattaaacaaacaccatcattacaaaaagaagccgaacaattaattaatttctcgttaagacaaatggataaattaccagatgatgtcacacatcgtattaataaagcggttaaatccatgggagatggcgcaacgtctattttatctaattcagtgtcatatattacgtctttcatctcaactgtatttttattaataatggtgcctttcttcctgatatatatgctaaaagatcatgaaaaatttatcccagcaatcggtaaatttttcaaaggagaacgtaaagtttttgttgtagatttattaaaagacttaaacttcactttaaaatcatatattcaaggtcaagtgacagttagtatcatcttaggtattattttatatataggttatacgattataggattaccatatacacctttattagtattattcgccggcgtagctaacttaataccatttttaggtccatggttatcttttgcaccggcagcgatactaggtattattgatggcccttcaacttttatttgggtatgtgtcgtaacattaatcgcacaacaacttgaaggtaacgtgataactcctaacgtaatgggtaaatcattaagcattcatccattaactattattgttgtcatacttgcagctggagatttgggtggtttcacactcattcttgttgcagttccattatacgctgtaatcaaaacattagtgagcaacatttttaaatatcgtcaacgtattgtcgataaagcaaacagtaatgttaaagattaa

SEQ ID NO: 2003 - DNA, 1392 bp, Staphylococcus epidermidis
aatcaaattgaaataaatgttgaggtgaaaatcatgtcagttttaagtcagctgcttaaaaaatctagccctcaacaagggattatactctattatctatttgccatcgtcgttgcatttttattattaaatttgccatatgttcataaacaaggggttgaggttaatccaattgatacactttttgtagctgtatcaggtattagtgttacaggattatcaccaattactatagtcgacacatactcaacctttggtcaaattatcatacttattattttgaacatcggtggtataggtgttatggctattggaaccatgctttgggttgttttaggcaaacatattggaattagagaacgacaactcattatgttagataataatagagatactatgagtggaacggttaaactgattttagaaattgtaagaacaatttttattattgagtttataggtgcactcttactcgcgttctatttttatcgggataatcctgatttaaaaaacgcattaatgcaaggcatttttgtgtcagtatctgctacgactaacggtggtcttgatattactggtgaatctttagttccctatgcaaaagactattttgtacaaacaatagtaatgttcttaattgtgttaggatctataggctttccagttttgttggagttaaaagcatatataaagaatcgagtaactaattttaggttctcattattcacaaaaataacgacaacaacgtatttattcttatttttattcggcgttattgttgtattaatattagaacatagcaatgcatttaaaggattgagttggcatcaatcattattttatgcattgttccaatcatcaacgaccagaagtgcaggtttgcaaacgatagatgtgtcacatttcagcgacgcaacaaatattgtaatgggattattgatgtttataggatcatctcccagttctgtaggaggtggaatcagaacaacaacatttgctattttaattttgtttgttattaattttaataatactggtgacaaaacaggtattaaaattttcaacagagaagtacatattatggatgtacaaagatcatttgccgtatttactatggcgtcattaattacatttattagcatgattattatatctgccactgaacaaggcaagttgtcctttttacaaattttctttgaagtaatgtctgcgtttggtacatgtggtttaagcttaggtgtgacaagcgatgtcaacgacattaccaaggctgtattaatgatattaatgtttataggtcgtgtaggacttatttcattcattattatgttagctggacgtaaagaacccgaaaaatatagctatcctaaagaacgtatacaaattggatag

SEQ ID NO: 2004 - DNA, 171 bp, Staphylococcus epidermidis
cgaagaattgatacaataacatacctaaaatcactagaaacgcttagaaagcctttaaacgttctatataaggttgaaacagaaaaagtaggcggtttgtttgataaagaattacaagagactgctaatgttgttataaacaaagatgaatttaatcagtttcaagagtaa

SEQ ID NO: 2005 - DNA, 186 bp, Staphylococcus epidermidis
ttcatattagatggaatatttgtttgttgttgtatcgatttctctgattggtttggtgctggagagtggttcgaagtttcagctatcgaaggggaacttaaactagctaaacccagtgtaacggtagataaagttgaaatgattattttcttagatttaaacataaaaacatcctttcaaaaatag

SEQ ID NO: 2006 - DNA, 612 bp, Staphylococcus epidermidis
aacatgatagaggtgacttttatgtctacgaataatgagattgaatttaaacaaatactaaatcaagatacttactcaaaaatctatgaactctatttcaaaaatcaatcaccttttaagcaaactaatttctatatcgacacagagaattttaaattaaaacagcatcaggctgctttgcgtataagggtcaaagattatatgtatgaaatgactttaaaagttcctgctgaagttggattgacagaatataatcactcagtaaatatagaacctaaacttgatatgtcacttcaactttcccaattacccaatgatattagaaatattttagaacaggactttaatattttagaaaatgagcttaaagtgctaggaaacttaactacctatcgtttagaaaccgaatatcaaaatgaattactagtattagataagagtgaatatctcggcaaaactgattatgaattagagtttgaagttcattcttatgatgaagggtattcaaaatttaaaagtttacttcaacattttaatcttcaacatcaaaaacccttgaataaagtgcaacgtttttttcaagaaaaacaaaatgcaagtgataaagattaa

SEQ ID NO: 2007 - DNA, 999 bp, Staphylococcus epidermidis
tggggtgaagagatgttaatggcaatcaatcagcaaggtcagaaaattttagcgcaacatgcaaacaaatttgataaatatcaatgtcctcactgtaagtctgaggtgatactcaaacaagggatgactttaatagctcactttgcgcataaaacacgttttaatcaccgctgttcaaagtcagaatcagttgaacattatgaagcaaagttatatttagcaagaatttataaagcattgaattttaacgtggaaattgaaccttattacaaagaagttttgcaatatccagatattgtgatcaatcaagaaaatgcaattgaagttcaattttctaaaataagtatcagtaaaattattcgccgaacaactggtttaaagcgaataggtttgaatgtgatttggattattaaagatgttcctttgaaatataaatacgttaaattatcaccatttcaaagtgcttttattcatccaattaatagaacattagtaacatgggattccaaaaagtttgtattaatattatatagtcaacttcaacatgtaggcggtaaaaattttgttgctcaaagaaaagttttaaaatttgaggatataataaatatgacttttcaatcaaataatgttcccaattttaggttatctgcttctaatatacaacgttatataaactattgtagaaagcgccacagtgttttagaacctacactcagtgccatgtatcaattaaatatgtatgattctgatgtaatttgtaaattaggatatgttgtaccacatcaaatatatttaataacgcatccaatagaatggcaattaaaatatttgttgctaagaagaacattaaatgacaacgaattatgtaaacaacttcttagtcaagtgaagtttagggtgtttgcaacgtttcaatacgacaaacgtcaaatattaagtactattttgcgtgaatttgattatttatatgaacacgaaagcttaaacgtgcaaaagtag

SEQ ID NO: 2008 - DNA, 2616 bp, Staphylococcus epidermidis
aataatttggatattaatcaaatgacatatgctgtacaaggtgccttacaaaaagcagtcgcgtacagtaaagaatatgaattacaaaacattgaagttgaagcattgttaaaagctgcaatgaatgaaaatgatagtttatttaaaagtatattagaacgagcaaatattgatgttgatcaattaataaaagcatacgataatcaattaagtcattatccaactgtacaaggtgacaatgttcagtatggacagtatattagtgctaaaacaaatgaattattagacaaagccgagaaatatatgaagtcctatgaagatgagtttatttctatggagcatatattacgtgcagccatagatactgatgaaactactcaaaaatgggtcggcaataaagtagaagtgataaaagaaattataactaaagttagagggggaaatcatgtgacatctcaaaatccagaagtaaactatgaagctttagaaaaatatggtcgtgatcttgtagaagaagtacgtcaaggtaaaatggaccctgtcatcggtagagatgaagaaatacgtaatacaattcgtatattaagtcgaaaaacaaaaaataatccggttttaatcggtgaaccaggtgtaggtaaaactgcaattgttgaaggtttagcacaacgaattgtacgtaaagacgttccagaatcattactcgataaaacgattttcgagcttgatttaagtgccttagttgcaggtgcaaaatatagaggtgaatttgaagaacgtttaaaagcagtattgaaagaagtaaaagaatctgaaggtcgaatcatcttattcattgatgaaattcatatgttagtaggcgctggtaaaactgatggtgctatggacgcaggaaacatgttgaaaccaatgcttgcgcgtggtgaattgcattgtataggtgctacgacattaaatgaatatcgtgaatatattgaaaaagattcagcattagaacgtcgtttccaaaaagttggggtcagtgaacctgatgttgagaatacaatatcaattttacgtggtctaaaagaacgttatgaggtctaccatggtgtacgtatacaagaccgtgcacttgttgcagcggctgagctatctgatagatatattaccgatagatttttgccagataaagctatagatttagtcgaccaagcttgtgcgacaatacgtacagaaatgggatcaaatccaacagagttagaccaagtaaatcgtcgagtaatgcaattagaaattgaagaaagcgccttgaaaaatgaatctgataacgcaagtaaacatcgtttagaagagcttcaagaggaattatctaatgaaaaagaaaaacaatcctctttaaaatcacgtgttgaacaagaaaaagaaaaaattgctaaagtacaagaaaaacgtgctgaacttgatagtagtcgtcaagctcttgaagatgcacaaacagaaggtaatcttgaaaaagcagcagaattacaatatggtacaattccgcaattagaaaaagaattgcaagaatttgaggaagcctttcaagatgaaactggcgaagatagtgaaagaatgattcgtgaagtcgtttcagatgaagaaataggcgacatagttagtcaatggacaggtatacctgtatctaaacttgtggaaacagaaagagaaaagctattaagtttaagtgacatcttacacaaacgtgtagtaggtcaagataaagcagttgatttagtatcagacgcagtagttagagcacgtgctggaattaaagatccgaatagaccaatcggaagtttcttattcttaggacctactggagtaggtaaaactgaattagcaaaatcgcttgcttcatcacttttcgattctgaaaaacatatgattagaattgatatgagcgaatatatggaaaaacatgctgtatcacgtttaattggtgcacctccaggttatgtaggtcacgatgaaggtggtcaattaactgaagcagttagacgtaatccatactcagttattttgttagacgaagttgaaaaagcacatagcgatgtttttaatgtattacttcaaatactagatgaaggtcgtcttacggattctaaaggtagaagtgttgactttaaaaataccattatcatcatgactagtaatattggttcacaagtattacttgaaaatgtaaaagatgctggtgaaattagtgatgatacagagaaagcagttatggacagtctacatgcatacttcaaacctgaaatattaaatcgtatggatgacatcgtgttatttaaaccattatcagttgatgatatgagtatgattgtagataaaattttaacacaattaaatatgagattattagatcaacatatctcaattgaagtgacagaagaagcgaaaaaatggctaggtgaagaagcgtatgaaccacaatttggtgcaagaccattaaaacgctttgttcaacgacaaatagaaactccaattgcacgtatgatgattaaagaaagtctacctgaaggtacaataattaaagtagatttaaatgacaataaagaacttgattttaaggttgttaaacctacgtcttaa

SEQ ID NO: 2009 - DNA, 138 bp, Staphylococcus epidermidis
acatgcttggatacaataacgtacgatttatatttattgaagtatgaacatcatattattcctaaaaaaaagaccaaaatgaattcaaaaaattcattttggtctttttatatgaaaattataagttcattttcctaa

SEQ ID NO: 2010 - DNA, 630 bp, Staphylococcus epidermidis
aacaagatggattatgtatacacaatttataaaaatcctagatataacatcattcaaaaagataatcgctatttaatggtcgatttagaacaaaattggtattcatatttatgtccaatgctgaattggtttatacctattaaattcacagaattaacttatcaagaattcaataatataaacatatttcataatggaggacaaaagagtcatggtatgatggctgctggcgttggcgtcactatcagtgtgctattaagaagtcttgtgggttatatagatattaatattagtcgaatttggatagtttttatgtttttaattggatttgttgctgtgatcacacttcgtttatctataagaaagaagttaaatcatccagcatttaataaaaagagtaaacaaaaagtaatattgataccatcatttaaaaatatgatattggtggtgttttgctattttatgatgctgtttttctcaattgcaccttttcaaatgatttttgaggaaaagaaaaacatcttaggatatatactttgggtaggtgtattatttatatttactactttgaatatggcttcaatttctgatagaaaagtacatgccaaaattaaaaatataagaagatag

SEQ ID NO: 2011 - DNA, 1389 bp, Staphylococcus epidermidis
aattcggaggagaaagaagtgaaaaaaatggatgtgaatgtagacgaacaggcaatcgtcgataagttatatgaaagtacaaaagattgggtttcagttgaagttgaattaaataaaactatgaaacctagtgtgttgtttcatttaactgaaaaagatgctggggaccgtttttacatgcgcttaaatgataattattcttcgtattttggatatcatgctattcataggtttaaaaacgactttgagaataagcaatccatttttaaggactgggaaaaattaaaaaataatattgaacttattcatccacataataaatatcatcatcttagattgtgtggcggttttcaattttcgagtcacaaatcagatgatgaatggagagaatatggtttaaaccattttgttttacctaaagtattaatttctaatgaaggtacgcgtacttatctaacttatacaacaaagcgacaagattttgatttacaagcatttaaaactttagtggcacattttgaacaaacaaccatggataaccctgaggaagcacttggagatgtgacgcgtatggaagatatttataaggatgattggcgtgatctcgtaaaagaagcgattgatacgattgacgacaataaaaaaatcgttctcgcacgtcgtcgtttagtcaaatttgataaaaaaatcaatattccatatgttttaaaccgggctcttgaaaatgaaaaaaatagttatatatttttattagaagctaatcagtcaatattcttttctcaaacgcctgagcaattaatcaaagttgaagatggtgttttatctacaaaagctgtagcaggtaccattaaacgtacacataatgagcaaatagataataagaatatagaggcatttcttaaagataagaaaaatttaggagaacatcgttttgttgttgagagcatcttaaatgatattgagccttttgtacaggatgtagagtacaatgaaacgcctaatattttaaaaaatgatcatatgtatcatttatatacggaaatcaaagctaatttaaatgacaaatcatacattggtttaatcgatcgtttacatcctacacctgcgttaggtggctaccctaaagaagaagcgcttgattttattgagaataaagagtttggtactcgaggtttatatggcgcgccggtaggctatattgatgtttatgatgattgtgaattcattgttgctatacgttctatgctaattaaagagcaacaagcgactttatacgctggatgcggcattgttaaaaattcggatcctgatagtgaagttgctgaaactgcagttaaattctcaccaatgatgaacgccttaggagtagataataatgatgaatcatag

SEQ ID NO: 2012 - DNA, 135 bp, Staphylococcus epidermidis
gcacacacacttgatacatttaaacctattgttgtgtgggcttggtacactcataaatttcaattcaggaataaacgtttgccagacgatttatttagttggagtggtcatttgctctggataatgttgctgtaa

SEQ ID NO: 2013 - DNA, 189 bp, Staphylococcus epidermidis
ataggaggtttcattaatgtccataaattcttatttgatttcgtcattatttacgccagttttatcaataattatatggttattttattcaaatcactttataaatttaatcaatatcttattttatacatcattcattatttttatagttgctttccttattttactcattcaagaaggaatatttga

SEQ ID NO: 2014 - DNA, 384 bp, Staphylococcus epidermidis
tatgttaaactagtatggaataaggaggaaacaagcatgcgtatttacataaatgaaattaaattaaaagatgatggcgtttattgcttctcagaagaatctacagagggactagaagaggtaggtcaaatgcttgttgatagtgataattatggttttgcttatcttttagatgatggacaatcatattcatatttgatttttgttcaggaaacatggtcgatgttgcatgagaatagagataaacgaatcattattaataatcatttagaactaaagcatttccaagaagaattagattatgttttgaataacatagaaggaaacaataactatggtaaggagtttgtttcagctgttgaaaaaactttcgaactagagtga

SEQ ID NO: 2015 - DNA, 135 bp, Staphylococcus epidermidis
gataaaatttgtttgaataagttgattagaagcaatagcgttcgtcttatgaaattgattagtaaaaaagttacttgtctaacgaaatttattattaatagggaagaatgtaacaatgagaaaaaaattaaataa

SEQ ID NO: 2016 - DNA, 132 bp, Staphylococcus epidermidis
ataaaaagttgtaaagttggcatagatattagtattaaagatactcctaaaatagctattacaattaaaaaagtatcacacagtccagctgttataattacaggtaatgctttactaattttttttggttag

SEQ ID NO: 2017 - DNA, 1221 bp, Staphylococcus epidermidis
gtttttattcgaaaacgaaggggagattttatgactcaatctgaaaaaattattaacttaacaaatcactatggggcgcataactacgttccacttccaattgttatttctgaagcagagggtgtatgggtgaaagatccggaaggtaacacgtatatggatatgctttcggcctactcggcagtgaatcaaggtcatcgacacccaagaattattcaagcattgaaagatcaagcagataaagtcactttagtatcacgtgcttttcatagtgataatttgggtcaatggtatgagaaaatatgtaaactcgcaggtaaagacaaagcattgcctatgaatacgggagcagaggcggttgaaacagctttaaaagctgctcgtcgttgggcttatgatgttaagggtattgagccgaacaaagctgaaattatcgcttttaatggtaatttccatggacgtacgatggcaccagtatcattgtcttcagaagctgagtatcaacgaggctatggtccattgttagatggctttcgaaaagttgagtttggtgacgttaatcaattaaaagcagcaattaataaaaatacagcagcaattttagtagaacctatacagggagaagcagggattaacgtaccaccagaaggatatttgaaaacaattagagaattatgtgatgaacatcaaattttatttattgctgatgaaattcaagcaggattaggacgttcaggaaaattatttgcaacggattgggatcatgtaaaaccggatgtttatattttaggaaaagcgttaggtggaggggtatttcctatctcggtagttcttgcagataatgaggtattagatgtatttactcctggctcacatggttctacatttggtggaaatccactagcgagtgcagtttctattgcagctatagatgtcattattgacgaggatttacctggtcgttcattagaattaggagaatattttaagtctgaattgaaaaaaattgagcatccatctattaaagaagttaggggacgaggattatttatcggtattgaattacatgaaagtgccagaccatattgtgaagctttgaaagaacaaggattattatgtaaagaaactcacgacaccgttattagatttgcacctccattagtgataacgaaagaagagttagacatggctttagagaagattaagagtgtatttgcatag

SEQ ID NO: 2018 - DNA, 156 bp, Staphylococcus epidermidis
acacccgttcgtgataattctttgattaaagatgcgtatgataattctgatgaaataagtgaaaaaattaattgtataataataagtgcgacactcgttattatacccatgcctatggaagttaataatcgtttagatgcaatgtctctttggtaa

SEQ ID NO: 2019 - DNA, 135 bp, Staphylococcus epidermidis
tatatgagtcgcctatctctcaggcgtcaattgacgaagagaggaggtgcattaattgctaatcattttcgttcacatcacgaccacagtcctcagttgttgtattattgcattatttactcattggatatgtaa

SEQ ID NO: 2020 - DNA, 291 bp, Staphylococcus epidermidis
tttgttatacgcaaagcttcatatggacaaacgcctcacgtgcactttgaaattgtaccaattacagaagatggacgattaagtgctaaagatgttgtaggtaataaaaaagcattagcaagctttcaagataaatttaatgagtatgtaaatgaacgtggttatgaattagaacaaggaacttcaagagaattaacaaatagacaacacgatcaagttaatagttataaacaaaaaacagaatatcataagaaagaatatgaacgtaggtataaaattcagcccatataa

SEQ ID NO: 2021 - DNA, 1365 bp, Staphylococcus epidermidis
aaaggcatacgtgtttcaatatcatacatatataaaggagagacagctatgaataaaattataatagtcggtgcagttgctggtggtgcgacttgtgcaagtcaaattcgaagattagataaagagagtgaaatcattgtttttgaaaaagatagagacatgagctttgctaattgtgcattaccttattatattggcaacgttatcgaggaccgtcgtaaagttttagcatacacgcccaatcaattttatgacaaaaagcaaatcactgtaaaaacataccatgaagttatacaaatcaatgatgagagacaaaaagttactgtcttaaatcatcaaactaatcaaacttttgaagaaagctacgatacattgattttaagtcctggcgcatctgcaaatcgattaaacactcatagtgatatctcatttactgtgcgaaatctcgaagatactgaaacaattgatacctttattacgaataccaaagcacaacgtgcacttgttgttggcgcgggttacatctctttagaagtccttgaaaatttacatcatagaggtttggatgtcacatggattcatcgctctacaaatattaataaactgatggatcaagatatgaatcaacccatcatcgacgaaatagaaaaaagaaatatcacttatagatttaacgaagaaattagtcacgtcaatggacatgaagttacattcacatctggtaaagttgaaaactttgatcttattatcgaaggtgtaggtactcatccaaattcacaatttattaaatcatctaacgtcatactgaatgataaaggatatatcccagtaaatcataatttccaaacaaatataccaaatatttatgcattaggtgatgttattacttcacattatcgtcatgtgaatttaccggcacaggttccacttgcttggggagcacaccgtggtgcaagtattatagctgaacaactttctggaaattcgtctattcactttaaaggttatctaggaaataatatagtgaaattttttgactatacattagcaagtgttggcatcaaaccaaatgaacttaaaaatttcgattatgatatggttgaagttaagcaaggagctcatgcaggatattacccaggaaattcaccactacatttacgtgtttattttgaaaaagactcgagaaaacttatacgcgcagcagcagttggtaaacaaggtgccgataaaagaatagacgtattatcaatggcaatgatgaataatgctactgtggatgatttaacagaatttgaagtagcatatgcacctccttatagtcatccaaaagatttaattaatttaattgggtataaagcgcaataa

SEQ ID NO: 2022 - DNA, 132 bp, Staphylococcus epidermidis
gcaacaccacgattagcagacacagttaacttattattagttcctcctgatggtttagaaggttgtgacggttttgtagatgttgtgccccaaggtgctacttgcttcgttttaattaaatatttttcataa

SEQ ID NO: 2023 - DNA, 495 bp, Staphylococcus epidermidis
aaagccatgcgctatgtgtatggttcagaaaaggttttaccgttatctaaaaaaacatctcatcatgctagaatatatattggccagccaaccaaaatattcaacacgaggagatgctttttaatgtcatctgacacaaacggtttagcacatacaaaatggaattgtaagtatcacatagtctttgcaccaaaatatagaagacaagtgatatatggaaaaatcaaaagagatattggagtgattttacgtcaactatgtgaaagaaaaggcgtagaaataatagaagcagaagcatgtaaatacccagttggtgttgttgaagatcaaatatactatttcaatgaagataatattgataacgttatatttgagggctattctgatcaagatgaaacaagatttcaagaattatttaaagagatgatgggtaatttggatgaagatattaaacgtgggactgttcaacaaaaagatagttacggattgatttaa

SEQ ID NO: 2024 - DNA, 1503 bp, Staphylococcus epidermidis
aaaaaggagcgatacattttgaatgcaagtgcgttgttcaaaaaaattagagtaaaaaatgtaattggtacattagatatacaggtggacgatattaccactgactcacgtacagctaaagagggaagtctatttgtagcatctaaaggatatacggtagatagtcataagttttgtcaaaatgtagtagatcaaggttgtggtattgttgttgtcaatagagaactcgaacttaaaggtaatgtgacgcaagtcgttgttcccgatactttacgtgttgcaagtctattggcacatgaattatacgagtttcctagtcatcaactgacgacatatggtgttacggggacgaacggtaagacatcgattgcaactatgattcatttaatttatagaaaattgaataaaaatagtgcatatctaggtacgaatggatttcaagttaatgaaacaaaaacaaaaggtgcgaatacaacaccagaaacagtagcattaacaaaaaagatcaaagaagcagttgatgccaatgcagaagcaatgacgatggaagtttctagtcatggattggccttaggtcgacttagaggcgtagagtttgacgttgctatcttttcaaacttgactcaagatcatttagactttcatggaactatggaagcatatggacatgctaaatcgttattatttagccagttaggtgaagatttgtctaaagaaaaatatgttgtattaaataatgatgatgacttctccgattatttagcaagtgtgacaccctatgaagtatttacatatggtattactcacgaagcacaatttatggctaaaaacattaaagaatcattgcaaggtgtagaatttgaattttgtactccatttggaagttttccagttaaatctccttatgtaggtaggtttaacatttcaaatattatggctgctatgattgcggtttggagtaagggaacaaatttaaatgaaattattaatgctgttactgagcttgaacctgtagaggggcgcttagaagtacttgatccatcacttcctatagatttgattatagattatgcacatacagctgatggtatgaataaactgattgatgctgtacaaccatttgttaaacaaaagctaatctttttagtaggtatggctggggaaagagatttaacgaaaacacctgagatggggagagtagcatgtcgagcagattatgttatttttactccagataatcctgctaacgatgatcctaaaatgttgacagctgaattagctaaaggtgcaacgcataacaattatatagagtttgatgaccgtgcagaaggtattagacacgcgattgatattgctgaaccaggtgatacagttgttttggcctcaaaaggtcgagagccttatcaaattatgcctggtcatgttaaagtcccacatcgcgatgacttaattggcttaaaagcagcatatcaaaaatttggtggtggacctcttgaggattaa

SEQ ID NO: 2025 - DNA, 1782 bp, Staphylococcus epidermidis
agaaactataggagtggtcttctagtggataacaataaaaaacaagtcataccacgcagtcaatatcgacgtaaaagacgtgaatactttcataacgtagagcgagaagagcgcataagacgtgagaaaatagagaaggaaaatcaagctaaaagagaacaacatcaaactaaagtcaatgaggaacgtgttaaagataatttgagaaaagcaagaatagagaagctgacacaagaagaaatacatcaacaacgtgatgataaaagttataaacaaaaaactttaaatcaaaataatcaaatgaataaatctaaagacgacgataataaaattggagaagaaagtctacatgatgtgcgagtttcaagtgatacctccactttaccgcatcaaaataagtcaataaaagactatgatgattctggaaacgaaagtaaacaacatactaaattgacttcaaaggaatctatgctaggcgtaaattctaatcatactgagcaagattcaagaagtacacaaccatattcttcaaaacatagctattcacaaccaaaagataaagacaacgataatactcaacaagcgcaatttcttaaaaaagaagacaaacaacgtaacagagccgaaaatataaaaaaagttaatgaatttaaacaattggtggtagctttctttaaagaacactggcctaaaatgttaattattatcggtattatagtattacttttaatattaaatgccatattcactacagttaataaaaatgatcatacaaatgatagtgcatttaacggtacagctaaagatgaaacaacagcgatgaaaattgctgaaaactctgttaagtcagttgtaactgtcgagaatgatttgtctaatgacacgactgtgtctgataacaaaaatgaatctgataatgagataggatcaggtgtcgtctacaaaaaagtgggcgactctatttatatttttactaatgcacacgttgtcggtgatcaagaaaaacaaaaagtaacatatggtaatgataaatctgtgacaggtaaggtaattggtaaagataaatggtctgatttagcagttgtaaaagctaaagttgctgacgaaaatattaaaccaatgactatgggggattctaataatattaaattggctgaacctattttagttataggcaatcctctaggcacagactttaaaggaagtgtttctcaaggtattgtgtctggactcaatcgtcatgtacctgtggacattgataaaaatgataattatgatgctttgatgaaagcttttcaaattgatgcgcctgtgaacccaggaaattcaggtggtgctgtggtcgatagagacggtagactcataggtatagtttctttaaaaattgatatgcataatgtagaaggaatggcttttgcgatacctattaatgatgtacgtaagattgcgaaagaattagagcataaaggtaaagtgaactaccccaatactgaaatcaaaatcaaaaatgttggtgaccttgacgattctgaacgtaatgcaatcaacttaccagctaaagtgaatcatggtgtattaatcggtgaagtgaaagaaaatggtttaggagacaaagcaggtttaaaaaaaggtgatgtaatagtagaattagatggtaagaagattgaagataacttacgatatagacaagtcatatatagtcattatgatgatcaaaaaacaattactgctaaaatttatcgaaatggtgcggagaaaaatattaaaatcaaattgaaataa

SEQ ID NO: 2026 - DNA, 954 bp, Staphylococcus epidermidis
agagggtggcttttaatgagtaatgaaaatgtattattacaagttaaaaatttaaaacagtattttaatcaaggtaaacataatgaagttaaagcgattgataatataagttttgatgtttataaaggggaaactttaggcctagtaggagagtctggatgtggtaaatcaacgactggaaaagccattatcaaattaaatgatattactgatggcgcaatcgagtatgatggtaaagatattcatcaaattagaaaacgtaaagagcgattgaagtttaataagaaaattcaaatgatatttcaagatccttatgcatctctaaatcctcggttaaaggtaatggatatcgtagctgaaggaatagatattcacaaacttgctagtagtcagcgtgatcgaaagaaacgtgtatacgaccttttagaaacagttggtttaggtaaagaacacgcgaatcgttacccacatgagttttcaggcggacaaagacaacgtattggtatcgcacgtgcattagctgtagagccagaatttattattgcagatgaaccgatatcagcattagatgtatcgattcaagctcaagtcgttaatcttttattaaagctacaacgtgaacgtgatattactttattgtttattgctcatgatttatcaatggtgaaatatatttccgatagaattgcagtgatgcacttcggtaaaattgtagaaattggaccggctgatgatatttataattatccattacatgattatactaagtcattattaagtgccattccacagcctgatcctgatgttgagagaaatcgtcaacgtgttttatatcatgaagatgcaacgcttaatgaagaacgtcaattaaatgaaattagaccacaacattatgtattttctactcaaaacgaagcagttaaattgaaacaaaagtatggtttgtctgtttaa

SEQ ID NO: 2027 - DNA, 453 bp, Staphylococcus epidermidis
gggaaaaccagtgaaaatggaggtgatactgtgtttcaaatagcaaaaaaccaaacgatgctagatgattgctttgaaataagaaagtgtgttttcgtcgaagaacaaggcgtaccactcgaaaatgaatttgatcaatatgaagattactcattccatatagtgggatatataaatggtgttcctatggcaactgctagaattagacctttaaatactcatatttgtaaaattgaacgtgtagcaatcatcaagtggtatcgtggtcttgggtacggtaaaaatttaatacatgctattgaaacaattgcaaaaaaacaccaatacaatgaactcactatgaatgctcaattacaagctcgagacttttacttaaaactaggttactcaccttttggtaaagtattcttagaagaaaatataaatcatattagtatgaataagtttttataa

SEQ ID NO: 2028 - DNA, 312 bp, Staphylococcus epidermidis
tgccccaggcttttttattgcaaacacagacaacaatttaatttaaaaacccgcttaatatcgagttatttcaacatttgtctaaacccagaatttcaaacagaaattctacagacaaggcaagttggggttcggggccccaacatagagaatttcaaacagaaattctacagacaaggcaagttggggttcggagtatgtttagacaacgcgcttataacttatgccccactgaaaccatttataaaaattcaatctgtaaacaaaattaatgtttattcatttatatacatcacacacctttcattatga

SEQ ID NO: 2029 - DNA, 150 bp, Staphylococcus epidermidis
caaatactaagattttttgaagacaatactaaaatcgtgcagaatgtgttcaaatttagtttcgttaccttgcaaccatacttaataaataatgaacactttataaagcaaatttacgacaaagcatggtattgtacgccttatttatag

SEQ ID NO: 2030 - DNA, 273 bp, Staphylococcus epidermidis
tcagtttcaagagtaataaaaatagcacaaagaattatggaggattacgaatgtataaaatctgttagcgccttagaagataaagagaaggaaatacgagagaaagatgatttattaaataaagcagttgggcgtattgaaaatacatacgataatttcaatcgactttacgaaatggcaaagccatttaaagagaatgtagaaatagctttaaagcttttaaaaattttactaaaagagctaatgaagaaacacatttgcggaaagagttaa

SEQ ID NO: 2031 - DNA, 1545 bp, Staphylococcus epidermidis
atagagtcaagaaagacatttgccatcatttcacaccccgatgctggtaaaacaactttaactgaaaaattgttgtatttcagtggagcgattcgtgaagctgggacagttaaagggaaaaagacgggtaaatttgcaacaagtgattggatgaaggtaaaacaagaacgtggtatctcagttacaagctctgtaatgcaatttgattatgatgattataagataaatattttagatacgcccgggcatgaagatttttcagaggatacgtatcgtacattaatggcagtagatagtgcagttatggttattgactgtgcaaaaggtatagaaccacaaacattaaaattatttaaagtttgtaaaatgcgaggtatccctatttttacattcatcaataaattggatagagtagggaaagagccatttgaattacttgatgaaatagaagaaacacttaatattgacacttatccaatgaattggcctgttggtatgggacaaaatttctttggtattattgatagacactctaaaacgattgaaccatttagagatgaagaaaatttattacatttaaacgaagattacgaacttaaagaagaacacgcgataaaaaatgatagtgcatttgaacaagcaattgaagaaatgatgcttgtcgatgaagcgggtgaagcatttgataatgaagcgttactgaacggtgaattaacacctgttttctttggatcggcattagcaaacttcggcgtacaaaatttcttaaatgcatacgttgatcatgcgccaatgcctaatgcgagacaaactaaagaagaggttgatgttagtccattcgacatagatttttctgggtttatctttaaaattcaagccaatatggatccaaagcatcgtgacagaattgcatttatgcgcgtggtaagtggtgcgtttgaaagaggaatggatgtaaccttacaaagaactaataaaaaacaaaaaataactcgttccacatcatttatggctgatgataaagaaactgttaatcatgctgtagcaggcgatattattggtttgtatgatacaggtaactatcaaataggcgatactttagttggtggtaagcagaaatatagtttccaagagttaccacaatttactccagaaatatttatgaaggtttctgccaaaaatgtaatgaaacaaaagcattttcataaagggattgaacagcttgttcaagaaggtgcaattcaatattataaaacgttgcacacaaatcaaattatcttaggtgctgtgggtcaattacaatttgaggtgtttgaacaccgcatgaataatgaatataatgtagatgtggttatggaaccagttggacgtaaaattgcgcgttggattgaaaatgaagaagatattaaagataatatgaatacttctagatcaattttagtaaaagatagatacgacaattatgtattcctatttgaaaatgaatttgcaacgcgttggtttgaagaaaaattctctgatattaaactgtatagtttattataa

SEQ ID NO: 2032 - DNA, 486 bp, Staphylococcus epidermidis
aaagcacaaaggtttgcaaaattaaaaagtgccagacgtgtcattgccattgatcatgttgagcatagattagctcataccgagaaatataacggtgctgaggtttataattttttaaaagaagatgacgtaggaaaactattacatgaaacaacacgcggtggtgcagatgttgttatagattgtgtcggaatagatgaacaagtagttcaagatgacttagaagttagctcaaattcaatacagagaggaaatatcagcccaattgttacggcaacagaatcagtgagaaaatatggaacaatccaattgataggtgtctatggaactgcagctgataactcccaattagacttaatatttaatagaaatgttcaagtgaaaagtggacaagcgccagttattcatatgatgccaaaactttatgacatgattaaaataaagtctttgatccaacagaaattatcactcatactatgcctttaa

SEQ ID NO: 2033 - DNA, 135 bp, Staphylococcus epidermidis
cccacaaaaaggcctcacaaaaaggatgctttggttacccaaggggaccttccagtttttatcctaaggtgggcctatgggattaaattaccccaggggatgcctaaggtgggccttttgactggtagaaattag

SEQ ID NO: 2034 - DNA, 222 bp, Staphylococcus epidermidis
tctgaactgagtacttcaatcatttcagctctaatatatcttgcaacagttgctaaaactgtagctgatagtgctagagaaggtaaaatagctgtagaaaaaccttcccatcctgcaactggaaaccattctaacttaactgcaaatacatactgcaataaaactgctaagacaaatgacggcactgatactgcgataacagagataattgttgttgtatag

SEQ ID NO: 2035 - DNA, 729 bp, Staphylococcus epidermidis
gatgatatgagaatagaacgtgttgatgatacaacagtaaaattgtttataacatatagtgacattgaagcacgtggttttagtcgtgaagacctatggagtaaccgtaaacgtggtgaagaatttttctggtcaatgatggatgaaattaatgaagaagaggattttgtagttgaaggtccactttggattcaagtacacgcttttgaaaagggcgtggaagtaacaatttctaaatcaaaaaatgaagatgctatgaatatgtcagatgatgatacaaatcatcaatttgatgatcaggtaaatgaattattggctcaaacacttgaaggtgaagaaagtttagaagatttatttgaacaacgtaaacaacaaaagaaaaaccatcaagataaacaacaaagacgtgcgcataagccatcaaatgtgagaaatattatagtgaagtttgacgatttagagcaagttatcgactatgcttatcataataatcaaaacactgatgaatttgaagatttattatatatgattgataataaatattattactcaattcattttgatgattcagtttcacaagagatgattaacgatagttatagtcagttattggagtttgcatatccaactgataaaacaaatatttatttaaacgactacgctaagattattatgagtcacaatgttacttctcaagtacgtaaatactttactgatacaaacgaataa

SEQ ID NO: 2036 - DNA, 1407 bp, Staphylococcus epidermidis
atatgttttggaggtgttaacatgtctaacgaaactgaaatgaaagacaacgttcgtgaagacgtatatgataaagaattatttgatcgattattagatcaaaatgatatagatgaattcagaaaagaatttttagaattacataactatgaacaaagtgaatactttgaagatacggatgatgaaaatagacaaaaaatatttgagtttttatcacccaaagaagtagcaaatttctttgatcaattagactttgatgacgatgattatgagagcctttttgataatatggacgctacctatgctagtcatgtcttagaggaaatgtcttacgataatgcagtagatattttaaatgagttatctaaacctaaagtggcgagtttgctaacattaatgaacaaagataaagctaatgaaatcaaagctttattacattatgaagaagatactgccggcggtataatgactacggagtttatctctttaaaatcaactacacctgttaaagaagcgttaattcacgtaaaagaacaagcgcctgatgctgaaacaatatatgtcatattcgcagtaaatgaagatgaacaacttgttggtgttctatcacttagagatcttattgtagctgagaatgatgcatacattgaagatgttatgagtgaacgtgtcatcagtgctaatgtcggtgatgaccaagaagatattgctcaattaatgagagactatgattttatagctgttccagttgtagattatcaaaatcatttactaggtattattactattgatgatatcctggatgttatggatgaagaagcaagtgaagactactcacgattagctggggtatctgacatagattctacaagtgactcagtgtttaaaacggcgagtaaaaggttaccatggctcattgtattaacatttttgggtatgattactgctacaatattaggtagttttgaagatactttatctcaagtggcattacttgcagcatttattccaattataagtggtatgtcaggaaattctggtacacaatcattagccgtttctgtccgtaatatatctactggggaaataaatgaacagagtaaatttaagattgcattgcgagaagcgggaagtggtttattatctggtattgtatgtgcagttatccttttcctaattattgtcgtcatattcagacaaccgttattagctttaatagtaggtggaagtttgacatgcgcaatgacagtaggtacattagttggttcaatgattcctttagtaatgaacaaatgtaaaattgatcctgctgttgcaagtggtccttttattacaacaattaatgacattgtgagtatgcttatttatttcggattagctacatcattcatgtcatacctaacataa

SEQ ID NO: 2037 - DNA, 510 bp, Staphylococcus epidermidis
atgattttaggattagcattggttccgtcaaagtcatttcaagatgaggtgaatgcttatcgcaagcgatatgacaatcattatgctcaaataatgcctcatatcacgattaaacctcaatttgaaatcgatgatcatgattttaatttatttaaaaatgaagtgaaaaatcgaatttctagtattaaaccagtagaagtgcatgctacaaaggcatctaatttcgctccagtcagtaatgttatatacttcaaagttgctaaaacagagtcattagagcaattatttaatcaatttaatacagaagatttttacggtatagctgaacatccttttgtacctcattttacaattgcccaaggtctaacaagtcaagaatttgaagatatatatggtcaagtaaaattagcaggggtagaccatagagaaataattgaagaactatcgttacttcaatatagtgaagaagaggacaaatggactattattgaaacttttacattagggtaa

SEQ ID NO: 2038 - DNA, 165 bp, Staphylococcus epidermidis
aatatcaaaggcgccggaactataaatggtcttacatatagacccgctctttatatccaacctctttatacgtgttataaccaaggaataaatttctatgaaggtggcttccaagaaaaaatatttaaacatttaaaagagaacttctctggaaaaattcttcgc

SEQ ID NO: 2039 - DNA, 1647 bp, Staphylococcus epidermidis
aggatgaaaggttttaaagtcttaattattttattaagtgtatgcataattttatctgcttgtagtaataagcagagtttatattcagaccaggggcaagtttttaggaaggtaatcacacaagatatgactacactagatacagctttaattacagatgctgtttctggtgatatagcagctcaagcttttgaaggattatatactttaaataaagaagacaaagctgaaccagctattgctaaatcttttccaaagaaaagtaatggtggcaaaacacttacgattaatttaagaaaaaatgcaaaatggtccaatggagattcggtaactgcatatgacttcgtatatgcgtggagaaaggtagttaatcctaagacggcttctgagtttgcatacataatgagcgatataaaaaatgcagatgaagttaatgcaggtaaaaaatcagtcaaggatttgggtatcacggctataggtaaatataaattacaagtagatttagaaagacctgtaccttatattaatgaactattagcacttaatacatttaatcctcaaaatgagaaagttgctaaaaagtttggagaacaatatggtacaactgctgaaaaagcagtgtacaatggaccatttgaagtaacaaattggaaagtggaagataaaattcaattagttaaaaatgaacaatattgggataagaagaatgtaaaattagataaagtgaactataaagtattaaaagatcaacaagcaggtgcatcgttatatgatactggctcggtcgatgatactattataacttctgaacaagttgataaatatagaggagaatctgctttgaattatcgtttaacagcagcaacattctttattaaaatgaatcaaaaaacagttcctgaatttaaaaataagcatttaagattggctatatctcaagcaataaataaaaaagggtatgtcaattctgttttaaatgatggttcgctaccatcaaataattttactggagtaggaactgccgatacaccggatggcaaagattttgcaagaaccatcaaatcaccattaaaattcaaccctgatttagcgaaaaagaattggagagaagcacaaaaagaattaggaaaaaataaatttacttttacgatgaacacacaggatacacctgcttcaaaaattgctgccgaatatataaaatctcaaattgaaagtcatttgccaggtgtgacactcaaaattaaacaaatgccatttaaacaaaaaactactttagaattagcaaataactatgaagcaagttattcagggtggagtcctgattatcctgacccaacagcatttcttcaaacaatgacaaaaaataatgcacagaataatacagattggagtaataaagaatacgatcaattactcaaagatgctaacagcaagtttttacgaaagccaggtgaacgtaatacctcattacaaaaagcggaatatatcttattacatgaagcgccagtcgctcctgtttatcaaaaaggagaagcacacttaacgaatccgcaagtaaaaggattacaatatcacaaagtagggcctgaaacgacgcttaaacatgtctatattgataaatcaatcaatagggagacaggtaaatag

SEQ ID NO: 2040 - DNA, 204 bp, Staphylococcus epidermidis
tttaagggaggactcgtaatgactgttgcagaagtaggtaatatagtagaattttatgacggtttaagaggccgtgtcgagaagattaatgataactctgttattgtagatttaactattatggataattttaatgaattagatttaccggaaaagacagttatcaatcataagcgatacaaaatcgttgatcaagaaggttaa

SEQ ID NO: 2041 - DNA, 420 bp, Staphylococcus epidermidis
aaagatggggggacaaacatgttacatgtccatattttaagttgggtattagcaattattttatttatcgcaacttatttaaattattcacaaacgcaaggtgcatcaccttattataagcctttgcatatggcattaagattattcatgctattaacattaatttctggtttttgggaattaatcgaagagtttatggctgcctctaatggtgaaggtggaaatcatatgctacttactttaaaaatgttatgtggtttagctgttatcgcatttatggaaatttctattgctaaaagaaaaaaacaacagactagccataaattcttttggattactattattttaatcataattacaatggctattggtgttattttaccttggggcccaatttctaaaatatttggaataagttaa

SEQ ID NO: 2042 - DNA, 168 bp, Staphylococcus epidermidis
atcataattttaaagtttattaatcttcctcgtactatttataacggtgtatgtgtaactttttctttaattaatttaaaaaagcatttcttagctcaaattcatgagtctaagaaatgctttttttatccgtggaatatcaataataaaatgatagccacaatttga

SEQ ID NO: 2043 - DNA, 3489 bp, Staphylococcus epidermidis
gggaatgttatggaatttaatacatatattggtcgagcaggtacaggaaagtcaacagccatgcttaatcaaataaaaaataaaatgaagcaagacccgctgggtgatcctatagtattaattgcacctactcagagtacttttcaattagagcaagcatttgtaaatgattccgaacttcatggtagtttgagaactgaagtacttcactttgaaagattgagtcatcgtgtatttcaagaagttggtggtttgacagagcaacgattatctaaggacgctttagaaatgatgattttccatattgttcaacaacatgagtctgatttgaaattgtatggttcacaagctcaatactatggtttaagcgaaaagttagctgagcaaattcaagattttaaaaaatataatgtcactcctgaacacttaaatcaattgatagaaaatcattcaatacaaacgagaacaaaacataaattagaagatatttctcttatttataaacaattagaatcacgaatgaatggtgaatttataacaacagaggatagtttgcaacaattcattgaaatactatctcaatctcagtggataaaaaaggctgaagtatttattgatggattccataatttttctacattggaatatagaattatagaagcacttgttcaacacgccaaacaggtgactgtattattaacgaccgatggcagccatcatccatttagtttatttagaaagccatctgaagttttatcacatttggaggatatcgctaatcgtttaaatataaatctaaataaaacatattttaatacattttatcgctataacaatgatgatttaaagaatcttgaaaatgggtttgatgcattacaatttacgcctaaacatcatcaaaatcatgttaaaatatttgaatcttcaagcatgagagaagaaataaatgaagtagctcgacgtattttaaaagatgtcagagaagcagattataaattcagggacattgctatattataccgtgatgaatcgtatgcatatctattcgagtcaatacttccttcatatgatataccatttaacattgatactaaaaagtctatgacacatcatcctatcatggaaatgttacgttctttattggaagttatacgttcaaattggcatattaatgcaatgttacgattatttaaaacgaatgttttaacgtctcaatttaaaagaagtagctatttaattgatttactggagaatttcgttttagaacgtggtatttatggtaaacgttggttagatgaagatatctttagtattgatcagtttagtagaatgggacgtaaatcacatcaactaactgaaggacatcaagcattatacaaagaagtaattaaacttaaaaagaatgttataaataaagtgttatatttcgagcaagctatgaatgaagcgcatactgttaaagattatgctacgtcattttatgaaagtttggagtattttgaactaccgagtcagttaatgactcaacgtgatgaattagagttagcgggtctaacagaaaaagccgaagaaattgaccaagtatggaatggtttaatacaaattttagatgatttagttactgtatttgatgatcaggaaatgacacttcaacaatttttagatgtttttgatataggtttagagcaattagagtttgttatgatacctcaaactttggatcaagttagtatcggtacaatggatttagcgaaagttgataataaaaaacatatttatatggttgggatgaatgatggtatattaccacagactgtatcttcatcaagtttgattacagatgaagagaagaaatatgttgaggacaatgcacatgttgagttaagtccaacttcagatatactgcaaatggatgaagcgtttgtatgttacatcgctatgacaaggagtcaacaaagcgttactttttcatatagtttaatggggaattctggagatgagaaggaaattagtccttttttaacgcaaattaaagaattattttatgatttagaaatcatcaatctacaagatttacataaagcgcaaccattattaatgatgcaacattcacatcaaactaaaattcagctttttgaatatttaagaggttggttagaccatgaagacatcgattatcgttggttggatgcatatttagctattcgagacgatgatcaattaaatcaaggtttagattatcttactacgtcattgacatatgataacgagactgtccaattaaatgaaattttatcacaacaactttatggtaaaactatcaacgctagtgtgtctcgttttgaaggttatcaacaatgtccttttaaacattatgcctcgcatggtttaagattaaatgaacgcactaaatatgaattacaaaattttgacttaggagatatttttcattcagttttaaaatacatttccgatcgaatttatggtgacttcaagaatttagatacaaagaatattcaatcacttactaaagaagcattagagcttattttacctaaagtacagtttaatttgttaaattcgtctgcgtattataaatatttatctaaaaagattggatcaatcgttgaaacaactttaaaggcacttaaatatcaaggggagtactctaaatttgtacctcaacgatttgaaacaggatttagaaaatcacctaaaaacaaaggtgaacttgttgcacaaccactgattaccaatcagggaattccgattaatataagaggtcaaatcgatcgtattgatacatatacaaaaggtgatcatagttatgtcaatatcattgattataaatcttcagaaagtagtgcaacactcgatttaacaaaagtttattatggtttgcaaatgcaaatgatgacctacatggatattgtattacaaaacaaggagcgtttaggtcttacagatattgtgaaaccagggggtctactttatttccatgtccatgaaccgcgtattaaatttaaaagttgggcagatatagatgaagaccaatttcaaaaagactatatcaaaaactttaaaatgagtggtttgcttaatcgtgaccaagaagtgttagacgctttagatattagacttgaaccaaagtataattcggatattgttccaatagcattaacagctaaaggcgctataaatcaacgtagtagtaaagtagctgatgaaaacatcatttatcaattaatagaacataataagaagaattttatcgagacagccagccacattatggatggacatacggaagtggcacccttgaagtacaaacaagtattaccttgtcaattttgtaattataaatcagtttgtcatgtagacggattaatagatagtaagcgttatagaacagtagatgaatcgataaaaccattagatttaattcaacaattaagaaatgaaggtggtgaaagacatgattccaactaa

SEQ ID NO: 2044 - DNA, 783 bp, Staphylococcus epidermidis
ggagtcactatcatgttaaatctagaaaataaaacctacgtcattatgggtattgcgaataaacgtagtatcgcatttggcgtcgctaaagtattagatcgattaggtgctaaactggtatttacatatcgtaaagaacgcagtcgtaaagaattagagaaattattagaacaattaaatcaatctgaacatcatctctatgaaattgatgtgcagaatgatgaggatatcattaatggtttttctcaaatcggaaaagatgtaggccagattgatggtgtttatcactcaatcgcatttgccaatatggaagatttacgaggtcgattttcagaaacatctcgcgaaggtttcttacttgcacaagaaattagttcatattcacttactctcgtagctcatgaagccaaaaaacttatgcctgaaggtggaagtattgttgcgacgacttatattggtggtgaggcagcagttcaaaactataatgttatgggtgtagctaaagcaagtttagaggcgaatgttaaatatttagctttagacttaggtgaagataatattcgtgtcaatgctatttctgcagggccaattcgtactttaagtgctaaaggtgtaggtggatttaatacaattcttaaagaaattgaagcgagagcgccgttaaaacgcaacgttgatcaagaagaagtaggtaagacggctgcgtatttattaagtgatctttcaagtggtgtaactggagagaacatccacgttgatggtggattccacgcaattaaataa

SEQ ID NO: 2045 - DNA, 447 bp, Staphylococcus epidermidis
ctccaatatatcgatggattgattgacaaacaactgattgatgaagatgcaaaagaggatgtgagaagagatgagattatgcatttcattgatggccctctctatatggaaatagctcaagctgacaatgtttatactgaattaccttttgtggtaaatcaaattaaagttgatggacttacaagtgaagatgaagatgtatccattattcaaggtatgattgatttaatatatgaaagtgacggacaattttactttgttgattacaaaacagatgcttttaatagaagaaaaggtatgagtgatgaagaaatagggaatcagctcaaagaaaaatatcagatacaaatgacgtattatcgaaatactttagaaaccatacttaaacgacctgtaaagggttacttatattttttcaaatttggtacattagaaatagatgattaa

SEQ ID NO: 2046 - DNA, 1854 bp, Staphylococcus epidermidis
ggaggtcatatggaattcttatctttagttatagtcgtcgtagctgcatttatgactccgatcattgtgcatcgttttaatataaactttcttcctgttgttgtagctgaaatattgatggggatagtgataggtcactcttttctcaatttagtggaaagagatgcattccttaatattttatctacgcttgggtttatctttttaatgtttttaagtggtctagaaattgactttaatgcatttaaaaaggattcacgtccaagacaaggagaagataaacatgaaaaggatgtacctgggcatcttaaactggcactgacagtatttgcatttattatgatgatttcggttgttttagcttttgcatttaaatggttaggattagttaatgatgtccttttaatggtgatcatcatttcaacaatttctttaggagttgtagtaccaacccttaaagaaatgaacattatgcgtacaacgataggacaatttattttactagtagctgtattagcagatttatttaccatgattttactaactgtttatggtgctatttatggtgaaggtggtagtacaatatggcttacaggtattttagtcgtatttacagttgtcttttatgtaatcggtgtgttatttaaacgtatgtccttcttacaaaagttaatggatggtacaacgcaaataggtataagagcagtatttgcacttattattttattagtagcacttgctgaaggtgttggtgctgaatacatattaggtgcatttcttgccggtgtcgttgtttctttacttaaacctaatgaagagatggtcgaaaaattagattcctttggttatggtttctttattccaattttctttatcatggtaggtgtcgatttagatatcccaagtttaattaaagaaccatcgttgttacttattatacctgtactcattttttcatttattatttcaaaattgataccagtattttacattagacgctggtttgacactaaaactaccattgcatctgctttcttacttacatcaactttatcacttgttatagctgcggctaaaattgctgaaaaattaaaagcgatttctccggaaacttcaggcattttaattcttagtgctgtgattacatgtgtcttcgtacccgtgatattcaagaagatgttcccaattcctaatgaagtgggacgccgcatagaagtaagtatgattggaaagaatcaattaactattccaatagcacaaaatttaacttctcaattatatgatatttctttatactatcgaaaagatttgagtgatagtagaaagctctctgacgatattactatgatagaaatagcagattacgaagaagatttattagaacgcttgggacttttcgagcgagatattgttgtatgttctacaaatgatgaccatataaataaaagcgttgcgttaatggctaaaaaacatggtgttaaacgtgttatatgtcgactcgaaagcacaaacgaagatccgacattgaaacatcaaggtatagaggtgtttagtaattatttaagtaataaaatcttactaaaaagtttaatagaaacacctaatatgctgaatttattaagtaatgtagaaacatctctatatgaaattcaaatgttaaattatcagtatgaaaatattcaattacgtaatttcccatttggtggcgatattatttttgttcgtattataagagataacgattcaatcgtacctcatggtgatacacagttacgatataaagatcgtttgattgtgacgggaactaaagaatatgtagatgaattaaagcaagaattggaattttattattaa

SEQ ID NO: 2047 - DNA, 279 bp, Staphylococcus epidermidis
aagcagcatatcaaaaatttggtggtggacctcttgaggattaaatcacttcagtttcatggaatgatgataaacgtatatcattatcattctaatgatttaatcatgttagctattccagaacttttttggtccattgagttatccaaagagttagatgcaaatcagctatatgaggaattagtgatgcaattattcaatttgttgactgaagttgaagcagatacattggcaagtaatataactgatttgattagaaatgaatccaaaggagaatga

SEQ ID NO: 2048 - DNA, 999 bp, Staphylococcus epidermidis
gcatctaatatggaaactttattctcaggaattcagccaagtggtattccaacaattggtaactacattggtgcattaaaacaatttgtagatgttcaagatgactatgaatgttttttctgtatcgtagaccaacatgcaataacggtaccacaagaccgcttaaaattacgcaaacaaatacgtcaactcgcagcaatttatttggcaacaggtattgatccagataaatcgactttatttattcaatctgaagtccctgcacacgtgcaagctggttggatgcttacaacaatagcttctattggtgaattggaacgtatgactcagtttaaagacaaagctcagaaacgcgcagatggagtgcctgctggtctactcacttatccaccattgatggcggctgatatcgtgatttacaacactaacattgtccctgttggtgatgatcaaaaacagcatatggaactgacacgtaatttagtagatcgtttcaatagtagatataacgatgtattagtaaaaccagaggtacgaatgcctaaagttggtgggcgtgtgatgagtttacaagatcctactaaaaaaatgagtaaaagtgatgataatcagaagaatttcatttctttattggatgaacctcatgtagctgccaaaaaaattaaaagcgctgtaacagactctgacggtataataaaatttgatcgtgagaataaaccaggcatttcaaatttactttcaatatattctggtctaactaatgaatctattaagaatattgaatctaaatatgaaggtgaaggttacggtaaatttaaaggtgatttatcggaaatcgttaaagattttcttattaatttccaagaaaaatatgcaagcttttataattctgatgacctagatgatattctagataaaggtaaagaaaaagctcaaaaagcttcatttaaaacattgaaaaaaatggaaaaagcaatgggcttaggtcgaaaaagataa

SEQ ID NO: 2049 - DNA, 858 bp, Staphylococcus epidermidis
acgatgattttaacatatcaaattgtacagtcagaaccagtgaaaacttttttgaaaaatcaagattattctaaacgcacgttgagcgccattaaattaaatggcgctttactattaaacggttcacctgtaactgtcagacatgttatgaacaaaggtgatagattagaagttcattttccatgtgaaacaccaagtgagaatttgattccatacgataaggaattagaagtcatttatgaggatgcgtatttgataattgtaaacaagccacaaatgcaaaattgtgcaccttctagagaacatccccatggcagtttagtagaacaagtgcttgcttattatacaaaaaaaggcgaaaaaataaatcctcatattgtgactcgacttgatcgaaatacttcaggtttagttgtatttgctaaatttgggcatgtacatcatttgttttcaaaggtgaaatttaaaaaagaatatgtcgccttagcctatggccatacacaatcttcaggtgttattgaagcgccaattgcaaggcggagtgatagtatcattaaacgagaagttaatgataaggggaagtatgcaaaaacagtctatcaaaggcttatgcaaaatgagactgctagtttatgtaaggttaaattgcttactggaagaacgcatcaaattcgagttcactttgagtatattggacatccattaattggtgatgatttgtacggtggaaatcatccttgcgttcatggacaagcgttacattgctgttcagttgaatttatccaccccatatatagatctcattacctaataaatgttgactacaaacaattaattaaattattcaacatggtataa

SEQ ID NO: 2050 - DNA, 1215 bp, Staphylococcus epidermidis
ggtgtaaatatgaaagataaaatcgttttagcatattcaggtggtttagatacaagcgttgcagttcaatggcttattgataaaggatatgatgtagttgcttgttgtcttgacgtaggcgaaggcaaagatttagacgttgtatatcaaaaagctttagatatgggtgcagtcgaatgtcatattattgatgcaactaaagaatttagtgatgattatgtaagttatgctattaaaggaaatttaatgtatgaaaatgcatatcctctagtttcagcattatcacgtccactcatcgcgaaaaaactggttgaaattgctgaaaaaacaaattctattggtattgcgcatggatgtactggtaaaggtaatgatcaagtacgtttcgaagtggcaatcaaagctttaaatcctaagttaaaagcatttgcacctgttcgtgaatgggcttggagcagagaagaagaaattgattacgcaatcaaacataatattcctgtttcaatcaattatgactcgccatactcaattgaccaaaacttatgggggagagctaatgaatgtggtattttagaagatccgtatgccgcacctccggaagatgcatttgatttaactacacctttagaagaaactccagacaatgcagacgaaattatccttacatttaaacaaggtattccagtacaagttgatggcaaagattatcaattagatgaccttattctttacttgaatcaacttgctggcaaacacggtattggtagaatcgatcatgttgaaaacagaatggtcgggataaaatcgagagagatttatgaaacacctggtgcggaagttattttaaaagcacacaaagcactagaaacaattacattaactaaagacgtagcgcactttaagcctgtcattgaaaaacaattttcagaacaaatatacaatggtttgtggttctcgccattaacagatagtttaaaactctttatcgatagtactcaacaatatgttgagggagatgtgagaattaaattatttaaagggaacgctattgtcaatggcagacaatctccttacactttatacgatgaaaaattagctacttatacaaaagaagatgccttcaatcaagaatcagcagtaggtttcattgatatttatggtttacctacacaagttaatgcattacttcacggggggtatagtaatgagcaataa

SEQ ID NO: 2051 - DNA, 792 bp, Staphylococcus epidermidis
tacaatagtattaacattacaagggagcatcggtttatgtcggagtttaaagtaggtaagattaataaaaaaataatacatagtgatattttaaatagagatgtaacattatcggtttatttacctgaggattatacaaacttatttaaatatcagttgattttttgctttgatggtttagatttttttagatttggtagaatacaacgcatatatgaacagttacgtgaagaacaatcaatacaacgtgcaattatagtaggattccattacgaagatgttgaaaaacgtagggaagaatttcatccttcaggaagtcgttctaatttaaccattaaagcaatgggaaaagaaattcttccttatatcgatgcgacatttccaacttataaagtaggtaatacaaggttacttattggagatagtttagcaggaagtatcgctttaatgactgcaatgacttacccaactatttttagtcgagttgcgttattgagcccaatgtataatgaaaatattaagaaaaaaattgatacatgtatgaataaaggtcaattgacgatatggcatgccattggtttagaagaagcagattttattttaccaactaatggtaaaagagctaactttttaacacctaaccgcgaattaaatcaactgattaaagaagataatattgaatatttctataaagaatttaacggtggacatcattggaaatcatggaaaccattgctaggagatattctcttacaatttttaggtgatccaataaatggaaaatatgtttaa

SEQ ID NO: 2052 - DNA, 606 bp, Staphylococcus epidermidis
aaattgagtataaactttagctatcaatatctaaaaggggagtcaaatgtgattagaaaagcgaaaacgagtgataatcgacagattgcagagttatgttaccttatttggagagatatggaattagatattaccaaggaaataactaaagatcgtattattgaagcgatagaattaagtattgtgaatgtgagatatcggtcgttttatgagcatatttgggtatatgagaaagacggggttgttgctggatgtgtaattgcgtatcctgggaaagaggaaatggattttgaacaacaatggcttaagttaccacttgaagaagatatccttcagttaggtacaccattacctgaaaaagaatcatacgatgatgaaatatatatagaagcagtagtaacgactccaaaatatcgaggacaaggtattgcaacacaacttttaaagtatgtaatttccactcatgcacatgaaaaatggggattgaattgtgattatgataataataaagcacgccacctatatcacaaattagggtttaaagaggatgcgacaattcgtttatatggccatcaatattttcatatgacattgaataataagtaa

SEQ ID NO: 2053 - DNA, 171 bp, Staphylococcus epidermidis
attcaaatcattatttgtcagtgtgataagtttttcaagttgtttatacatgttgttctactccactatattaagttaataatattatatgccttatttataaattatacaatacaaatatacacattgcacaaattcgttgcatcattacctatttttatactacattag

SEQ ID NO: 2054 - DNA, 150 bp, Staphylococcus epidermidis
tgttttcgcattcaacaaccattcgctaacatactattttatttatcttactttattaaacatattttccatttattggatcacctaaaaattgtaagagaatatctcctagcaatggtttccatgatttccaatgatgtccaccgttaa

SEQ ID NO: 2055 - DNA, 585 bp, Staphylococcus epidermidis
ggttttttaatgacacatttacccgaaacgatttatgttatacgaaaaggtgatatggtaatacgacctaaatatgatgaatatcagcaaacaaatggtactgaaattatcagatttgatcaaactcgcaaagaaagtccatttaaagtacagagaattatcgaaagatcatgtaaattttatggtaataattatattagtaaaaaagcagaaacgaatcgtattactggaatctctagtaaaccacctattttacttacgcctctttttcctacttacttttttccaactcactcagaccgtcaagaagaaaatatatggattaatatgcattatattgaaaatgttaaagaacttaaaaatcgtaagagtaaaataatttttgcgaatggtgattcgttaacgctcaatgtatcatttcatagcttgtggcatcaatatacgaatgcaatcatctattattacatggtagataagcaatcacgaatgaaatctaacaaccctgaacaacccattgactataatcagtcttctctaaatattttcgaggcgctctcacgctactccctttttgaagaaaattag

SEQ ID NO: 2056 - DNA, 174 bp, Staphylococcus epidermidis
ttttatttaattcaacttcaactgaaacccaatcttttgtactttcatataacttatcgacgattgcctgttcgtctacattcacatccatttttttcacttctttctcctccgaattttactcattattatattgtatcatttttaatcttttatgtagttattaatgcttaa

SEQ ID NO: 2057 - DNA, 2304 bp, Staphylococcus epidermidis
tatgcaataatcaatgttataaagtttataaagggaggacaattaatggattttattaatattacaggtgcttcacaaaataacttgaaaaacatagatgtaaatatcccaaaacacttagtaacggtatttacaggtcgttctggttcagggaaatcatctttagtgtttaatactgttgctgcggagtctgaacagctactaaatgaaagttattctagttatattcaatttcatttaaatcaacaacccagaccgaaagtaaagaaaattaaaaatcttcctgtagcaatgacgattaatcagaaaagattcaatgggaattctcgctccacggtaggaacagtttcagatatatatgcttctgttagattactgtggtctagaataggcgaaccgtttgttggttattcagatgcatattccttcaatagtcctaagggcatgtgtaaaacttgtgagggattaggatatattgaagacattaacttagatgaattgctagattgggataagtctttaaatgaaggtgcaatagactttccttcttttggaccagacaaagagcgtggtaaagcctatcgagatagtggtttatttgataataataaaaaattgaaagattatacaaaagatgaattagaattgtttttatatcaagagccaatgacattaaaaaatcctcctaaagaatggagaaagtcagctaaatatgtaggactaatacctagattcagtagaatatttttaggtgataaagaatttaataagaaacgctacgccaaacatcttaaaaatgtagtaaataataaaatctgttcaacatgtaaaggtcaacgtctaaactcgaaaatattaagttctaaaattatgagtaaaaatatttctgatttcacacaaatgacaattaaggaaaatttagagtttcttaataaattagaggatccaacagccaaatatattattgatcctctcaaaaagcagttagaagcactagaatatattggattaagttatttaacgcttaaccgtgtaacaacgacattatcaggcggtgaagcgcaacggcttaaattaatacgtcatttaaatagttctttatcggatttagtttacattatagatgaaccaagtgttggcttgcatccggaagatatagctaaaatcaatgaaattttaaaatcattaaaagaaaaaggtaatactgtgttaattgttgaacatgatcccgatgtcattaaagaaggagactatatcatagatatggggccaggttcaggaaaaaacggcggtgaaatcacatttgaaggaacatataatgaattactatcttcaaatacttcgacaggtaacgcattacgtaacaaacataatttaaaagagaatattcgtgaagctaaccacttttataatatcggtcctgtgacacaaaacaatttaaataacgtaaaaacgtctatacctaaacacgtattaacagtcttaacaggtgttgctggttcaggtaagagtacccttgttaaagcaggttttgaaaataatgaccataccatctttattgatcaaaaagcagttcaaggatctaatagatctaatctattaacgtatttaggtgtttttgatagtgtaagaagctatttcagtaaagaaacaggcttaaataaagctatgtttagttataattcaaaaggtgcctgtccaaattgtggtggaaagggctatattaaaacggaacttgcttttatgggtgatttttcacagacatgtgaagtttgtcatggcaaacgttataaacaagaagtattagatgctaccatagacgggtattcaattgccgatgttctcaatttgacggttgacgaaggtatcattttctttgataaaaagaatgatattaagtcaaaattacaatctgtaagtaagacaggtttgaattatatgtcactaggacaacctttgtccactttgtctggtggagagattcaacgcgtgaaactaggacaacatttagatgaagagataaagaatagtatttttatttttgacgaaccaactacaggcctacatgaatcggatatccctatattgatggagtgttttgatgatttaattgatcaaaacaatactgttattttgattgaacataatttatcgattatgtgtgaagcagattggatcatcgatgtcggcccaggcccagggttggatggcggaaaggtccaatttagtggaacacctaaaaacttcattgatagttcagaaacattgacatctaaacacttgaaacgctatatcaaacagtaa

SEQ ID NO: 2058 - DNA, 249 bp, Staphylococcus epidermidis
ttctttccaatcatacttacttctatgcggcgtcccacttcattaggaattgggaacatcttcttgaatatcacgggtacgaagacacatgtaatcacagcactaagaattaaaatgcctgaagtttccggagaaatcgcttttaatttttcagcaattttagccgcagctataacaagtgataaagttgatgtaagtaagaaagcagatgcaatggtagttttagtgtcaaaccagcgtctaatgtaa

SEQ ID NO: 2059 - DNA, 321 bp, Staphylococcus epidermidis
ttacttgcaatagaacctccaattagtagaaaaagtagtgatataagaaaagaaaaagttcaagtcttaagatccttgaaatgttttaatccaaatgaaattaaagaaagtttcgtacgtggtcaatatgatgggggaatgatgaataatgagttcgttcctgcatatagaaatgaacctaatgtaaattcacaatctaatactgaaacttttgtagcaggtaaaatagaaattgaaaactctaaatgggctagtgttacattttatattcgtacagaaaaaagaatgaaaaaaatctatccaaatcgttatagagtttaa

SEQ ID NO: 2060 - DNA, 1062 bp, Staphylococcus epidermidis
aaggatgtttttatgtttaaatctaagaaaataatcatttcaactttatctaccgttacactgggtttagctagtttaagttccccttcgatagctgaaacttcgaaccactctccagcaccaaaccaatcagagaaatcgatacaacaacaaacaaatattccatctaatatgaatcaatcatcagctaaaacatttaaacgacaagctgaatcagactcagtaagtggtaaaacaaacgatactcataatcattggactaaaaatttaactggagagaaatttacaaccattgcacatcgtggcgcaagtggttacgccccagaacatacttttgaagcatatgataaaagtcataatgaattaggagcatcttacatagaaatcgatttacaacgtactaaagatggtcacttggttgctatgcatgacgaaaaggtcaatcgtacaactaatggccatggacgtgtcgaccaacttactttaaaagagttaaaacaacttgatgcaggaagctggtttaatcgaaagcaccctgaatatgccaaaaataaatataaaaatgctaaagttcctactttagacgaaattttaaatcgctatggcaaaaatgcaaactattatattgaaactaaatcgccagatgtttatcctggcatggaaaaacaattattagatacattagataaacatgacttgttaacacaaaaatcacttaaacatggacatgtgatgatccaatcattttcagggagtagtttagaaaaggtacatcacatgaacgccaatataccacttattagactaatgaataaatttgaacttaaaaaagctactaatcaagatttaaaaaatattaaatcttatgccattggagtaggtcctgaatacacagatttaaatattaagaacacaagacatttaaaaaatttaggatttttagttcatccttatacagttgatgatgaaaatcaaatgagaaacttaaatcaatatggtgttgatggtgtattcactaattttgctgatagatataaaaaagtttcagaaacacaacaataa

SEQ ID NO: 2061 - DNA, 150 bp, Staphylococcus epidermidis
gctacaaaaataaagaatacaatccaccaattatctaagtatataaataatgaacttgaacatattgcaacaattaaaatgctagcccatttcggtaagttatattttattaattccttttgtaaaacagttctcatatataattcatga

SEQ ID NO: 2062 - DNA, 522 bp, Staphylococcus epidermidis
ccaaaaaaaattagtaaagcattacctgtaattataacagctggactgtgtgatacttttttaattgtaatagctattttaggagtatctttaatactaatatctatgccaactttacaactttttatttacatcatcgggtttttgtttttgatgtatatggcatggtctttatggacggaaaagccttcaaatatcgaagaaatagaacctatgtcagctaaaaagcagattttatttgctttatctgtttctttattaaatcctcatgcaataatggatactgttggtgttatcggaacgagtgcttcagtttatgatggttatgacaaagttgttttttcattggctacaatttctgtatcttggatttggtttgtctttttagctattttaggaagaattacaggaaaaattgataaaagtggtaagtatatcgttattttaaataaagtttctagcgttattgttattattgtaggattaattatattaaaaaatattgttggaattttaagttag

SEQ ID NO: 2063 - DNA, 123 bp, Staphylococcus epidermidis
tttgaaagaattatgagactatttaaacaatttaaatactacattttggtatttttatatagagaggttttagcaaatgaaattatcattaaattcaagttcaaaatttttaagagcccctag

SEQ ID NO: 2064 - DNA, 1455 bp, Staphylococcus epidermidis
gtttcattgatatttatggtttacctacacaagttaatgcattacttcacggggggtatagtaatgagcaataaagcttggggtggcagatttgaaactcaacccgaagaatgggttgatgatttcaatgcgtcaattgattttgataaaaatttaattaaacaagatgttcaaggtagtattgcacatgcaactatgctcgctaaacaacatattattacagatgatgaagctcaatccatcattaatgagcttaaaaatattcaaagtgactttgaagaaggtaaacttaaatttaaagcttctctcgaagatattcatcttaatattgagcacgagcttattcaacgtattggcgaagctggtggaaaactgcatactggtcgtacccgtaatgatcaagttgccacagatatgcatttgtatactaaagaacaagttcaatacattattgaacttatagcgtcgtttcaagaaacaattgttcaattagcagaccagcacgttgacacaattatgcctggatacacgcatttacaacgtgcacaacccatctcgttcgcacatcatattatgacttacttttggatgttagaaagagacaaaggtagattcatggatagtcttaaacgtatagatatctcaccattaggtgctgcagctttaagtggaactacacaccctatagatagacatctgactcaagaacttctaggatttgcaaatctgtatgaaaatagtttagatgctgtcagtgatcgtgactatatcgttgaaacattgcatcatatttcactcactatggtacatctatcacgttttgcagaagaaatcattttttggtcgactgatgaggcaaaatttatcactttatcagatgcgttttctactggctcatctattatgccacaaaagaaaaaccctgatatggctgaactaataagaggaaaagtcggacgtactacaggacacttgatgagtatgttagtaacacttaaaggcttacccttagcttataataaagacatgcaagaagataaagaaggtttatttgatgctgtacacacacttaaaggctctcttcgaatcttcgaaggtatggttgcatctatgaaagttaattcaaaccgtttaagtcaaacagtaaaaaatgatttttcaaatgcaacagaattagcagactatttagtcagtaaaagtgtaccttttagaaccgctcatgaaatcgttggtaaaatcgtattaaattgtattcataaaggtatatacctattagacgtacctttaagcgaatatcaagaacatcatgagaatattgaggaagatatatatgattatttaacacctgaaaattgtctcaagcgtcgccaaagctatggttcaactggtcaagaatcagtaaaacatcaactaaaagtcgcaaaagcattattaaaagacaacgaatcaaaatag

SEQ ID NO: 2065 - DNA, 1680 bp, Staphylococcus epidermidis
ataataatgatgaatcatagtgaagctttaactgaacaagtattttcatttgcttcagagctttatgcttatggtgtaagagaagtagtaattagtccaggttcacgttcaacaccattagcacttgttttcgaagcacatccaaatattaaaacatggattcaccctgatgagcgaagtgctgcattttttgctttaggtcttattaaaggtagcgaaaaacctgtagcaattctttgtacatctggaacagccgctgcgaactacacacccgctatagctgaaagtcaaattagtcgtttgcctctcgttgttttaacgagcgacagaccgcatgaactgcgcagtgtgggtgcacctcaagcaatcaatcaggtaaatatgtttagtaattatgtgaactttcaatttgatttgccgattgctgatggaagtgaacatacaattgatacaattaattatcaaatgcaaattgcaagtcaatatttatatggaccacaccgaggaccgattcattttaatttaccatttagagaaccactaacaccagatttagatcgtgtcgatttattaacatctgtaactaaaacgttacctcattatcagaaatcgatttcggtagatgatataaaagacatattacaagaaaaaaatggtctcatcattgtcggagatatgcaacaccaagctgttgatcaaatattaacgtattcaactatatatgatctgccaatcttagcagatccccttagtcagcttcgtaaagagaaacatcctaatgttataaccacttatgatttattgtatcgagcaggattaaatttagaagtagactatgtcatacgtgtaggtaagccagttatttctaaaaaattaaatcaatggttgaagaaaaccgatgcgtatcaaattattgtgcagaataatgatcaaattgatgtatttccgacaccacctcatatatcttatgagatttcagcaaatgattttttccgttcattaatggaagaaccacttgttgaacgaaaaaaatggttacagcaatggcaatcacttgaacaacaagcacgcattgaaataagtgattacttaaagcatgcgacagatgaagcggcatatgtagggagtttaattcaaaaacttacaaaagaagatacattatttgttggaaatagtatgccaattagagatgtcgataatttactgtttgatagtgaggcatctgtatacgctaatcggggtgccaatggaatagacggagtagtttcaactgcgctaggtatggcggcacataagaatgtgacattgcttattggtgatttatctttttatcatgacatgaacggtttattaatggccaaattaaatgaacttcatattaacattgtattagttaataacaacggaggaggtatcttttcatatttacctcaaaaacgatcggctacaaaatattttgagcgattatttggaacaccaacaggcttaaactttgaatatactgcactgttatatgattttacatttaagcgctttgataatttgactgactttaaatatgctgaattatctaaaatgggttctcacatgtatgaagttataaccaatagagacgaaaatttgcatcaacaccaaaatttatatcagaaattgagtgagattgttaatgttacattataa

SEQ ID NO: 2066 - DNA, 447 bp, Staphylococcus epidermidis
cagttgtcgataaggcaaattacttttaaatgtaaaaattcatgttatattagatatatattaatggaacacggtgatattatgtctaaaacaccatatgagttgattggtcaaaaagccttgtatcaaatgattgatcatttctatcaacttgtcgagaaagattctcgtatcaatcatttattcccaggcgatttcaaggaaaccagtcgaaagcagaaacaatttttgacacagtttcttggaggtcctgacttatatacacaagaacatggtcatcccatgttaaaacgaagacatatggaatttacaattagcgagtatgaacgtgatgcatggcttgagaacatgcatactgctattcaacacgcccaacttcctgcgggtgtaggcgattacttgtttgagcgattaagacttactgcaaatcacatggtaaattcctaa

SEQ ID NO: 2067 - DNA, 1839 bp, Staphylococcus epidermidis
gctattcagattattaaggaggtttacattatgagtcaacaattaacaagagaagaacaggaacgtaaatatcctgaatatacatgggatttaacaactatttttaaaagtgatgaagcatttgaagaagcttttaaaagtattgaagctaaaataggtgaagaagaaaaatttaaaggtcatcttggagaaagtgctgaaacattatatgaagcgctaagtcttgaagacgagttaggtacaaaattagaaaaggtatatgtatacgcacatttaaaacaagatcaagatactgcaaatgataaatataccggtttagaagcgcgtgcacatcaacttgttattaaatatagctctgcatggagttttttagtacctgaaattttacaactagatgaagctactattcaatcttttatcgattctaataatgatttaaaacgatatgaatttgatttgaaattgattaatgagaaacgtccacatatattagatgcgaatacagaaaagttattaacagaagcacaagacgcactttcaacgccttctaatgtatatggaatgttcagcaatgcagatttagaatttgaagatgctatagataaagatggtcaagcttatcctttaacacaaggtacatttatcaagtatttagagtctgatgatcgtgagttaagagcttctgcttttagaaatgtttataaagcatacggtgcgcataataacacgctaggtgctactttagctggtgaggttaagaaaaatgtatttaatgctagaactcatcattatcgttcagcacgtgaaagagctttaagtaataatcatattccagaagctgtttacgataacttaatcaaaacggtccataaatacttacctttattacacagatacacgaagcttagacaagagttactaggtttagacgatttaaaaatgtatgatctttatacacctcttgttaaagatgtcaaatttgaaatgccatatgaagaggcaaaatcctggatgttaaaagcacttgaaccaatgggagaagaatacttaaacgtggttaagaaaggtctagataaccgttgggtcgatgtatatgaaaataaaggtaaacgttcaggtggatattcatccggtggacatttaactaatcctttcattttacttaactggtcagacactgtttctgatttatatactttagtacatgaatttggtcactctgcacatagttactttagtagacagaatcaaccatcaaatttaagcgattatacaatctttgtcgctgaggtagcatcaacttgtaatgaggctttacttagtgactacatggacaaacatttagatgatgaacgacgtctattgttacttaaccaagaattagaacgatttagagcaacactattccgtcaaacaatgtttgctgaatttgaacataaaatacatcaaatagaagaagctggggagccgttaacgccaaatcgtatgaatgaagaatatgctaaactgaacaaactatattttggtgaagcagtagaaactgacgatgatattagtaaagaatggtcacgtattcctcatttctatatgaattattatgtatatcaatacgcaactggttatagtgcagcacaaagtttaagtcatcaaattttaactgagggtcaacctgctgttgaacgatatatcaatgaattcttaaaaaagggtagctcaaactatccgattgaaatattaaaaaatgcaggtgttgacatgacaacacctcaaccaatagaggaagcttgtgaagtattcgaacaaaaattagatgcttttgaaaagttaatgaaagcttag

SEQ ID NO: 2068 - DNA, 150 bp, Staphylococcus epidermidis
cgatataacttgtcaatgatagagtcgttatgtcattataaatgtaagggcttacatatatgttttgcatcaagatttagtctgtttcatacaattcaatttttcgattatgacgatattgattcattttattgttatattaaaaaataa

SEQ ID NO: 2069 - DNA, 132 bp, Staphylococcus epidermidis
acaagtaacttttttactaatcaatttcataagacgaacgctattgcttctaatcaacttattcaaacaaattttatctcatttaaattaacaaggtcattctcttatgttatagctatccctatcatatag

SEQ ID NO: 2070 - DNA, 999 bp, Staphylococcus epidermidis
ggagagaatgttatgaaatttattagcaacaataatattaatgatccttccctcaatttagcaatggaagagtatgttcttaagaatttaccttctgaagaaagttattttttattttatattaacagaccttcaattattgttggaaagaatcagaatacaattgaagaagttaatcaagcgtatattgataaacatcaaatagatgtagtgagacgtatttctggtggtggggctgtttatcatgatactggaaacttaaattttagctttatcacagatgatgatggccatagctttcataattttaaaaagtttacgatgcccattgtacaggccttacaatcaatgggagttaatgctgaaatgactggaaggaatgatatacaagtagggcaagctaaaatatctggaaatgctatggttaaagtaaaaaatagaatgtttagtcatggtacattaatgctgaattgtgatttaaatgaagttcaaaaggcattaaaagtgaatccagctaaaattaaatctaaaggcgttaaatctgttagaaaaagagttgccaatattgaggaatttctagaacagccaatagatatagaagaattcaaaaaaattattcttaaaactatttttggtgaaaatgaagttgaagaatatatattaacagaagaagattggaaaaatattaagcaattaagtgatgaaaagtatcgtacgtgggaatggaactatggcagcaatccaaaatataatattgagcgtgaagagaaatttgaaaaaggttttattcaaataaaattagatgtaaaaaaaggaagaattgaacgggcaaaactatttggagatttcttcggcgaaggagatgtaaccgaacttgaacatgcgttagtaggttgcttacatgattttgaacatatagaagaggcacttcaaaattatgatttctatcactactttggggatatagataagtatgaaattataagattgatgtcctaa

SEQ ID NO: 2071 - DNA, 507 bp, Staphylococcus epidermidis
acttatgtagtaaatatacttaaaaggagcgcaaatatgagtcgtaaaacatatgaaaaaattgctaatattaatggtatgttcaacgtacttgaacaacaaatcattcatagtaaagatatggcattatttaggaatgaatttttttatgtaaaccatgaacacagagaaaattatgaagcgcttttgatctactacaaggatagtttagataatcccgttgtagatggcgcatgttacattcttgcattacctgaaatatttaataaggttgatgtgtttgagtctgatttaccttttacctgggtttatgatgaaaatggactttctgatacaatgaaaagtatcagtgtgccccttcaatatcttattgcagccgctttggaagtgactgatgtaaatatatttaagccttcaggttttactatgggcatgaacaattggaatattgcccaattacgtattttttggcaatactgcgctatcgtcagaaaagaggctttataa

SEQ ID NO: 2072 - DNA, 219 bp, Staphylococcus epidermidis
atttttggagttgcaacaaaccacttgaaagagtctggattaacgaacgtaaaagggttaatgcgaataattatagaaaaaccatttggtgatgatttaaaatctgcaaaaaaattaaataatcaaataagtaagtcttttaaagaagaagaaatatttggaattggtcactatttaagtaaagaaatgattcaaaatattgaacgtctacgattttga

SEQ ID NO: 2073 - DNA, 795 bp, Staphylococcus epidermidis
attaatttggtgcgatttaaaatgaaagcctttgttgaagcagttgatgaattaggtggtatatattatgacgtaccatataacttaaatgaacctaacagtgatgatactggtagaattaaaataaaaaaaggataccaaaagctaaacggcgaccaagcattagctgtagctcgaactagacaccatgattcagaccttaaacgtggtcaaagacaaatggaacttattaaaatattgttccaaaaagctcaaaatttaaaatctatagataaacttgacaatgttattagtattgtagggaaaaatgctaaacataatttaactcaaaaagaaattaagtctctagccaaaatgtatcttggtggtagtactgaaattaaaacatcacaacttaaaggtaaggatgactacttaaatgatatatactattaccacccaagcgtaaaaagtattatggaatattcaaatcttttacgtaatgatttagatttatctaaaataacaaacaaaaacgatttcttagatcaaagagtcattaaacgatatggttcactcgtacccttaacagaattagatgaagacttattgcgtaagaaccaaaaggaatcgactgatagtcagaaagagtctgattcttcatcacaaaataatgatgaagaagatcaaactaacgaacaaacagaccaaaatagcttaaacggaaacgaacagtacccaaatcaacaagacaacaatcaaaccaatggtgaaaatggtatgataaataatgacaattatccttacgcacaataa

SEQ ID NO: 2074 - DNA, 234 bp, Staphylococcus epidermidis
aaggtcgtggtctttatgaatcacaatactgaggtcaagtacactacattagaagattttgtaatgacagtgaacgatttaggcgttgaactcgtcattgaagaagcactcagaaatgcaagaaaagctaaacttaaactcttaattgacgaagcgctcatcaataaaaacgagaacgattttattcaatatactaacgaatttaaacaattggaggcatttttaagtgaataa

SEQ ID NO: 2075 - DNA, 243 bp, Staphylococcus epidermidis
tataacacggtaaaatatccttttcaacccttgtttattcataaaaccaaattgtcacaatctgttcatattgtaagcgaattcaattctactaagctttcattaacttttcaaaagcatctaatttttgttcgaatacttcacaagcttcctctattggttgaggtgttgtcatgtcaacacctgcattttttaatatttcaatcggatagtttgagctacccttttttaagaattcattga

SEQ ID NO: 2076 - DNA, 3231 bp, Staphylococcus epidermidis
gaaatgaaggtggtgaaagacatgattccaactaaacctcatgatgtgatttggacagatgcacaatggcaaagtatttatgcgaaaggacaggacatacttgttgctgctgcagcaggttccggaaaaacagccgttctagttgagcgtattatacaacgtatactaagagatgaggtagatgtagatcggttactagttgtaacatttacgaatttaagcgcacgtgagatgaagcatcgagttgataaacgtatacaagaagcatcttttaaggatcctaacaatgaacatttaaagaatcagcgaatcaaaattcatcaagcacagatttctactttacacagtttctgtttgaaattgattcagcagcattatgacgtattagatatcgatcctcattttagaacaagtagtgaagcggaaaatatattattattagaacaaactattgatgatgttttagaacaacactatgataaattagatcctcactttatagaattaaccgaacaactatcatcagataggaatgatgatcaatttagaagtattattaagcagttatattttttcagtattgctaatcctcaaccatttgaatggctcaatcaattagcgcaaccatacaaagaagaaaataaacagcgagaattaatgcagcttatcaatgatttagcaatgatttttatgaaagcaggatatgaggaattacaaaaaagttatgacttattctcaatgatggaaagtgttgataagcagcttgaagttattgaaaccgaacgcatgtttattactaaagccattgaaggtaaagtattaaatacagatgttatcacacaacatgaatttatgagtcgttttccggcaataaatagcaagataaaagaagcaaatgaaggcatggaagatgctttaaatgaagcaaaacaacattatgataaatataaatctttagttatgaaagtaaaaaatgattatttttctagaaatgcagaagatttgcaaagagatatgcaacaactcgcacatcgagtggcttatttagctcaaatagttcaagacgtgattcaatcatttggtgttcaaaaacgaagtcgtaatattttggatttctcagattatgaacattttgcattacgcattcttactaacgaagatggctcgccttcgcgtatcgctgaaacgtatcgtgaacattttaaagaaatcctagttgatgagtatcaagatactaatagagtgcaagaaaaaatattatcttgtattaaaactggtgaagaacacgatggtaatttgttcatggttggggatgtgaagcagtctatttataaatttagacaagctgatcccagtttatttattgaaaaatataatcgcttttctagtagtggaactgaaagtggcttacgcattgacttatcgcaaaactttcgttcgagacaggaagtgttatctacaaccaattatttgttcaaacatatgatggatgaacaagtaggagaaatttcatatgatgatgcagcgcaattgtattttggtgcaccatatgacgaagtttcacatcctgttcaattacgggcacttattgaggcaagttcagaaaatagtgacttaactggaagtgaacaagaagcgaattacattgttgagcaagttaaagatattattaatcatcaaaacgtatacgatatgaaaacaggtcaatacagaaaagcaacatataaagatatcgtaattttagagcgaagttttggtcaagctcgtaatcttcaacaagcttttaaaaataatgatatcccttttcacgtaaatagtaaggaaggatattttgagcaaactgaagtacgtcttgttctttcatttttaagaacaatagataatccacttcaagacatttatttagtgggtttgatgcgttctgtaatatatcaatttactgaagaagaattagctaaaataagagttgtaagccctcatgatgattacttttatcaatctataaaaaattatatgattgatgaaaaagctgattctagattggttgacaagttaaatcgttttattcaggatatacaaaaatatcaaaattatagtcaaagtcaaccggtttaccaattaattgataaattttataatgatcattttgtaattcagtactttagcggtcttattggaggtaaaggtagaagagcgaatctgtatgggctatttaataaagctgttgaatttgaaaattcaagtttcagaggtttattccaatttattcgttttattgatgagcttattgatcgtaaaaaagattttggtgaagaaaatgtcgtaggtcctaacgataatgtggttagaatgatgacgattcacagtagtaaaggattagaatttccatttgtaatttactcaggattatctaaaaaattcaacaaaggtgacctgaatgcaccagttattctaaatcaacaatatggtttaggtatggattattttgatgtaaataaagatatggcttttccttcgcttgcctctgtggcatatagagcaataaatgaaaaagaacttatatcagaagagatgcgtttaatctatgttgcgttgacacgagcaaaagagcaacttattttagttggaagagtcaaagatgaaaaatcgttaattaaatatgaaaaattagctgtttcagacacacatatagcagttaatgaacgccttactgccacaaatccatttgttctaatttatggtattttggctaagcatcaatcgccttcattgccaaatgatcaaagatttgaaagagatattgatcaattaaattctgaagtgaagccacgcgtatcaatagtgattgatcattacgaggatgtttcaactgaagaagtggtcaatgataatgaaataagaacaatcgaagaattaaaggccataaatactggtaatgaagatgtgaaaattaaaattcatcaacagctttcttatgactatccttttaaagttaacacgatgaaaccatctaaacagtcggtatcagagttaaaacgccaattagaaactgaagaaagtaatacaaattatgatagagtacgtcaatatcgtattggtgttgcatcatatgaaagacccaagtttcttacccaaacaaaaaaaagaaaagcaaatgaaatagggactttaatgcatacagtcatgcaacacttaccttttagagaacaacgtttaacaaaagacgaatga

SEQ ID NO: 2077 - DNA, 135 bp, Staphylococcus epidermidis
ttatcagaggttacctataataaaataagtttggtaaattttgttcgtaaaccgttaaaaatatacagtgaatatgattattgtggtcattttattttgctttattatcaggtactaaaaatgttaaactattaa

SEQ ID NO: 2078 - DNA, 942 bp, Staphylococcus epidermidis
tttaggagggtgtatatgactaaatatgtgttgaaacgattgtgttatatgtttgtgtcgttatttattgttataacaattacatttttcttaatgaaattaatgccaggatctccgtttaatgacacaaaacttaatgcgcaacaaaaagaaatattaaatgaaaagtacggtttgaatgatccagtagcattacaatatgttaattatttgaaaaatgtagtaacaggtgattttggcaactcatttcaatatcataatatgccagtgtgggatttagttaaaccacgattgataccttcaatggagatgggaataacagctatggttattggtgttgttttaggtttagtattaggtgttgctgctgctactaaacaaaatacatgggtagactatacaacaacaattatctctgttatcgcagtatcagtgccgtcatttgtcttagcagttttattgcagtatgtatttgcagttaagttagaatggtttccagttgcaggatgggaaggtttttctacagctattttaccttctctagcactatcagctacagttttagcaactgttgcaagatatattagagctgaaatgattgaagtactcagttcagattacatacttttagctcgagctaaaggaaattctactttaaaagtgctctttggacatgcattacgaaatgcattaattcctattattacaatcattgtacctatgttagcaggtatattaacaggaacattaacaattgaaaatatctttggtgttccaggattaggtgatcaatttgttcgttctataactacaaatgatttttcagtcatcatggctacaacgatattattcagtactttatttattgtttcgatctttattgtagacattttatatggtgttatcgatccaagaattcgtgtacaagggggcaagaaataa

SEQ ID NO: 2079 - DNA, 1857 bp, Staphylococcus epidermidis
cgaaatttattattaatagggaagaatgtaacaatgagaaaaaaattaaataatgaatatcgctctgctaaaaaaatacgatatatgcctggattagatggtttgcgagcaattgcagtcattggtattattatttatcacttgaataaacaatggttaacaggtggttttttaggcgtagatactttttttgttatttcaggttatttgattacgagcttattacttaaagagtatgaagatactggaacaataaatcttaaaaatttttggattcgtcgtattaaaaggttattaccagcggtatttgcattaatagtagtagttggaattgcaactttattattgcaccccgagcatattgtaagagttaaacatgatatgatagcagcaatattttacgtatctaattggtggtatattgctaaagatgtcaattatttcgagcaattttcttttatgcctttaaagcacctatggtcactagccattgaagagcagttttacctttttttcccagcagtactcttattatttatggcaatagttaagaaaaagaaaaatgtcatactgatgttttggatcatatccctggtttcattattaatgatggttgttatttctcaacctcacttgaaccattctagagtatattttggaactgatacaagattgcagacactgcttttaggtgtacttctagcatttatctggccaccttttaaattaaatcccaatccacctaaaggattaaaaactgtgattaatagtgcgggtatcataggacttacatttgtaattctattattctttaatgttagtgatgaaagtgattggatttataacggtggattttatcttatttcaacaatgactttgctaattattgcaagtgttgttcatccaacgacaattttagctaagttattaggaaatcctttatttgtctacattggaaagcgttcatacagtttatacttatggcattttcctgtaattagctttattcatagttattttattgatggtcaattaccaacttatgtttatattatggatatcgtaattactgtattattagccgaattatcatttagatatgttgaaacgccattaagaaaggaaggtctaaaggcttttacatttaaaaaaacttacaaacctcagtttattagaacaattgtaacgttaattatgttgttaccttttatttttatactagttggagctttcgataaattcggaaaagatacaatttcaaataaagcacaaacatttaatacaaacgaggctgatcaatatcttattcatatgataccgattgataatatttcgttaactagcgatggtaaaaccaaagagaataagaaagacaatgatgtatatacacaaattaagccattattaattggtgattcagttatggtagatataggggaacaatttaaaacgaaagtacccaaagctaaaatcgatggcaaagtcggtcgtcaactctatcaggccgagagcctcgttaaaaatcaatatagacattataataaaccatcagaccaaatcatacttgagttaggtacaaatggtgattttacaaaagaacaattagataatttaattgacaaatttggcaaagcacaagtgtatcttgtgaatacaagagtgccaagatcatatgaaagtcatgttaatgagttgatggcaaaagcagctaaaaataaaaagaatgtaaccctaattgattggtatagtcgctcaaaagggcatacagagtattttgctccagacggaatccatcttgaaaatgatggcgtagaggcattgacagatgagatattaaaaaatataaagaagaaataa

SEQ ID NO: 2080 - DNA, 156 bp, Staphylococcus epidermidis
aacactatatttgaaccactttggaataataagtatatttccaatatacaagcaacttcttcagaaacgattagtatagaatatcgtggtggttactacgaatcaagcggcgccctaaaattcatggttcaaaatcatttattacaaatggtttaa

SEQ ID NO: 2081 - DNA, 384 bp, Staphylococcus epidermidis
gaggtttcattaatgtccataaattcttatttgatttcgtcattatttacgccagttttatcaataattatatggttattttattcaaatcactttataaatttaatcaatatcttattttatacatcattcattatttttatagttgctttccttattttactcattcaagaaggaatatttgatgctacaagttttggatttcgtcgtttaaagtatcaactttcctcaactaagagaaaacgtatgatgaaaaatgaccactttttcaatccacaaaaagttaaaaaagaaagttatattatttccccatgggtagttccaacattgattattaacctcacttatataattgtgagtatcggagtatctttattaatataa

SEQ ID NO: 2082 - DNA, 1188 bp, Staphylococcus epidermidis
caaatgaaattatcattaaattcaagttcaaaatttttaagagcccctagtattcgtcaattttctaatagaattaaagcgattgacgattgtgttaatttaacaattggacaacccgattttcctatgccagatgtggtcaaaaatgcttatatcaaagcaatcaaaaacgataaaacaagttattctcataacaaaggtttatttgaaacacgcgaagctattagccaatattttaaacgaaaatataatttcctttatagtgaggaagaaatcatcgttactaatggtgcgagtgaagcattagatacatcgttaagaagcattattgagcctggcgatgatatacttattccaggaccgatatacgctggttatatcccattagttgaaactctaggtggaaatccagtatatatagataccacacaatcagattttaaagtaacacctgaactgattgagtcgcatctaacgcataaaactaaagctatacttctaaattaccctaccaacccaacaggtgtaatactcgaacgctctgaagtcaaaaatatagtagacacacttgtaaacaaacacatttttataatcagtgatgagatttatgctgaaaatacgtttaaaggacaacatacatcttttgctgaatttccagaaattcgagatcaattattacttataggtggtttgagtaagtcccattctgcaacaggtattcgaatcggctttttacttggtcctgaatatttaattgaaaaattaacctttatgcacgcttacaattgtatttgtgcaaatgtaccagctcaaattgcttgtactaccgctttaaatgaagggataaatgcccctctatacatgaatcgtgattatatcgaacgtcgtaattacctgaaagaaaaattagaatcattaggcttcgaattaactgctcaacctgaaggcgcattttacatcttccctagtattaaaagatttacggaaaacgattttgaattttgtgttgatgtgttggagaaagcacacttagctatggttcctggttcttccttcaccgatattggcaaagggtatattcgaatttcatatgcttatgatatggaaacattaaaaaaaggaatgcatcgattagaaaattatttacagcaacattatccagagcaaatgaccactccaactaaataa

SEQ ID NO: 2083 - DNA, 435 bp, Staphylococcus epidermidis
aataatgaattaaattcattctataggagagtgagatgtatggtaacattatttacttcaccaagttgcacatcttgccgtaaagcgaaagcatggttacaagaacatgatattccgtatacggagcgtaacattttttctgaacatttaacaattgatgaaattaaacaaattttaaaaatgactgaagatggaactgacgaaattatttcaacacgttctaagacatatcaaaaattgaatgtagatatagattcattaccattacaagatttatactcaatcattcaagataatcctggcttgttacgtcgtccaattattttagatgataaacgtttacaagttggatacaacgaagatgaaattcgtcgtttcctaccacgaaaagtacgtacgttccaattacaagaagcgcaacgtttagttgattaa

SEQ ID NO: 2084 - DNA, 147 bp, Staphylococcus epidermidis
atgcgctattcaattctcaaggctaacttatcacaggaaaattattttttatgtaacctttcattcataaaaaaagttatttttaatatcaaaggtcacaccaccactttagatatacaatttacagaaattttaaaatatatataa

SEQ ID NO: 2085 - DNA, 2667 bp, Staphylococcus epidermidis
gatggatgttctttttattttttaggaggtagacatatggaaatgaaaccaaaatatgatccaagagaagttgaaaagggtcgttatgaggaatgggtaagtaatggttactttaaaccatctgaagataaatctaaagaggcatatacaattgtaattccgccccctaatgtaacaggtaaattacatttaggtcatgcatgggatactactttacaagatataataactagaatgaaaagaatgcaaggatacgatactttatatctgcctggtatggatcatgctggtatagcaactcaagcaaaggttgaagcaaaacttaatgaacaaggtatatctagacacgacttaggaagagaaaaatttttacagcaagcatgggattggaaagaagagtatgcaacatttattagacaacaatgggctaaacttggcttagggttagattatagtagagaacgctttacgttagatgatggtttaagtaaagctgtaagaaaagtatttgttgatttatataataaaggtattatttatcgtggtgaaagaattattaactgggaccctatagctagaacagctttatcagatattgaagtcattcatgaagatgtccaaggtgctttttatcattttaaatatccttatggtgatgggaatggatatatagaaatagctactacacgtcctgagactatgttaggtgacactgctattgttgtaaatccaaatgacgaaaggtataaagatgtgattggtaaaacagttatattacctattgtaggaagagagttacctattttagctgatgaatacgttgatattgaatttggttcaggagcaatgaaagttactccggcacatgatcctaatgactttgaaattggtcaaagacatcaattagaaaatattatagtcatggatgaatatggtaagatgaacgataaagctgataaatacaaagggatggatagatttgattgtagaaatcagcttgttaaagacttaaaagaacaagatcttgttataaaaattgaagaacatacacattcagtaggacattctgaacgttctggtgcaatagtagaaccttatttgtctacacaatggtttgtaaaaatgaaacctttggcacaaagagctttggataatcaaaatacaaaagatagaattgactttttcccaggtagatttgaaaatacattcaatcgctggatggaagaaattagagattggacgatttcgcgtcaactatggtggggccaccaaatacctgcttggtatcataaagatacaggtgaagtctttgttggtgaagaagcacctgaagacatcgagaattggatacaagatgaggatgtattagatacatggttctcaagtgcactttggccgttttcaacattaggatggcctgatacaaatgctgatgattttaaacgttattatccgacaaatgcattagttactggttatgatatcattttcttctgggtagcccgtatgattttccaaggattagaatttactgatagaagaccatttaatgatgtattactccacggtttagtcagagctgaagatgggcgtaaaatgagtaaatcattaggtaatggcgttgatcctatggatgttattgacgagtatggcgctgatagtctacgttactttttagcaacaggatcttcaccaggtcatgacttgagatattctactgaaaaagttgaatcagtttggaattttattaataaaatatggaatgctgcccgctttagtttaatgaatattggtgaagattttaaagtcgaagatatagacctaagtggtaatttgtcattagcagatcaatggatattgactagattaaatgaaacgatatctacagtaaccgaattaagtgataaatacgaatttggtgaagtaggtcgtgcgctttataatttcatttgggatgagttctgcgattggtatattgaaatgagcaagatacctatgaatggcgaggacgaatctcaaaagcaaacgacgcgatcagtacttagttatgttttagataaaataatgaaaatgttacatccatttatgccttttgtgacagaaacaatttggcaaagtcttccacatcatggagaaacaattgtaaaagctaactggccaactgttgatcaagcattaatctttaatgaaagtaaacaaacaatggaacaattagttgaaattattaaatctgtccgtcaatcaagagttgaagttaacacaccgttatctaaggcaataccgattttaattcaaactaaagatgaaaagattaaacatacacttatggataacataagttacctacacaaattctgtaatccaagtcaattgactattgatactgagattgaaattccagaaaaagctatgacaactgtagtagttgctggtaaggtagttttgccattagaaggtcttattgatatggacaaagaaattgctcgacttgaaaaagaattagataaattacaaagcgagttagatagagtagataaaaagttatccaacgagaattttgtaaataaagcaccagaaaaaataattaatgaagaaaaagaaaaacaacaacattatcaagaaaaatataatggtgttaaatctagaattgaacaattaaaggcatag

SEQ ID NO: 2086 - DNA, 1329 bp, Staphylococcus epidermidis
attagtcaatcatggaggtatttatacatgacagcaacttgggaaaaaaaggaaggtaatgaaggcgttttaactgttactgttcctgcagagaaagtaaataaagcattagatcaagcatttaaaaaagtggtcaaacaaattaatgtgcctggattccgtaaaggtaaagtgcctcgtccaatttttgagcaacgttttggtgtagaagcactttatcaagatgcagtggatattttattacctgaagcttatggtgaagcaattgaagatacagaaattaatccagttgcacaaccagaagttaatgtaactcaaatcgaaaaaggtaaagatttcatttttgaagctacagttacagttgaacctgaagttaaattaggtgattacaaaggattagaaattgaaaagcaagaaactgacctttctgatgaagaattacaagaatcaatcgaccatagcttaagtcaccttgctgaaatggttgttaaagaagatggtgctgttgaaaacggtgacacagtaaacattgatttctcaggttcagttgatggtgaagaatttgatggtggacaagctgaaggttatgacctagaaattggttctggatcattcattcctggctttgaagaacaaatagaaggaatgaaaactggcgatgaaaaagatgtagttgtaacattcccagaagaataccacgctgaagaattagctggtaaagaagctacatttaaaacaaaagtcaacgaaattaaattcaaagatgtaccagaattaaatgatgagattgctaacgaattagattctgatgctgaaaacgtggacgaatataaagaaaatcttcgcaaacgtttaagtgaacagaaagcaactgaagctgaaaatactgaaaaagaagaagctattaataaagcaacagaaaatgcttcaattgatattcctgaagcaatgattaatactgaattagatcgtatgattcaagaatttggtcaaagaatccaacaacaaggcttagatttgcaaacatattatcaaatctctggtcaaaacgaagagcaactaagagaccaaatgaaagacgatgcagaacaacgcgttaaaacaaacttaacgttaactgcgattgctgatgaagaaaatattgaagtatctgatgaagatattgataaagaattagaaaaaatgagcgagcaatttaacatttctgtagaagatattaaatctactttaggtaatacagatattgttaaaaatgatgtacgcattcaaaaagttattgatttattaagagataatgcgaaatatgttgaagctactaaagaagactag

SEQ ID NO: 2087 - DNA, 174 bp, Staphylococcus epidermidis
tttcattgtcccgcccctaaatttcatttaacatcaacaattataaatcataatgatgctatattaagttgtcaatctatacaattgacactgtctatatttaatttaacttatagacaattgactaattcaatattatgcattcatttaatgaacgatactagtcttctttag

SEQ ID NO: 2088 - DNA, 1269 bp, Staphylococcus epidermidis
aaaagaatgttcaaattcaatgaagatgaagaaaatttaaaatgttctttctgtggtaaagatcaagatcaagtaaaaaaattagtcgcaggaagtggcgtttatatttgtaatgaatgtattgaattgtgctcagaaatcgttgaagaagaattagcacaaaatacatctgaaggatttacggagttaccaactcctaaagaaattatggatcacctcaatgaatatgtcattggtcaggaaaaagccaaaaaatcattagcagttgctgtatataatcactataagcgtattcaacaattgggtccgaatgaagatgatgttgaattacaaaaaagtaatatcgcattaattgggccaactggtagcggtaaaacattattagctcaaacactagctaaaacactaaatgtaccatttgcaattgctgatgctacaagtttaacagaagcaggttatgtaggtgatgacgtagaaaacatcttattacgtcttattcaagctgctgatttcgacattgataaagctgaaaaaggtattatatatgtcgatgaaattgataaaattgcgcgtaaatctgaaaacacttcaatcacgcgtgacgtgtctggtgaaggtgtacaacaagcattgcttaaaattttagaaggtacaactgctagtgtaccgcctcaaggtggtcgaaagcatccaaaccaagaattaatccaaattgatacgacaaacatcttatttatcttaggtggagcttttgatggtatcgatgaagtcattaagagacgcttaggagaaaaagtgataggatttgctagtaatgaagcagataaatatgatgaagaagctttactggaacaaattcgtccagaggatctccaatcatatggcttaattccagaatttattggtcgtgtacctatagttgctaatcttgaaactttagatgttgctgcacttaaaaatattttaactcaacctaaaaatgcgctagttaaacaatacactaaaatgctagagttagataatgtagaattagagttttctgaagaggctctatctgctataagtgaaaaagcaatcgaacgtaaaacaggagcgcgtggattacgttcaattatagaagaagcattaattgacatcatgtatgatgtaccttcttctgaaaatgtaagtaaagtagtcattactgaacaaacaattaatgaagaaattgagcctgaattatatgatgatgaaggaaatctaattaataagaacaagacatctgcttaa

SEQ ID NO: 2089 - DNA, 123 bp, Staphylococcus epidermidis
ttaataagaacaagacatctgcttaaaatatttgatttaagactgagtcacgtgaattgtgactcggtttttttatatgtaaatatagaaaaaaatgttaaagttaattatacaatagtataa

SEQ ID NO: 2090 - DNA, 141 bp, Staphylococcus epidermidis
attaaaaatgcacttatatcaacttttaaagctatgttatgtcatcaatacagtaaattccacttagaaattcaacagacaaggcgagttggggtttggggccctaacaaaaagaatttcactgagaaattcaacagatag

SEQ ID NO: 2091 - DNA, 147 bp, Staphylococcus epidermidis
ttcaaaatggctgaacaatcaaaagaaaaacaagctaatgaacaagcaaaagcgcaaaatctttttgctcgctggagaaaagaagaaacactttatagtgaagatgaaaagaaagataagtcttcaaagaagaaagataaagaataa

SEQ ID NO: 2092 - DNA, 579 bp, Staphylococcus epidermidis
gatactaattttagtcatatagaggtgttctgggtgcttaagttttttagaaataacaagctcattgtcgttttatgtgcaatgattatttttattgcattaatagggttatcgatacgttctcagacccaatctccagctgaacaatacgtaggagactctgtatcatttggacaaagagtaatcagttatccaattcaatttgttactggatctattggtgatttatttgaaaaaggaagctcaaaaaaggataaaaataaaatcaaacaacttgaagctaaaaatgaagagttagaatcagaaaataagaaatataaaaaagaacttgatatcaaagatttatcaaaatatgaacctatttctacttcagttattgcgagaaacccagatcaatggatgaatacgatattaatagataagggctccaaagcaggtataaaaaataatatggccgtcatgacaaccagaaggattagttggaagagtaccaaagttaatcattttcatccaagtagaccttatttccactcatactcgagcaggaaaatatttgttaatattcatcaccgtacttaa

SEQ ID NO: 2093 - DNA, 324 bp, Staphylococcus epidermidis
agtaaccattacttacccattcctcataacgacccttttcaacttctcttggatcatattttggtttcatttccatatgtctacctcctaaaaaataaaaagaacatccatcctataaaaaataggacggatgttctgttccgtggtaccacctatattcaagaagaaataattcattcttttcttcaagcacttaagtctctgattaacgctcatacacggcttctacctacttgtcgtctatgtttcaatagaagttataaaatagggctaccttcagacttaatcatttacatattcacagccaccatatgctctctttaa

SEQ ID NO: 2094 - DNA, 222 bp, Staphylococcus epidermidis
tactacatatacaatataagtgatttaaggaggttcaacataatgagcattttgacgattattttaattgttttgctagtcatcctcttatttaaagttggattatctatattacgctttttgatttcagtaggcattgttttgttatgtatctatttaggttatcaaggtgtattatggttatttgaacattttcaaaacttttcaggttttattcgataa

SEQ ID NO: 2095 - DNA, 177 bp, Staphylococcus epidermidis
gttattcttcaattaaaaatagtaaacagcaagaaatttggaactttattgaaacatatatataaattttttcaattagagaaatgtattttaaccacaattaaaaaatgtcggtattttggcaaaaaattgaatgtagattataatctttctaatttatttaagcattccacttaa

SEQ ID NO: 2096 - DNA, 135 bp, Staphylococcus epidermidis
aattcttctcatatttacttttgtttaagactgtttataataaatgttgaggagtgtgatatatgctattacttgcctatacttgtagcattatatttagttttctttatcaattttgcaatcaaaatatattaa

SEQ ID NO: 2097 - DNA, 162 bp, Staphylococcus epidermidis
aaagtatttaaactcattaggataaatccaatcaaattaaggaaaaaaacagaaaaattcattactttaatcaaattcaatatcaacgaaattgatataataatccaagttaaagagaaaaaaacgtcaaatatagaacctagtggcacttgtttagtatga

SEQ ID NO: 2098 - DNA, 381 bp, Staphylococcus epidermidis
agatcatctaaggaggaatttattatgccacgagttaaaggtggaacagtaacaagagcacgtcgtaaaaaaacgattaaattagctaaaggttactttggttcaaaacatacattatataaagtagctaaacaacaagtaatgaaatcaggtcaatatgctttccgtgaccgtcgtcaacgcaaacgtgatttccgtaaattatggattacacgtattaatgcggctgcacgtcaacatgacattagctactcacgtttaatgaacggcttgaaaaaagctgagattgatatcaatcgtaaaatgttatcagaaattgcaatctcagatgacaaagctttcgctgaattagtatcaaaagctaaagaagctttaaaataa

SEQ ID NO: 2099 - DNA, 144 bp, Staphylococcus epidermidis
gttgttcctaagatatctgtatggtcaagtcctatacttgtgagtatggatagcacaggtttaaaaacattcgtcgaatcatttttaattcctaaacctgcttcaattatcacaaaatcaacaggatttatctcaccaaaataa

SEQ ID NO: 2100 - DNA, 930 bp, Staphylococcus epidermidis
cgtatgcgtaaattaattgttgggtcgcgaagaagtaaattagcgctaacacaaagtcaacaatttatagataaattaaaatttatcgatccgtctttggatattgaaataaaagaaattgtaactaaaggcgacaaaattgtagataaacaattatccaaagttggaggtaaaggactttttgttaaggaaatccaaaatgaattatttaataaagagatagatatggcgattcattctctaaaagatgtaccaagtatgattcctgacggtcttaccttaggatgtattcctgacagagaaattccttttgatgcctatatagcaaaaaatcatataccattacaagaattgtctgagggcagcattgtaggtacaagttctttacgtcgtggcgctcaaattttatcaaaatacccacatttaaaaattaagtggattcgtggaaacattgatactcgattaaaaaaattagagactgaagattatgatgctattatattagctgctgctggattaaaacgcatgggttggtcagataatattgttacgacttatcttgatcgagatatattactgccagctatagggcagggtgcacttggtattgagtgtaggagtgatgacaaagaacttttagatttactatctaaagtacacaatcatgatgtagcacaatgtgtgactgctgaacgtacttttctatcagaaatggatggcagttgtcaggttcctataggtggatatgcaacaattgctcaagataaccaaattgaatttacaggactgattatgtctccagatggtaaggaaagatatgagcatacagcattgggtactgatcctgtaaaattgggtatagaagtgagtcaagtacttaaaaaacaaggtgcttatgacataattaaaaaattaaacgaagcagaataa

SEQ ID NO: 2101 - DNA, 150 bp, Staphylococcus epidermidis
atacataacaaaacaatgcctactgaaatcaaaaagcgtaatatagataatccaactttaaataagaggatgactagcaaaacaattaaaataatcgtcaaaatgctcattatgttgaacctccttaaatcacttatattgtatatgtag

SEQ ID NO: 2102 - DNA, 522 bp, Staphylococcus epidermidis
attatactaaatttgatttgtaaaaggagggcttatatgagatatatctttagtgttattaaaaatattattgcagtattagcgataatattgattatatatatagctcttcaacatgcaccatttctcaaaaatcaagaatggaacccacttaatgatatgaacaatcatcatcaaaatatcacacagaaagtgagtcaaaaaaataatacactctattcacaacctagtaacgataaaagttacattttaaaagaaaatgatatcatcaataatgttccagcaggtcaaattaagacagtttttaatatgattgataaggcagaatttatgtctgtttcaggtttagaacgtatgggattcaatgacgaatatcttgctggccaacaaggtgacgaatttattatttataaattcggtgatgattatatccgagtttataatactgaattcgaaatgaacgaagacctaaatcaattaaaacaacctattaatttgaagccaattgaagcctatcaataa

SEQ ID NO: 2103 - DNA, 141 bp, Staphylococcus epidermidis
caccttctgaaagaggatatgaatacaacgtatagacttaaagagtgcggagatatattaggtataaatttacttgatcatattattattggtgataataaatttacgagtttagttgaagcggggtattttgataaataa

SEQ ID NO: 2104 - DNA, 186 bp, Staphylococcus epidermidis
aaagtagggaacaaaatgaaatttgatagacatagaagattgcgttcatctaagacaatgcgtgatttagtaagagaaactcatgttagaaaagaagatttaatatatccaatatttgtagttgagcaagatgatataaaaagtgaaattaaatcactaccaggcatataccaaattagtttttaa

SEQ ID NO: 2105 - DNA, 123 bp, Staphylococcus epidermidis
aacgacaatgagcttgttatttctaaaaaacttaagcacccagaacacctctatatgactaaaattagtatcttaatatattttatattactcattcagttaaataaagcactaactttatga

SEQ ID NO: 2106 - DNA, 825 bp, Staphylococcus epidermidis
tttggtgatgatatgcaagaaaccctgttaattcgatttcatgaaatcatattaatgatttatctgtttagtattatatgttactttgttgatttcattaataaaaattataagactagaactgtaggtttttattcattagggattgtttgggttttacaaacaatctctttgtctattttttttattcatactaaacaagtgccactaggttctatatttgacgtttttttctctttaacttggattattatatcaatttcgttgatattgaatttgattaaagtaatgaatttttctgtttttttccttaatttgattggatttatcctaatgagtttaaatacttttcagcctgaacattatcaaacgcaaattcaacaaattgcagtaattaatgaattattacttgttcatatagcacttgcagtattaagttatgcattttttgcaatcgcatttgtaaattcattactctacattattcaatatcgaaatttaaaggagaaaaatttcgatcaaaattactttagaattggtagtgttgctactttagaaaccatcgttttctattcaacacttgttgcatggattatccttatattaagtacgattttaggtgcacaatggggtatctttgcagtcggtaaacaaatatttatagatccaaaagtaatattttcaacaattattactttattatatggtgtttatattttcattagaataaaaaaatggatatcacaaagaaatcttatctactttaacattatattattttgtttgtgtatgattaatttattctttttaactcattttagataa

SEQ ID NO: 2107 - DNA, 264 bp, Staphylococcus epidermidis
tcttcagcacttgtagaactaattactatgtccgttgtttctaataaagatggtaatgctgaaagtgaatcatatgaaacattgtgtttttcggctaaaattttagctttagataatgtccgattaacaattgttacatttgaaattccagaacctaaaagatttaagagtgataattcacccatttcccctgctccaataacgacagcatgtttactttttaattttccaaatacctttttagctaattcaacagcagcataa

SEQ ID NO: 2108 - DNA, 627 bp, Staphylococcus epidermidis
tatattattttactcatttatattataatggatattaaaataagtcaatgtattggagatgaaattatgaatgaatgtgcttttaacacaactgatcctatctatatagagtatcatgattattattggggacaaccaatctatgatagcaaagaattatttaagctaatggctcttgaatcacaacatgcaggattatcatggttgacaatattaaagaaaaaagaatcgtatgaacaggcattttacaactttgaacctcaatttatcgcacatatgactgaacaggatattgattatttaatgaaattcccaaacattattcataatcgtaaaaagttagaagcaattgtgagccaagcgaagggatatttaaaaattgaaaaagactatggtagttttagtaaatttttatggtcttatgtaaatcatcaacccataaatatgggttataaaaaacctagagatcgtaaaaaagttgatcaaagagctactcaattatcaaaagatttaaaagcatatggttttaaatttttaggtccagtaaccgtgttctcattcttagaagctgctggattgtatgactcacatcttgaaggatgtcctttcaaaccaaatcatgagtga

SEQ ID NO: 2109 - DNA, 618 bp, Staphylococcus epidermidis
ttatacaatagtataagaaagaggaagtctatgaatataaattttaataatattaacttaattataagtgctgtaaaaaaagcacagtatcctgacactggattaacagaagtagcgttaagtggacgctcaaatgtagggaaatctacatttattaatagtatgattgggcgtaaaaatatggcgagaacgtcacaacaacctggtaagacacagacattgaatttctataatatagatgaacaacttatttttgttgatgtaccaggatatggatacgctaaagtaagtaaagttcaacgagaaaaatttggtaaaatgattgaagaatatattacacaacgagagaatttaaaacttgttattcaacttgtcgatttaagacatcaacctactgaagatgatgtgcttatgtacaattatcttaaacattttgatataccaacacttgtaatatgtactaaggaagataaaattgccaaaggaaaagtacaaaagcatatcaaaagaataaaagacaaattagaattagaatctggagataatattataagttattcttcaattaaaaatagtaaacagcaagaaatttggaactttattgaaacatatatataa

SEQ ID NO: 2110 - DNA, 1077 bp, Staphylococcus epidermidis
agtggtattttgaagcggaattttattaataatttaatcatattattaattgctattatgttaagtctgttattaaaaatgttacatgtgattttgccatttatgtttggaccaatattagcggcgttattatgtgtaaaagtattaaaattaaaaatacgatggccattttggttgagtcaaattggtttaatactacttggagttcaaattggctctaccttcacacaacaagtgattaaagacataagtaaaaattggctaactatcgtttttgtcactatcctactaattttattagctttgataattgcattcttttttaagaaaattgcacaagtaaatttagaaactgcaattttaagtgttataccaggtgcgctaagccaaatgttagtgatggcagaagaaaataagaaagcaaatatattagttgtgagtttaacacagacatcacgtgtaatatttgttgttattttagtaccacttatttcgtatttttttcaggataaccatcatgaaatgaatcatactacaatggaagtacccacactttctcagactttaaatatatggcaaataatcatcttattctcaatggtgggaatcatctatataggaatgtcaaaaattaacttccccactaaacaattattagcacctataatagttttaattatatggaatatgacaacacatttaacattttcactagatcattggttgttagccacagcgcaacttatttatatgatacgtattggattacagattgccaacttaatgagtgatttaaagggaagaattgcaatagcaatagcctttcaaaatataatgctcatagtcacaacgtttataatgataataggaatacatttgattactaatgaatccatcaatgaattgtttttaggagcagcaccaggaggtatgagtcaaatagttttagtggctatggctactggagctgatgtagcgatgatttcaagctatcacatttttagaatattttttatattatttgtcattgcgccactaattggttattttattaatgttaaattaaataataaatga

SEQ ID NO: 2111 - DNA, 1284 bp, Staphylococcus epidermidis
aggcataggagcatgatcatgaattacctagacagcttgtattggatacacgaaagatctaaatttggtatcaaacctggcgtcaaacgtatggaatggatgctagaacaattaaataatccccaacataaaattagaggtattcatgtgggtggaacaaatggtaaaggttcaactgttgcatacttgagaaccgcattaattgagaacgattactcagttggaacatttacctcaccatttattgaaagtttcaatgaacgtattagtttaaacggtgtaccaattatgaacgatgaaattgttcaattagttgaacgagttaaacctgttagtgaagccttagagatagaaacagatttaggtggggctactgaatttgagattataacaacaatgatgttcctttattttggtgagataaatcctgttgattttgtgataattgaagcaggtttaggaattaaaaatgattcgacgaatgtttttaaacctgtgctatccatactcacaagtataggacttgaccatacagatatcttaggaacaacttatttagatattgcaaaagataaggcagctataattaaaccacatataccgattgtttatgctgtaaaaaatgacgatgctttaaagtatgtgagagattatgcgcttgaacagaacgcaaaaccaattgaattggatcgggagattaccgttgtctcccaagatgatgagttcacatatcggtataaagattatgaattagaaactatcattcttaatatgttaggggaacatcaaaaggaaaatgcagcacttgctattactgctctcattgaattaaatgaaagacaaatcatagaattagattttaataaaatgatagacggtatagaatctgtgaattggacaggtagaatagaacaagtaaaagaacaaccattaatggttattgatggtgctcataataatcgaagtattgatgcgttagtagacacaataagacattattatggaagagataaaattgatattttattttctgcaattaaaggaaagccaattcatagtatgattaacaaattaaatgatattgcatcaaaattctatatagcagattttgagtttccaaaagcattagctaaagaagaaattgccgaagaattgaaattagataatttacatttaattgatgattatgttgattttattgaaaattacgaaggtgatgggctgattattactggaagtttatacttcatcagcgaggtaaaagcaaaaattaattttaattaa

SEQ ID NO: 2112 - DNA, 690 bp, Staphylococcus epidermidis
aataaatttatgaaaccagttatagttatgacgcagacgaatgaagttcatagtcatttagttgatattatccataagccttttatccaactaaaacaacttcattttaatgaaaaattgcttgatcatagctacgactggcttattttttcgtctaaaaacgcagtaaaatacttttatccttatttaaaaaacgttaaagttaaaaaggtagctgttataggtgataagacagctcagtattgtaatgaattaggtattagtgtcgactttgtgccacgtgatttttctcaagaaggctttttggacgagtttaagattagcgaacaacatttattgttgccctcaagtgaaaaagcacgttctaaattagttcaacaattgagcaaatataatgaagtcgttaaaattgatttatatagaccagtaccgaattttaaaaatataagtcaagttaagtctcttgttagaaaacatcaaatagacgcagtgactttttctagttcctctgcagttgaattttatttcaaagaggacaatgtgcctgaatttgatcattattttgctatcggtaagcaaactgctaggaccattttaaaattcaatacatctgtaaaagtggcaaataaacaaacattagattcacttattgataaaataatagaaagtagggaacaaaatgaaatttga

SEQ ID NO: 2113 - DNA, 1296 bp, Staphylococcus epidermidis
ggaggtcatatgatgagttttgaaaaatctattaaagcaatggagcaagctgagaaattaatgcctggcggtgttaacagtcccgtaagagcatttaaatcagtagacacaccagctatttttatggatcatggtgaaggatctaaaatatatgatattgatggaaatgaatacattgattatgtgctaagttggggcccattaattctgggacataaaaatcaacaagttatatccaaattacatgaagcagtagataaaggtacaagcttcggcgcttcaacacttcaagaaaataaacttgctgaacttgtgattgaccgtgtaccttcaattgaaaaagtaagaatggtttcctcaggaactgaagctactttagacacacttcgtttagctaggggttatacaggacgtaataaaattataaaatttgaagggtgttatcatggacacagtgattctttattgattaaagcaggatcaggtgttgcaacactaggtttacctgattcaccaggcgtccctgaaggtattgctaaaaacactatcacggtgccatataatgatttagattcacttaaattagcgttcgaaaaatatggcgatgatattgctggtgttattgttgaaccggttgctggaaatatgggtgtagtgcctccagtgaatggatttctacaaggtttaagagatattactaatgaatatggagcattacttatatttgatgaagtgatgactggtttccgtgtaggttataattgtgcgcaaggatactttggtgtaacacctgatttaacttgcttaggaaaagtgataggtggaggtttacccgttggagcttttggtggtaaaaaagaaattatggattacattgctcctgttgggactatttatcaagctggcacactttcaggtaatcctttagcaatgactagtggttatgaaacattgagtcaacttactcctgaatcttatgagtattttaattctctaggagatatacttgaaaaaggattaaaagaggtatttgctaagcataatgttccaatcacagtaaatcgcgctggttcaatgattggttacttcttaaatgaggggcctgtaacaaattttgaggaagcaaataaaagtgatttaaaattatttagtaatatgtatagagaaatggctaaggaaggtgttttcctaccaccttcacaatttgaaggaacatttttatcaactgcacatactaaagatgatattgagaaaactatccaagcatttgataatgcattaagtcgtattgtgtga

SEQ ID NO: 2114 - DNA, 297 bp, Staphylococcus epidermidis
gcagatgtcttgttcttattaattagatttccttcatcatcatataattcaggctcaatttcttcattaattgtttgttcagtaatgactactttacttacattttcagaagaaggtacatcatacatgatgtcaattaatgcttcttctataattgaacgtaatccacgcgctcctgttttacgttcgattgctttttcacttatagcagatagagcctcttcagaaaactctaattctacattatctaactctagcattttagtgtattgtttaactagcgcatttttaggttga

SEQ ID NO: 2115 - DNA, 624 bp, Staphylococcus epidermidis
aaggagataatcatgtctaaatttgatgaacaaataattgttgtaaacagagatattttatttaacaaagataagaatgcttttaatggttttttacataaaaataatttcaaaggaaaagaaatttttagtgcgttaagtaaatatgaagtgaaaagacgtggtgatatggaagatgatccatcgtttaaacaattaatatcatattgcctactagaaaatgagaagggtgaaatccttatttacgaacgtctttctggtggtggagaagaacggttacatggtcagtcatcaatcggtgttggtggtcatatgaacgatgttgttggagctgattctattaatgaagttttaagagttaatgctcaaagagaattagaagaagaagtaggattaagtaataataaatctcaaaatatggaatatttaggttttataaatgatgatgacaatgatgtgggtaaagttcatatgggcgtcgtatttaaaatcactgtgcattcaaacgatgttgaagctaaagaaactgatacgctaaaaattaaatggatagaacaaggcgacattcaatcctatgaggattttgaaacatggagtgcattaattcttcaagatatatcatga

SEQ ID NO: 2116 - DNA, 141 bp, Staphylococcus epidermidis
ctttatgaaattgattctattttattatttgtgactatagagctaacattaatcaaactgattaataaaatagatagagtaaacgagctatggaaaacttcactaaatcttgatataactagacttcaaataaatttttaa

SEQ ID NO: 2117 - DNA, 669 bp, Staphylococcus epidermidis
atatttacctttaataccatttatattcttatcattcgtagtaacttcatcagtttatcaccaacttttatttcttttaaggggagaattttattgagaataaatgaaatggcactgcatgaaaaacctagagaacgtttaattacatatggcgctaaaagtctatccaatgttgaacttttagcaattctcttaaacactggtagaaaaggattttctagtattgacattgcaaacgaattactgaagcaacaatccactattagagatttaaaaaaattgtctataaatgatctactgaaaataaagggcattggactttataaagctgtaatattacaggctgcatttgaactaggtgaacgtattaattctacaagcacttttgacaaagtacagattacacatcctagtgatgttgctagtctgatgatgtcgacaatgaaagatttagagcaagaacattttgttgtacttttacttaactcaaaaaatatagtcacaaaacaagcttgggtatataaaggcacattgaatagttcgattattcatccaagagaagtatttaatattgcaataagagagtcttctaattcaataatagttgtacataatcatccttcaggtgatgtaacaccttctgaaagaggatatgaatacaacgtatag

SEQ ID NO: 2118 - DNA, 960 bp, Staphylococcus epidermidis
ttcttcaagatatatcatgattggagtgctaaattaatggctgatattataccttttccacagtttaaaagtaaaatgattaagcaaataaatgatgcagaaagaaatgcagattttgaaaagatgtatcaattgtttaatgtatatgaacagcatttcgaccccaacgaggagattgcactaaagaaatgccagatgcttttacaattgaatgcttatttagagttacgagaagaggcaattattttgttaaaacgtggattcaactgttatgacgaattgatgatatattatattaaaagtctgaatggcttaggtcaatttaatgaagcagttgaagtaattaatcaaattatcgatgaagttaaaaatcataaaaccagaatggaactttttccacttaaagaatatgcgatatcgagacttgatgaagatagaaaggcattgtcctcatctttatcagatttcggttcgcttaacacacgtgaacaaacttctttaatattacaacttattgataatggacattataattttaaagaatcagtagcgaatatactaatttctatggatttaccaaaaaatttagtgagcttaatgttggaatatttaagatttgctgaatattctcatacaattacaatccataaatatggtgaaactatcaatgtaaaccctaatcatttaagtggcattgagcatacgacgataaaagacaaggtcattcctgtcgtaatgaatagattagaagatggagcgttgcatattttaaaagaagcacaacatattatgaataatcattctatactcatgtatcctatagatatagagtcgttatacactattgataattggatagatgcatatgatgtttacttcaaacaattaattggtatagatataaatggctgtaacaatgatactttacaattcattaaatcattagataatgaaatgtaa

SEQ ID NO: 2119 - DNA, 1347 bp, Staphylococcus epidermidis
atgcattttgttgcaattagcataaatcatcgaacagctgatgtaacattaagagagcaagttgcttttagagatgatgccttacgattagcacatgaagatttatatgaaactaaagcaattttagaaaatgtcattttatctacatgtaatcgtactgaagtatacgctattgttgatcaagttcatacaggacgttattatatacaaagatttttagcgcgctcttttggatttgaggtagatgatattaaagatatgtcggaagttaaagtgggggacgatgcagttgaacatttattgcgtgtcacttctggcttagattcaattgtgcttggtgaaacacaaattttaggacaaatgcgcgatgcatttttcttagcgcaaaatactggtacaactggaacgatttttaatcatttatttaaacaagcgattacttttgctaaaaaagcacacagtgaaacagacattgcagataatgctgtgagtgtttcttatgctgctgttgaattagctaaaaaggtatttggaaaattaaaaagtaaacatgctgtcgttattggagcaggggaaatgggtgaattatcactcttaaatcttttaggttctggaatttcaaatgtaacaattgttaatcggacattatctaaagctaaaattttagccgaaaaacacaatgtttcatatgattcactttcagcattaccatctttattagaaacaacggacatagtaattagttctacaagtgctgaagactatatcatcactaattctatggtgaaaacaatttcagaaactagaaaactggattcattagttctgattgatattgcggttccacgagacattgaaccagggattgatgcaattacaaatatttttaattatgatgttgatgatttgaaagatttggtagatgccaatttaagagaacgtcaattagctgctgaaactattgcaggacaaatacctgaggagattgattcacacaacgaatgggttaatatgcttggtgttgtacctgtaatcagagctttacgtgaaaaagctatgaatatccaagcagaaactatggaaagtattgatcgtaaattgccagatctctctgaaagagaacgtaaagtcatttcgaaacatacaaaaagtattatcaatcaaatgttaaaagatcctatcaaacaggctaaggaattaagtactgataaaaaaagtaatgaaaaattagagctatttcaaaacatatttgatattgaagccgaagatcctcgtgaaaaagcaaagttagaaaaagagagtagagcaaaggaaatcttagcgcatcgaatatttagttttgaataa

SEQ ID NO: 2120 - DNA, 219 bp, Staphylococcus epidermidis
actgatgaagttactacgaatgataagaatataaatggtattaaaggtaaatatttaatatctttaaaagaaaaaatttttaaaattatggcaaaaatccccccaatgataaacgtaaatacaacaataaaaaagaaaaaatttaacggaaatataagtcccaatatattaaaaagcaatatgtctccataccctataaatttagatgcgaatagataa

SEQ ID NO: 2121 - DNA, 236 bp, Staphylococcus epidermidis
gaatcctggtgaagaggcctataggaaatgaatcatgcctaggaatgaaaactcaccgtggagcagctaaacgtgttaaaagaactggttcaggtcaattaaaacgttctagagctttcacatctcacttattcgcaaataaaaatactaaacaaaaacgtcaattacgtaaagctaagttagtttctaaaagtgatatgaaacgtgttaaacaattattagcatacaaaaaataa

SEQ ID NO: 2122 - DNA, 162 bp, Staphylococcus epidermidis
aaaagtcgggtcaaaacttgggcttatatgaacagattaaccccttgggtttgtgctaaaagggatgtccgacctatccctaagaagaggggtataaataaagcgcgacttcttattacttctaaagggatcctctcttttttatttggtacccatctcggg

SEQ ID NO: 2123 - DNA, 714 bp, Staphylococcus epidermidis
tatatgctattacttgcctatacttgtagcattatatttagttttctttatcaattttgcaatcaaaatatattaaaacttcaatatctttattctaggtctcactgtgatttttgtcatactatcataaaacccttagatttactgcctattataagttttttaaaacttcgtggacaatctcgttgttgtaatcaaccattacaacgtttatatttaatcggagaactcgtttcgtttggtgctattttcctctattatcctactcattttaatatacacttcacattatttttaataactttcctgtttctactgacgatgtgtctttacgatattcactcaatgcatattgatatgagactcttatttgtatacacagtcgtatctgtttttacaacccaaacctattttggtaattttataatgatatttttgatttcacatgttatttatctattcgcatctaaatttatagggtatggagacatattgctttttaatatattgggacttatatttccgttaaattttttcttttttattgttgtatttacgtttatcattggggggatttttgccataattttaaaaattttttcttttaaagatattaaatatttacctttaataccatttatattcttatcattcgtagtaacttcatcagtttatcaccaacttttatttcttttaaggggagaattttattga

SEQ ID NO: 2124 - DNA, 297 bp, Staphylococcus epidermidis
gttaaaatatttttaagtgcagcaacatctaaagtttcaagattagcaactataggtacacgaccaataaattctggaattaagccatatgattggagatcctctggacgaatttgttccagtaaagcttcttcatcatatttatctgcttcattactagcaaatcctatcactttttctcctaagcgtctcttaatgacttcatcgataccatcaaaagctccacctaagataaataagatgtttgtcgtatcaatttggattaattcttggtttggatgctttcgaccaccttga

SEQ ID NO: 2125 - DNA, 861 bp, Staphylococcus epidermidis
aaagtgaaattaaatcactaccaggcatataccaaattagtttttaaaaaaaaaattttattgcatgaagagattaaagaggcatatgatttaggtattagagcaatcatgttcttcggtgtgccaaatgacaaagacgacattggatctggtgcatatgatcataatggagttgttcaagaagcgacacgaatatctaagaatttatataaggatttacttattgttgcagatacttgtctttgtgaatacacagaccacggacactgtggcgttattgacgatcatacgcatgatgtagacaatgataaatcacttccattacttgtaaaaacagctatttctcaagttgaagctggagctgacatcattgctccaagtaatatgatggatggttttgttgctgaaattcgtgaaggccttgatcaagcgggatatcaaaatattcctatcatgagttatggtattaaatatgcatcaagctttttcggtccattcagagatgctgcagattcagcaccttcttttggggatagaaaaacctatcaaatggatcctgcaaaccgattagaggcattaagagaattggaaagtgatcttaaagaaggttgcgatatgatgatagttaaaccatctttaagttatctagatattattagagatgtaaaaaataatacgaacgtgccagtcgtagcaaacaacgttagtggagaatatagtatgacaaaagcagcagcgttaaatggttggatagatgaagagaaaattgttatggaacaaatgatatctatgaaacgtgcaggtgctgatttaataattacttattttgcaaaagatatctgtcgttatttagataaatag

SEQ ID NO: 2126 - DNA, 156 bp, Staphylococcus epidermidis
ttttatacctctccaaaaggtccacctgcagctataagtataaaaattgctaaatatgataattcatttttacaagttgagaattattttaatttcctgtattcagttaaagacatgaatttatcttcttctttttttgtaggtttcctttcatag

SEQ ID NO: 2127 - DNA, 504 bp, Staphylococcus epidermidis
gaggcgtttttaatggattggattttaccaattgcaggaatcattgctgcgatagcgtttttaattttatgtatcggtatcgtcgtggtacttatttctgttaaaaagaatttagactatgtggctaaaacactagatggtgttgaaggtcaagttcaaggtattactcgtgaaacgactgatttacttcataaagtgaatcgcttaactgaagatattcaaggtaaagttgatcgtttaaattctgtagttgatgctgttaagggcattggagactcagtacaaaacttaaatggatctgtagatagagttacaaactcaattacgcacaatatttctcaaaatgaagataaaatttctcaagttgtacaatggtcaaatgttgcaatggaaattgctgacaaatggcaaaacagatacaatcgtagaggaagtgcaaactacaaaacaaacactgtagcagatgatgcaaatcatagctacaattcacgtgttaataaataa

SEQ ID NO: 2128 - DNA, 237 bp, Staphylococcus epidermidis
gctaatttatctttactcatcgaatataacattcttgttgaagcatacattcctgagttacctgctgataatacacttgttaatataacagcattcataaatgaagcagcaaaagctaatccagcattcttaaatactaatgtaaaaggtgaagtagctatactatcaccaccgcccattaatgccttactatcatatggaatcaacataccaataatgaaaatagctagaatgtaa

SEQ ID NO: 2129 - DNA, 123 bp, Staphylococcus epidermidis
ttttgtctatcgaaattaactgaaaacggatttaccgtagaattaggcacattcccgttaacaaatgaaacttcagttgaattatcaacgtattcgaaattttctggtagtgttactttataa

SEQ ID NO: 2130 - DNA, 1101 bp, Staphylococcus epidermidis
ggagtgagattttatatgactattgataactcaaaaacattggaacgaattaaaatattaacagagcttcatggagcacctggttttgaagatgaagtgagaagttatatgaaaagtgaaatggaaccatacgtggataagtttattcaaaataagatgggtggtttctatggtataaaaaaatcaaataaagaaaacgcacctcgagttatgatagcagcacatatggatgaaataggttttatgattactcatattaatgataatggaatgattcaatttacgaatttaggtggcgtggctaatgatatttggcaaggacaaagattaaaaataaaaaatagatacggtaaagaaatcataggtgtagttgctaatattcctaaacattttagaacaggaaatgaaagcatacctcaaatcaaagatttaatgctagatattggtgcttcttcatcagaagaagtgcgcaatcggggtgtagaggtgggcgatacaatagttcctcacacaataatgactcagttgtcaaaaaacagatacagcgcgaaagcctgggacaatcgatatggttgtgtcttagctattgagatattagaattattaaaagacgttcaactagatgttgacttatatgttggtgccaatgtacaagaagaagttggacttagaggagctaaagctgccgcaaagcaaattgatcctgatattgcattcgttgtcgattgctcccctgcaaatgatatcaaaggtaaacaacaactttctggtgtgttaggggaggggactttaattcgtatcaaagatggtactatgatacttaaaccattatttagagattatctccttaagctagcagaagaaaatcagattgcatatcaatattatatatcaccaggtggtacagatggtggggagattcataaagaaaatgaaggtataccaacagctgttattggagtatgtgcgcgttatattcatagcactgatgcggtctttgatattagagattatttttctgcacgtcacttgctaaaagaaagtattattcatttaacaagtggacaaattcaacaattacaatatggaaaggaattttga

SEQ ID NO: 2131 - DNA, 138 bp, Staphylococcus epidermidis
attcagatatcatcgtggcttaatataagaaaagtaacagctcaacgagctgaaaatcatcaaaaaaattataaaaaagacaattcctatattatttcaatagaaattgtctttatttacttatcttggaccttttag

SEQ ID NO: 2132 - DNA, 165 bp, Staphylococcus epidermidis
attcagacatcatcgtggcttaatataagaaaagtaacagctcaacgagctgaaaataatcaaaaaaattatagaaaaagacaatttctatattatttcaatagaaattgtctttttttacttatcttgaacctttttgtcccagcttctttattttttaattga

SEQ ID NO: 2133 - DNA, 144 bp, Staphylococcus epidermidis
tcatttacttttttatcttttttctttttacgtgaggacatgattgctaaaccagatattaaagtaactcctgctaatggtagtgatttatcagcatttcctgcctctggtagagatttaattgtattattctcggaactataa

SEQ ID NO: 2134 - DNA, 156 bp, Staphylococcus epidermidis
atatctatgtcacaatttaaaaaatctggactcgataaaagttcagctacagtaattgctgaaacatcaaaacatcgttcttcacttaaaaatacgccatctacatcaaataatatagccttcatgccttacccctttcatttcagaaaattctga

SEQ ID NO: 2135 - DNA, 141 bp, Staphylococcus epidermidis
ttcttcactttcttcttactatggttcgctattaagaagagtataaagaataaaacagccacaagtattgcaacaattaagccaattactgtcggtgaagaaaaatccattaaaacaacgctcctttatcagtttcaataa

SEQ ID NO: 2136 - DNA, 627 bp, Staphylococcus epidermidis
aagtcaactttcaagatatggtatactatatctaactttaggaggtatctaatgcatttcaacaagtatcaaatactaactacagataaatatactaaatttgaacatttatataagaaggtcaaacatatatgtgtcgtaatttttttggtggtttttttgattggttttattatactgttgtcattagtattatacttccaacaactaactaaagatgcttcgtcaataagtgatcgagagttgaaagcaaaaatccttcatatacctggcgatgagctaataaatcataataatcaaattttagaagaatatgatcattcacaaaatacactcatagttggaccgaaccatgtaaattcaaatattatacatgcacttacagcctctgaagatacattattttataaacataacggtattatgcctaaagcacttttaagggcgatgcttcaagatatcacaaattcaaaccaatcttctggtggtagtactatcacgcaacaattagtaaaaaatcaagtgctctcaaataaaaaacttatagtcgtaaagcaaatgaaattatcttggctacacgggtcgaaaatttattatcaaaagatgaaatcatatatacgtatttaa

SEQ ID NO: 2137 - DNA, 147 bp, Staphylococcus epidermidis
ttgttatatccattaattttttacatctttcaaattgcattttctaaagaatttctaagtgcatttttctatttatggcaattgtttatacgacaagatgcctgtgacattacatatggtcataggcatctttttgtatatagttaa

SEQ ID NO: 2138 - DNA, 639 bp, Staphylococcus epidermidis
atgtctatgtttacaggtatcattgaagaaataggtactgtacaacaagttcgctctgagcaatcagtaagaacgcttgaaattaaagcacaaaacattttagttgatatgcatattggtgattcaataagtgttaacggtgcatgtttaactgtgatagatttcactgactcaagtttttcagttcaagtcatcaaagggactgaaaacaaaacatatcttggaagtgttcaacgtaatacagaagttaatctcgaaagagccatgagtggaagtgggagatttggtggacatttcgtgttaggtcatgttgatgagcttggaacaatttctaaaatcaatgaaactgctaactcaaaaattatttctattaaaacaactaaaaacattttgaatcaaatggtaaagcaaggttctataactgtagacggagttagtcttactgtatttgatttacatgattatacttttgatatacatcttataccagaaacacgtcgatctactattctttcatctaaaaaagtgggcgacaaagtgcacttggagtctgacgtactattcaaatatgttgaaaacatcatgaatcaaaatcaatcgcagttaacagaagaaaagcttagagcatttggtttttag

SEQ ID NO: 2139 - DNA, 1704 bp, Staphylococcus epidermidis
agcttaatgttgaagttccatttgcgtttattactattaattagtactattacaatcattagttttattggtttaggcgctatcattcacaacacaatttatcaaacattaactagtaatcaaattaaaagcttagatagtgaagcccgtaattatgttaatctctttaataataataaagagaaagaaatcactaatatagctcataatgaaaaaaatatcatattaataaaagaaaaagataaagataaaattatttactcaagtggaaatattaaagatattgaccatagaattgataatgaagctaatccttcgaaattaatcaataaaaacacaaaactcggtatgcgttacacctataagaatacaatagatgataaaacaatatacataagtggaattaataatgaaattattgatttacaaaaggatttatggaaatacttgtctattgttggagtcattgtattatttacggtctatttagcaagtagaagtatcaatcgaacatatattagacctatcaatgaagtaacttatgctacatcacttctagcagatggatattaccatgttcgtgttccagaaagtaatgtgaaggaaactagggcattatttgtgactacaaatgacttagcacgacgattgcaaaaattaaacaatagtcaaaaaattcaatccaatagattaaaaactaccttagaaaatataccgagttcagtactgatgattgataaacatggagaaattgtagttgctaatcatgcttattatcaggtgtttaaccctgatcaaatggtagaaaataaaagttacattggtttcatagatgatagtattgaaaaattaattattgaaagttttagaactgaaaaagttatctatgaacaattagaagttgctattaataacgtacatactaaatatttcgatgtatcttgtatccccattttaactaaatctaaaaaaaatttacaaggtatggtggttgtgcttcatgacattactaatttgcagaaattagaaaaccttagaagggaatttgttgcaaatgtgtcacatgaactaaaaacaccgattacttcaatcaaaggttttgcagaaactctgattgaaggtgctaaaaatgatgaacaatcgcttgatatgtttttaaatattattttaaaagaatctaatagaatagagtcattggttacagacttattagatttatcacatatagaacagcaaaaagaacttgaaataaattacatgaatttatctgaattagctattaatataatagataatttgcaaacacaagcatacaataagagaatcaaaatacaatctgaaattgaaaaagatgtcatcattgaggcacatgaaaataaaatagcgcaagttattactaatttgctatcaaatgctataaattattcttcagaagataataaggtaatagtaagagtatatagaaatgacaataaagtttatttagagattcaagattatggtattggtataagtgaaacagatcaaaagcgtatatttgaacgtttctatcgtgtagataaagcgagaagtagagattcaggtggtacaggacttggtctgtctataacaaaacatattgttgaagcacataatggtagaatagacgtgaaaagtgcacctggcaaaggttcgatattcaaagttctatttaatgataattaa

SEQ ID NO: 2140 - DNA, 309 bp, Staphylococcus epidermidis
tctactgctttagatctagaaaaaatgatacctactacaaaaatcacagttaatagagcaaatattataccaaaaataagatttgcagtgaaaaaagaaaaaatagaaagtgctgctgatagaatagtcaaaacaataaatcctattctcaaaaacttttgtcttttatttttttgtgtttgttcttcttcaaaagtttcttttaacttttcatacaagttctctttttcatgtaattctaaaacttgttgtgtatattcctttttcttttcaaaggtttcgtcaggaacaagctcattctcaacttga

SEQ ID NO: 2141 - DNA, 741 bp, Staphylococcus epidermidis
cctttcacgttcaggaggagaaatgacatgacaaaattaaatgttaaagtgtttgcggatggtgcagatattgaagaaatgaaatcagcatataagaatcaactcgttgatggttttacaacgaacccaagcttgatggctaaagcgggtgtaactgattataaagcttttgcagaggaagtggttagtgaaatacccgacgcttcaatttcttttgaggtgtttgctgacgatttacctactatggaaaaagaagctgagattttaaaacaatatggtgataatgtatttgtaaaaattcctattgttacaacaactggtgagtctacactaccattaattaaacgtttatcatcgaaacaggtaaggttgaatgtcacggctgtctatactatagagcaagtaaaagcaattactgacgctgtaactgaaggtgtgccaacatatgtgtcagtatttgcaggacgcattgcagatactggggttgatccacttcctttgatgaaagaatcagttaaggtaactcatagtaaagaaggcgttcaattattatgggcaagttgtcgtgaagtatataatgtaatccaagctgatgaaattggagctgatattattacttgcccagctgatgttgtaaaaaaggttaataacaatttaggccgggatataggagaactttcagtagatacagtcaaaggttttgccaaagacattcaaagttccggtttgtcaattttataa

SEQ ID NO: 2142 - DNA, 177 bp, Staphylococcus epidermidis
gtttccttgccatatatttatagcgtaaatctaacttattacattcttctaattaaagtgtcattatattattataactcttctaatatttcatcaactgcattcttaccttgttgtatgcagtctggtaaaccgacagcttcaaacggtgcccctgtaacacgtaatctaggataa

SEQ ID NO: 2143 - DNA, 249 bp, Staphylococcus epidermidis
aacaatacgccaatagcaattaaaataactactaatattgctaatatgataaataacaccatatacttctcctcctattttatcatcttacattataacgtaattttgtgcgtcgttaaatcacaaaatcaattaattgatagattatttttaaaagattatactaaattaaaaattgtagtaacgaggtatgacgatgacaaagaatattccaacaaattacaaactgatatcaaaacaacttgctag

SEQ ID NO: 2144 - DNA, 141 bp, Staphylococcus epidermidis
ataaagaagccagtaaatgaatttctgaaaactcatttactgacttttttgctaggaattatgtcccaacctcattttactattgatttacttaccgtcaaattcaagagggttaggtccaattcttttatcttgatttaa

SEQ ID NO: 2145 - DNA, 180 bp, Staphylococcus epidermidis
agccgacagttagagtctggatgggagaaagaagttgaattatcgacttacacaaattcgtgtagttatgataagcgtattgtatacttatgtgcaattttaagtatgctaataggcttatttaaagatatagatatctccttatgcctacagtataggtataaggtttttttgaggtga

SEQ ID NO: 2146 - DNA, 1263 bp, Staphylococcus epidermidis
atgatatttacatccatgtcacacaaggtagtagtgcttatgaataacgaggcgttaactttgtttagaaaacgacaacaagctatacgtaaggagaaaaactattataataaatttatatttaatggtcactttacagtttttctacttatactattaggagcatttatatttggatatggcgaatggttaagtcacattcctccccaaatagactatgcactatttgctagtatagcattagctgttgtttcattattcccaattcgtacactcttaaaagaagcggaccaaatcttcttactaccttttgaaagacacatgaaaaattatattaatgcaagtctgttttatagttatatttcaagaatcagtttaccgttcattttgctaatcgtattctttccattgttttataaattaagtcacaatcattatggattttatatcgcattttctataagtacattgctatatccatatttggtattactcatcaaatggcaatgggttaaattaaataaaaatgtgttcattatcaacatattattatttatacctttagcagtaacgcattacatgattttaagatttcataactatttagcttttttaataatgattatattatttgtaatttatttagtcctaaagactaaagcagatcactatttacttccttgggaaaaagtgattgcaattgaacaacaacatcacacaaattattataaattcgttaatatgtttacagacgtaaaacacctaagagaatcagcagtacgtcgtagttatcttgatttcttactacccgttcctaaaggtgccaaatttaatgagaatcggatgtatttatatttatttataagaagttttgtcagaggacgcgatgctttttctattattttaagattagttattatcgctattatattaatggtatggttatcacaaccggttgtttcattaattatcggtagtttgtttatgtatattattttattacaaatgtctcaattttatacgcaacaagcatacggtttatggcctcaagtttggcctgtatctgatacaaaagttattgcgggatatcagcaatttttaaatcgcttgatgattataatcgctattacatttacgattgtttatgtaatcaaacaccatgacttattcttttttgctgtattattctttatagtaggctggctaaccattcgaaatgcagttaaaaaattaaaatatcaagaaacattattacgtgactaa

SEQ ID NO: 2147 - DNA, 507 bp, Staphylococcus epidermidis
gaggtcgttacgatgactcaaattacatttaaaaataatcccattaaattatcaggttctgaagtgaatgaaggtgatatcgcaccaaatttcacagtgcttgataatagtttgaatcaaattactttagatgattataaaaacaaaaagaaattaattagtgttataccatctattgatacaggagtatgtgatagtcaaactcgaaagtttaatgaagaagcttcagcagaagatggtgtagttttaacgatatcagtagatttacctttcgcccaaaaaagatggtgtgcatcaagcggattagataatgtaattactttaagtgatcataaagatttatcttttggtcgaaattatggacttgtgatggatgaattacgcttacttgcacgttcggtatttgtgttaaacgaaaacaataaagtagtatataaggaaattgtcagcgaaggtacgaattaccctgattttgaagctgcattaaaagcttacagaaatatttag

SEQ ID NO: 2148 - DNA, 1149 bp, Staphylococcus epidermidis
ggacacgttacgataaggttggaggtagataatatgaaaattgggattcctaaagaaataaagaataatgagaatcgagtggggttatccccaagtggtgtacatgcacttgtagaccaaggacatgaagttttagtagaaacaaatgctggtctaggatcttactttgaagatggtgattatcaagaagccggtgccaaaattgttgatgagcagtcaaaagcttgggatgttgatatggtcatcaaagttaaagaaccacttgaatcggaatacaaattctttaaagaagagttaatcttatttacttatttacaccttgcgaatgaacagaaattaactcaggcacttgtggacaacaaggttatatctattgcctatgaaactgtacaattaccagacggttctttaccgttattaacaccaatgagtgaagtggctggtagaatgtctacacaagtgggagctgaatttttacaaagatttaatggaggtatgggtatcttactaggtggcatacctggagtacctaaaggcaaagtcactatcattggtggtggtcaagcaggtacaaatgcagctaagatagctttaggattgggagctgaagtgacaatactagatgttaatcctaaacgtttagaagaattagaggacttatttgatggcagagtaagaacaattatgtctaatccattaaatatagaaatgtatgtgaaagaaagcgatttagtgattggagcagtccttattccaggtgctaaagctccaaacttagtgactgaagatatgataaaagaaatgaaagatggatcagtgattgtagatattgcgatagatcaaggtggaatttttgaaacaactgataagattactactcatgataatccgacttacactaaacatggtgtcgtgcattatgctgtagctaatatgccaggtgccgttccacgtacatctacaattggattgaacaatgcaacattaccttatgcgcaattattggctaataaaggttatcgtgaagcatttaaagtaaatcatccattatctctaggtctgaatacatttaatggacatgtgactaataagaatgtagctgatacatttaattttgaatacacttcaattgaagatgcattgaaataa

SEQ ID NO: 2149 - DNA, 1524 bp, Staphylococcus epidermidis
aacgtaactactaataataaatacataaggatgatttacatgcgtgtagcaataataggtatgggaacagctggtgtaagtgtgttacgccaactcgttaaacatgaaaacttttctcaattaaaagtagatgtatatgacgatgatagaaatatgggccaaggtgttccatttcaaaatgatagtagcgaactacttattaacatgccatcaaaatccatgagcttaaatcttgatgatgatcaagagttttggaagtggtatcaaaatcagacggaatttaattttagtaatcctcaatatttgcctagatttgtatttggtcattatatgaagtcttatttatcttattataatgaccaatttgataatttaactattatcaatgataaagtacaagaaatttttacacaatccgatgttgatgacacagatttaaaatatcatgtatgtacatgtgatgatgaaaaagaatggcgtgaatacgattatttatttttaacttttggaacttttagttaccatgacccttatgatttgaagggaactaaaggctatatacaaacgccgtatcctacatatcatacacttgataatgttaaagattcagatcgaatcgtgattattggaacagggttggctagtttagatgctgtgagatatgtagctgcacatcatccatctttacccattactatgacaagtcgttctgcagcattgccaagtgttagagggaaaatgactaaaattcagtttacgcatttaactaaatcacgatttaatggaattatgaaaaatcactttggtaatgtaccattagaaaaagtagtttcattatttttaaaagaatgtgaagattatggaatagattttaaaaaacttatttatcgtagaaccggaaaccatgtcaaagacttggagtatgatttaaatcatgaagaagaaatggggatattccaaagtatcattgaacatttaaaagaaaatttaaactggatttggaatagtttgagcgttaaagatcaagaaacttttaatcgtaaatacactaaaattattcagttaaattctaatccaatgcctcctagaacagctcgtttacttatcaagttaatacagaataatgaacttgtcattaagaaagggctagaagacatagtccataaaaataatcaatttatgttgaagtataacgacactacgcaaaattatgagttgtttgacatcgttattaatgcaacgggctctaaaacacatctttctcaattagatgaggatgatcaattaattttaaacttagaaaatagacaaattgttcaacgtcatcctatgggtggcattcaaattatcccagaaacaaatcaagtcataagccctagatatggaaccttaaaaaatgtgattgcaattggacaaatgaccaacggtgtcaataaacttagaaatggcgtaaagatgattgttaatcaagttgttgatacagtatctcaattatatataacacaggaaaatagaaataagtaa

SEQ ID NO: 2150 - DNA, 186 bp, Staphylococcus epidermidis
aaaagacatacgaaagcaagtgttcaaaaattaaataattgcttttcacaagcttttaaagatgcgttaaatgaggaaataattgaacgtgatcaaacttggaacgaccctatctatgaaaggaaacctacaaaaaaagaagaagataaattcatgtctttaactgaatacaggaaattaaaataa

SEQ ID NO: 2151 - DNA, 186 bp, Staphylococcus epidermidis
atcaatagtactattcatttaagaagtactatgacaaaatcagctaataaaatcatttcaattgctataaaagatatgaaacatatacaaaatgttttaaacagactattacagatttctgccaaaataaaaaacataccttttagtaaaatggttaaaattttgatatcgacatctacgaaatga

SEQ ID NO: 2152 - DNA, 663 bp, Staphylococcus epidermidis
gcatgtaacactcttttttgttttttcataacaacaaaaaagaaaaaggaggagtctcacatggctcgattcagaggttcaaactggaaaaaatctcgtcgtttaggtatctcattaagcggtactggtaaagaattagaaaaacgaccatatgcaccaggacaacacggtcctaaccaacgtaaaaaattatcagaatatggtttacaattacgtgaaaaacaaaaattacgttacttatatggaatgactgaaagacaattccgtaacacatttgatattgctggtaagcaatatggtgtacacggtgaaaacttcatgattttacttgctagtcgtttagatgcagttgtttattcattaggtttagctcgtacacgtcgtcaagcacgtcaattagtaaaccacggtcacattgaagtggatggtggacgcgtagacatcccatcttactcattaaaacctggtcaagtgattacagttcgtgaaaaatcacaaaacttagatattattaaagaatctgttgaaattaacaatttcgtaccagaatatttagacttcgatgctgacaacttaaaaggtactttcgttcgattccctgaacgtagcgagttaccagctgaaatcaatgaacaattaatcgttgagtactactcaagataa

SEQ ID NO: 2153 - DNA, 138 bp, Staphylococcus epidermidis
attaaattaacgaggtaccttatgcataaagattataatatgactcaacttactttaccaaaggaaacttcagtacatattcccacacatgatatgtcacaatatgtgaatgatattgtaaaaaattccaggtactga

SEQ ID NO: 2154 - DNA, 177 bp, Staphylococcus epidermidis
actaaattaacgaggtgccttatgtataaagactataacatgactcaacatactctactaatggaaacttcagttcttatccccgcgaatgatatttcacgacatgtaaatgatattgcagaaacaattcccgatactgaattcgatgaattcagacatcatcgtggcttaatataa

SEQ ID NO: 2155 - DNA, 177 bp, Staphylococcus epidermidis
acaaaattaacgaggtgccttatgtataaagactataacatgactcaacatactctactaatggaaacttcagctcttatccccgcgaatgatatttcacgacatgtaaatgatattgcagaaacaattcccgatactgaattcgatgaattcagacattatcgttgcttaatataa

SEQ ID NO: 2156 - DNA, 168 bp, Staphylococcus epidermidis
acaaaattaacgaggtgccttatgtataaagactataacatgactcaacatactctactaatggaaacttcagttcttatccccacaaatgatatttcacgacatgtaaatgatattgcagaaacaattcccgatactgaattcagatatcatcgtggcttaatataa

SEQ ID NO: 2157 - DNA, 624 bp, Staphylococcus epidermidis
atgtttgaaacgataacgacagccgccatcctgtatattgctacagcggttgatttattagttatattattaatattttttgcaagagctaacaattatcaacagtataaagatatttatattggacaatatctagggtcattaactttaatttttgtaagtttgttttttgcttatgtacttaactatgtaccagataaatggattttaggattgcttggtcttataccaatttatttaggaattaaggttgctatattcgatgattgtgaaggggaaagaagagctaaagatgaactaaataaaaaaggattatctgagttatcaaaatctgtagcagtagtcacattagcaagttgtggtgcagataatataggattatttgtaccatatttcactaccataaataattatgaattagttatcactttaatcacatttgtaatcttaatttttattcttgtctttaccgctcaaaaattggctaatatacctggcctaggtgaagtcattgaaagatttagtaggtggataatgtcaatagtctatattggtttaggactattcattatcattgaaaacggaacagttcaaaaactctttcattttgtttttttagtgtaa

SEQ ID NO: 2158 - DNA, 156 bp, Staphylococcus epidermidis
atctgtgaaactctgtctatcaatactatttatctacctttctcattggaattattttatccggacacaagaaattgcaataatacacatttcttgaaacacatattacatcttaatatattttcaataaaaataaaagagtatatccgtttttga

SEQ ID NO: 2159 - DNA, 231 bp, Staphylococcus epidermidis
aaaggaggaacttttatggattatgcacatttaaatctcgagcacttttttgcaagaaatgatgatttggatattattagagatcgatctgattttgtgatgattaataatttcaccaatgagatgaaataccgtgaaggtgaaattgaaggaactatagatttgaatcaatactattataaaaatagatcacaagctgtaagtttcataatgatgaattataagaactaa

SEQ ID NO: 2160 - DNA, 483 bp, Staphylococcus epidermidis
cgaggtatgacgatgacaaagaatattccaacaaattacaaactgatatcaaaacaacttgctagtttaatcgaagatgaaaagaatttaattgcaatattaagcaatacttctgcccttcttaacgatacaattgatcaaattaattgggtaggtttttaccttattgaaaataacgaacttattcttgggccatttcaaggtcatcctgcttgtgtacatattgctattggtaaaggggtttgtggcactgccgtttcatctggtgaaacacaacgtgttaaagacgtccatcaattccctggccacatagcttgtgacgcaaatagtcaatcagaaattgttattccattacatcaaaacggcaagattatcggagtattagatattgacgctcctataaaaaacagattttcacaagatgatcaagaaggacttgaatccattgtaaaaactttagaaaaacaactcaatcaaatttaa

SEQ ID NO: 2161 - DNA, 1098 bp, Staphylococcus epidermidis
gtagaaatgactaataaattagaacagtatagagaagaaattgtttccttaaatgatcaagtattagaattactatcgaagcgaggagaattagcacagaaaattggtgaagaaaaaattaagcaaggtacacgagtatatgatcctcagcgtgaaaaggaaatgattaatcagctattagataaaaataaaggtccatttaacgacaatgtgattaagcaattatttaaagaaatttttaaagcctctacagatttacaaaaatcagaaaatgaaaaacatctttatgtatcacgtaaattgaaacctgaagatacgatcgttaaatttgataatggtggaatcattggtgatggtaataaatcatttgtatttggtccttgttctgtagaatcacaagaacaagttgatgctgtagcacaagatttgcaggctaaaggcgagaaatttattcgtggcggagcgtttaagccgagaacttctccttatgatttccaaggtcttggagtagaaggtctcaaaattttgaaaaatgttaaagataaatataacttaaatgtagtaagtgaaatagttaacccaaatgatttcgaaatcgcttcagattatttggatgttttccaaattggtgctagaaatatgcaaaattttgagttactcaaagaagctggtcgtacagataaacctattttattgaaacgtggtttatcagcaacgatagaagaatttatctatgcagcagaatatattgcttcacaaggtaaccgaaatattattttatgtgagagaggtattcgtacatacgaaaaagcaactagaaatacattagatatctctgctgtacctattttaaagcaaggaacacatctacctgttatggttgatgtaacgcatagtacaggtagaaaagatattatgttaccgacagcgaaagcggctttagccgttggtgctgatggagttatggctgaagttcatccagatccttctgttgcgttaagtgatgccggtcaacaaatggatcttaatgaattcaatcaattttatcacgaattaaaaccacttgctgatatgtacaattcgaagaaactgaaatag

SEQ ID NO: 2162 - DNA, 207 bp, Staphylococcus epidermidis
gtaatgcttgctaatacgataactgaaattgcaacagtaatgattgttcttgcaatagatggccacttgctaaatttccacatgagaaataaacctagtggaaaaatgaataaaagtgataaaactataaaccattcttgtttgtaccatgatgtcgtttcttgttgcataaaacgtcctcctgtgtatctatttgatgaaaagtag

SEQ ID NO: 2163 - DNA, 1248 bp, Staphylococcus epidermidis
ctctcatatttaaagagaattttcgtaatttatttaaaggagaaaatgatgacatacaataaacgattatttacctcagaatcagttactgaaggccatcctgataaaattgctgaccaagtttcagatgccattcttgatgaaatattaaaggatgatcccaatgctcgtgtagcatgtgaaacaacagtaacaacaggaatggcacttatttctggagaaatctcaacaactacttatgtagatattcctaaagtggtgagagaaacgattaaagatattggttatactagagcaaaatatggttatgattcacaaacaatggcagtgttaactgcgattgatgaacagtctcctgatattgcacagggtgtagacaaagctcttgagtatcgaaatgatatttctgaagaagaaattgaagcaacaggtgcaggtgaccaaggattaatgtttggatatgcaactgatgaaactgatacgtatatgcctctacctatattcctgtcgcatcaacttgctaaacgattggctgatgtacgaaaagatgaaattttagattatcttcgtccagatggaaaagtacaggtgactgttgaatatggtgaagatgacaaacctagacgtattgataccattgtagtttctacacaacatgctgaagatgtagagttagcacaaattgaaaaagacattaaaacgcatgttatttacccaactgtagataaagctttattagatgatgaaactaaattttacattaacccgactggacgtttcgttattggaggacctcaaggagatgctggtttaactggacgtaaaattatagttgatacgtatggtggttatgcccgtcatggtggaggttgttttagtggtaaagatcctactaaagtagatcgttcagcagcttatgcagcaagatatgtagctaaaaatattgttgcagctggtttagctaaacaatgtgaagtacaacttgcatatgcaattggtgtagcagaacccgtttccatttcaattaatacgtttgatactggaaaggtttcagaagcacgtttagttgaagctgtaagaaagcattttgatttaagaccagcaggtatcattaaaatgttagacttaaaacaaccgatatatagacaaacagcagcgtatggtcattttggacgtacagacgtattgttaccatgggaaaaattagataaagtcaatgttttaaaagatgctgttgaaattcaatga

SEQ ID NO: 2164 - DNA, 522 bp, Staphylococcus epidermidis
agaagtgcagctcgaaatgaaaaaaggtttgcaaatgaggagagaacaaaaatgacaaatcatattgtactatatcaaccagaaataccagcaaatacaggaaatattgcacgtacttgtgcgggtactttaacccatcttcatctaattaaaccactcggctttagtacggaagacaaaatgttaaaacgtgcaggacttgattattgggagcatgttaatattacatatcacgatagtattgaggaattttttgctaatacagaaggtcattactatttattaacaaaatttggtaaacagacctacagcgattttaatttttctaatactaatgaggattattattttatctttggtaaagaaactactggtcttcctgaatgggttaaggagaaatatgcaaaaacagctttaagaattccaatgagtgacaatatacgctctcttaatctttctaatactgctgctttactgatttacgaagctttgagacaacaagattatcctaacctttcataa

SEQ ID NO: 2165 - DNA, 588 bp, Staphylococcus epidermidis
aatgaacaagcagagtatacaatcatgaaactagaacgtattttacccttctctaaatcgttaattgattctcatattaatcataatagtattgtaattgatgcaacatgtggtaatgggaatgatactgcttattttgctcaacatgttccaaatggatttgtctatggattcgatatacaagaacaagcaattttgaatacgcacaaaaaaacaaaagattattcgaatgtaaaattaatccaatctggtcatgaaaatgctaaattgcacattcccgcccaacatcacggttgcatagatgctgctatttttaatttaggttatttaccgaaaggtaacaaagaaattgtcactaaacctgaaacaacaattatggctattaatgaaatctttgatatcttaagtattgaaggaattattatattagttatatatcacggtcatgaagaaggtaaagtagaaaaagaagcactacttgaatttttacaaaactttgatcaaaataaagctcatatattacaatatcaattcataaatcaaaagaataacgctccttttatctgtgctattgacaaacgtaattaa

SEQ ID NO: 2166 - DNA, 507 bp, Staphylococcus epidermidis
gccatgtatttatatacatcttatgggacttaccaatttttaaatcaaattaaacttaatcatcaagaacgtaatttatttcaattttccactaatgattcctcaataatcttagaagagtctgagggaaaatcaatcttaaaacatcctagtgcatatcaagtgattgatagcacaggtgaatttagcgaacatcatttttatagtgctatttttgtccctacatctgaagatcaccgtcaacagctagagaaaaaattattacacgtagacgtacctttaagtaattttggtggttttaaaagctatcgtttattaaaacccactgaggggtctacctacaaaatttactttggttttgcaaatcgaacagcatatgaagatttcaaagcttctgatatatttaatgaaaacttttcaaaagatgcattgagccaatactttggtgctagtggtcaacattccagctattttgaaagatatttatatccaatagaagatcattaa

SEQ ID NO: 2167 - DNA, 168 bp, Staphylococcus epidermidis
gtatcaatggcgctattgttgaaagtggctcgtgattatacagaaagacagattgggttaaattcgaccaagttattaaaaaagatggatattggtggcaccactttaaatatcaagcaccaggttcaagtaataaacatttctattgagccgttagtaaaattataa

SEQ ID NO: 2168 - DNA, 1128 bp, Staphylococcus epidermidis
ggcatgaaggctatattatttgatgtagatggcgtatttttaagtgaagaacgatgttttgatgtttcagcaattactgtagctgaacttttatcgagtccagattttttaaattgtgacatagatattcattttgatggtaatttaactgaaaatgatataaacaaaatacgtagaaacgtatttaataatgaccgaatattaaatcaactaaagtcacttggtttaaattcaaattgggatatgctatttattgtatttagtattcatttaattgataaagctaaacaattaaaaccatcattacgagatcaattacttgatgaattattgtttaccaaagagactttaaaggaaatagcaaaggatttaactgataaaacgataaattatagcttaccttacgatgtgatagcttcgtttagaaatggtaaagatgctatttacgaagatttggaagtttacgctaaaaatcaattagaacttaacaacactagtttatttaaattgaaaagtgctttatggacattagcaaaagatatatatcaagaatggtatttaggaaaagctttatttaatcaagttgaatataaaaaagatattcaagattttaagaaaggtttcatttatgatgaggtcattcttaaacctatagaagaaattcaattattacttcaaaatctaatagaagcgggatatcaaattgcgatagcaactggtagacctcgaactgaaacaattattccatttcaatcattgggattaaaatcttattttaaagatgaacatatcgtaacggcaagtgaggtgttgctagcagagaaacaatttcctcaatatcaacctttaggaaaacctaacccgtttagttacatcgctacgttaaatggaaattataatgaccaatatgaacgatatgcgacaaagcaagaagatatcgtaaataaagatgaggtttacatagtaggcgactctttagctgatttattaagtgcgaagaagataggggctacgttcattggtactttaactggtttaaaaggtaaagctgctcactctgaattagttgcaaatggagcagatcatgtagtagaggatataactaagattcgaaaaattctattatag

SEQ ID NO: 2169 - DNA, 144 bp, Staphylococcus epidermidis
aaatgtaatttttattacaacataaaaaaaagagctaaaagcctaacaattagactaatagctatacaaaattactccacaactgaaccaatttttctaaatttttcaaaacgatcatttgctaattcttcaggtgtgagttga

SEQ ID NO: 2170 - DNA, 11091 bp, Staphylococcus epidermidis
gaggccaatttaatgaatctatttagaaaacagaaatttagtattagaaaatttaatataggtattttttcagcattaatagctacagtcgcatttttagctcatccggggcaagcaacagcatcagaactggaaccttctcaaaataatgacactacagctcaatctgatggagggttagaaaacacatctcagtctaatcctataagtgaggaaaccacaaatacattatctgggcaaacagtaccttcatctactgaaaataagcaaacacaaaatgttcctaatcataacgctcaaccaattgcaataaatactgaagaagctgaatctgctcaaacagcatcttataccaatatcaatgaaaataatgatacgagtgacgatgggttacatgttaatcagccggctaaacatcatattgaagcccaatctgaagatgtaacaaatcacacgaactcaaatcattcaaattcatcgattccagaaaataaagctacaacagaatcatcaagtaaacctaaaaaaagagggaaaagatcattagatacaaatagcggaaatgacacgacaagtacaactcaaaatacggatccaaatttaagtaatacaggtccaaatggcattaacactgtaattacatttgatgatttaggaattaagacaagtactaatcgctctcgacctgaggtaaaggtagttgatagtctaaatggctttacaatggttaatggtggtaaggtcggtttattaaatagtgtgttagaacgtacaagcgtgtttgatagtgccgatccgaaaaattatcaagcaatagataatgtcgtagccttaggacgtattaaaggaaatgatccgaatgatcatgatggtttcaacggtatagaaaaagaattttcagtgaaccctaattctgagataatattttcatttaatacaatgactgctaaaaacagaaaaggtggaactcaattagttttaagaaatgcagaaaataatcaagaaattgcttcaactgatattcaaggaggcggcgtatatcgtttattcaagttacctgataacgtacataggttaaaagttcaatttctacctatgaacgaaatacactcagattttaaaagaattcaacagctacatgatgggtatagatactattcttttatagatacaattggtgttaattctggttcacatctatatgtgaaatcaagacaagttaacaaaaatgtaaagaatggtaaagaatttgaagttaatactcgtatagagaataatggtaacttcgctgctgctataggtcaaaatgaacttacttataaagtaacactaccagaaaatttcgaatacgttgataattcaactgaagtttcatttgttaacgggaatgtgcctaattctacggtaaatccgttttcagttaatttcgatagacaaaatcatactttaacgtttagtagtaatggtttaaatttaggaagaagtgctcaggatgttgctagattcttgcccaataaaatactaaatattagatacaagcttagacctgtcaacatctcaacgccacgtgaagtgactttcaatgaagcaattaaatataagacattttctgaatattacattaacactaatgacaatactgttactggtcaacaaacacctttcagtattaatgtcatcatgaataaagacgatttatcagaacaggtcaataaggatatcatcccatcgaactatacacttgcttcttataataaatataataagttgaaagaacgtgctcagactgttctggatgaagaaacaaacaatacaccttttaaccaaagatactctcaaactcaaattgatgatttgttacacgaattacaaacaacactaataaatcgtgtgagtgcttcgagagaaattaatgataaagctcaagaaatgactgatgctgtatatgatagtacagaattaactactgaagaaaaagatacattagttgatcaaattgaaaatcataaaaatgaaatttctaataacattgatgatgaacttacagatgatggtgttgaaagagtcaaagaggctggattacatactctagaaagtgatactccacatccagtaacaaaaccaaatgcacgacaagttgtgaataacagagcagatcaacaaaagacgcttatacgtaacaatcatgaggcaactaccgaagaacaaaatgaagcgattagacaagttgaggcacattcatctgatgctatcgccaaaataggtgaggcagaaacagataccactgtaaatgaagctagagacaatggtacgaaattaatagctacagatgttccaaatccaactaaaaaagcagaagctagagcggcagttaccaacagtgcaaattcaaaaattaaggatatcaacaataatacacaagcaacattagacgagagaaatgatgctatcgcacttgttaatagatcaaaagatgaagcaattcaaaatattaacactgcacaaggtaatgatgatgtcactgaagcacaaaataatggaacgaatacgatacaacaagtaccattaactccagtgaaaagacaaaatgcaatagcaactatcaatgctaaagcggatgaacaaaaacgtttaattcaagcaaacaataatgcaacgactgaagaaaaagctgatgcagagcgtaaagttaatgaagcagtcataactgcaaatcaaaatattaccaatgcaactactaatagagatgttgatcaagcacaaacaactggaagtggtatcatatctgctattagtcctgcaacgaagattaaagaggatgcacgtgcagcagtagaagctaaagctattgcacaaaatcaacaaattaattcaaataatatggcaacaactgaagaaaaggaggatgcattaaatcaagtagaagcacataagcaggccgcaatagcaactatcaatcaagcgcagtcaactcagcaagtttctgaagctaagaataatggcataaatactattaatcaagatcaacctaacgcagttaagaaaaataatacaaaaacaatattagaacaaaaaggaaacgagaaaaagtcagcaatagctcaaacacctgatgctaccactgaagagaaacaagaagctgtcagtgctgtttcgcaagctgttaccaatggcattacccatatcaaccaagcaaattctaatgatgatgttgatcaagaacttagtaatgcagaacaaattattactcatactaatgtcaatgttcaaaaaaaacctcaagccagacaagcattgattgctaaaacaaatgaaaagcagagtgcgattaattctgataatgaaggcactatagaagaaaaacaaaaagcaattcaaagtttgaatgatgctaaaaatttagctgatgaacaaattacacaggctgcttctaatcaaaatgtcgacaacgccttaaatataggtataagtaatatcagtaaaatacagactaatttcactaaaaagcaacaagctagagaccaagtaaatcaaaagttccaagaaaaagaagctgagttaaattcaacacctcatgcaactcaagatgaaaaacaagatgcgttaactagattaacacaagcaaaggaaactgcactcaacgacataaatcaagcacaaacaaatcaaaatgtggatacagcacttactagtggaattcaaaatattcaaaatacacaagttaatgttaggaaaaagcaagaagccaaaactacgattaatgatattgttcaacaacataaacaaagtatacaaaataatgatgatgctacaactgaagagaaggaagtcgcaaataatttagttaatgcatcacagcaaaatgtaattagtaagattgataatgctacaacgaataatcaaattgatggtattgtgagtgatggtagacaaagcataaatgcaattacacctgatacatcaattaaaagaaatgctaaaaatgatattgatattaaagcagctgataagaaaataaaaattcaaagaataaatgatgctacagatgaagaaattcaagaagcgaatcgtaaaattgaagaagctaagattgaagcaaaagataatattcaacgcaatagtactagagatcaagtaaatgaagcgaaaactaatggaataaataaaatagaaaatataacaccagcaactactgtgaaatctgaagctagacaagcagtacagaataaagcaaatgaacagattaatcatattcaaaacacgcctgatgcaactaatgaagaaaaacaagaggcaataaatagagtaagtgctgaattagcaagagttcaagcacaaataaatgcagaacatacaacccaaggtgtcaaaactatcaaagacgacgcgataacttctttatctcgaattaatgcacaagttgttgagaaagagtctgcaagaaatgcaatcgaacaaaaggcaacacaacaaacgcaatttattaataataatgataatgctacagatgaagaaaaagaggtcgccaacaatttagttatcgctacaaaacaaaaatcattagataatattaactccttatcttcaaataatgatgttgaaaatgctaaagtagcaggaataaatgaaatagctaacgttttaccagcaaccgctgttaagtcaaaagcaaaaaaagatattgatcaaaaactcgcgcaacagattaatcaaattcaaacgcatcaaactgctacaactgaggaaaaagaagcggctattcaattggcaaatcaaaaatcaaatgaagcaagaacagcaattcaaaatgaacatagtaacaatggtgtcgcacaagctaaatctaacggcattcatgaaattgaattagttatgccagatgcgcacaaaaaatctgatgctaaacaaagtatcgataataaatataatgagcaaagtaatactatcaacactacaccagatgcaacagatgaagaaaagcaaaaagcattagataaattaaaaatagctaaagatgcaggatacaacaaagttgatcaagcgcaaacaaaccaacaagtatctgatgcaaaaactgaggctatagatacgataactaatattcaagcaaatgttgcaaaaaaaccatccgctcgagtggaattagattcaaagtttgaggatttaaagcgtcaaatcaatgcaacgcccaatgctacagaagaagaaaaacaagatgcaattcaaagattgaatggtaaaagagatgaagttaagaatctaataaatcaagatagacgtgacaatgaagttgaacagcacaaaaatattggacttcaagaattagaaacgattcatgctaatccaactagaaaatctgatgcgctccaagagttacaaactaaatttatttcacaaacagagttaattaataataacaaagatgcaactaatgaagaaaaagatgaagccaaacgacttcttgagattagtaaaaataaaactataacaaatatcaatcaagcgcaaactaataatcaagttgataatgctaaagataacggcatgaatgagattgctaccataataccagcaacaacaattaaaacagatgcaaaaacggctattgataaaaaagctgagcaacaagttacaatcatcaatggtaacaacgatgcaacagatgaagaaaaagcagaggctagaaagctggttgaaaaagcgaaaattgaagccaaatctaatattacaaatagtgatactgaaagggaagtcaatggtgctaaaaccaatgggttagaaaaaataaacaatattcaaccatcaactcaaactaaaacaaatgctaagcaagaaataaatgacaaagctcaagaacaattaatccaaattaataacacgcctgatgcaaccgaagaagaaaagcaagaggcaacaaatagagtcaatgctggattagcacaagcaatacaaaatattaataatgcacatagtactcaagaagtaaatgaatctaaaacaaatagtattgctacaatcaagagtgtacaacccaatgtgatcaaaaaaccgactgctataaatagtttgactcaagaagctaataatcaaaagacgttaataggtaatgatggtaatgctactgatgatgaaaaagaggctgcaaagcaattagtgacccaaaaattaaatgaacaaattcaaaaaattcatgaaagtacacaagataatcaagttgataacgtaaaagcacaagctatcactgcaattaaattgattaatgcaaatgcacataaaagacaagatgccattaatattttgactaatctagctgaaagtaaaaaatcagatataagagccaatcaagatgcaactactgaagagaaaaatacggcaatacaatctatagatgatacgttagcacaagcacgtaacaatattaatggtgcaaatacaaatgcgttagtggatgagaatttagaagatggtaagcaaaagttacaacgtattgtgttgtcaactcaaactaaaacacaagctaaagcagacattgctcaagcaataggtcaacaaaggtcgacaatagaccagaatcaaaatgctacaacagaagaaaaacaagaagcccttgagagacttaatcaagaaacaaatggagtcaatgatagaatacaagcagctttagcaaatcaaaatgttacagacgaaaaaaataatatattagaaacaataagaaatgttgaacctattgtaattgtaaaaccaaaggctaatgaaataattagaaaaaaagctgcggaacaaacgactttaataaatcaaaatcaagatgcgacactagaagaaaaacaaatagcacttggcaaattagaagaagtaaagaatgaagcgttaaatcaagtatcacaggcacactcaaataatgatgtgaaaattgcggaaaataatggaattgctaaaatttctgaggtccatcctgagactataattaaacgtaatgctaaacaagaaattgaacaagatgcgcaaagtcaaattgatactatcaatgcaaataataaatcaactaatgaagaaaaatcagccgctatagatagagttaatgtagctaaaattgatgctattaacaatattactaatgctacaactacacaattagttaatgatgctaaaaatagtggtaacacgagtattagccaaatattaccaagtacagcagtcaaaactaatgcattagcagctctagctagcgaagctaaaaataaaaacgctataatagatcaaacaccaaatgcgacagcagaagaaaaagaagaagcaaataataaagttgatcgtcttcaagaagaagcagatgctaatatcctaaaagcgcacactactgatgaagttaataatattaaaaatcaagctgttcaaaatattaacgctgttcaagttgaagttatcaagaaacaaaacgttaaaaaccaattaaatcaattcattgataatcaaaagaaaattattgaaaatacgcctgatgcaacactagaagaaaaagctgaagctaatagattgcttcaaaatgtactaacttccacatcagatgaaattgctaatgtagatcataacaacgaggttgatcaagctttagataaagctagaccaaaaatcgaggaaattgtaccacaagttagtaagaaacgagatgttttaaatgcaatccaagaagcatttaattcacaaactcaagaaatacaagagaaccaagaagctacgaatgaagaaaaaactgaagcattaaataaaataaaccaattacttaatcaggctaaagtaaatattgatcaagcacagtcaaataaagatgtagatagtgcgaaaacacgtagtattcaagatatagagcaaattcaaccacatccacaaacaaaagcaaccgggcgtcacagattaaatgaaaaagctaaccaacaacaaagtactattgcaactcatcctaattcaacaattgaagaaagacaggaagcaagtgcaaaactacaagaagttcttaaaaaagccatagctaaaatagataaaggtcaaaccaatgatgatgtagaaaagactgtagtaaacggaatagctgaaattgaaaatatattacctgctactacagttaaagataaagctaaagctgatgtaaatgctgaaaaagagcagaaaaacctacaaattaatagtaatgatgaagcaacgactgaagaaaaattagttgctagtgacaatttaaatcacgttgtcgagacaacaaatcaagctattgaggatgcaccagataccaaccaagtgaatgtagaaaagaacaaaggtataggtacaattagagatattcaaccacttgtagttaaaaaacctactgccaaatctaaaattgaaagcgcagtagaaaaaaagaaaactgaaattaatcaaacacaaaatgcaactcatgatgaagtaagagagggtttaaatcagttaaatcaaattcatgaaaaagccaaaaatgatgtaaatcaatctcaaactaatcagcaagttgaaaatgctgagcaaaatagtttagatcaaatcaataacttcagaccagattttagtaaaaaacgtaatgcagtagctgaaattgttaaagcgcaacaaaacaaaattgatgaaatagagcaagaatttagtgctacacaagaggaaaaagacaatgctttacaacatttagatgaacaggttaaagaaatcattaattctataaatcaagctaatacagataatgaagtagataatgctaaaacttctgggttgaataacataactgaatacagaccagaatataataaaaagaaaaatgctatattaaaattatatgatgtttcagatactcaagaagctataattaatggttatcctgatgcaactgaagatgaacttcaagaagctaatagtaagttaaataaaatacttttagatgcaaaaaaacaaattggtcttgcgcacacaaataatgaagttgatgatatttataatgaagtttcccaaaaaatgaaaactattttaccacgtgtagatacaaaagcggtagcacgttctgtacttaatgcacttgctaaacaattgattaaaacttttgaaaatactgcagatgttactcacgaggaacgtaatgatgcgattaatcatgtaaaagaacaattatctttagtattcaatgccattgaaaaagaccgaaaagatatacaagttgcgcaagatgaattatttggattaaatgaattaaatagtatatttatcaacataactcaaaagccaactgccagaaaagcaattagtggtatggcgagtcaattaaacaactctatcaataatacgccatatgctacagaagaagaacgacaaattgcactgaataaagttaaggcgattgttgatgatgcaaatgaaaaaatacgagaagctaacactgatagcgaagtacttggaacaaaaacaaacgcaataacattgttacaagcaatcagtgcggatgtacaagttaaaccacaagcatttgaagaaatcaatgcacaagctgaaattcaaagagaacgaattaatggaaatagtgatgcgacaagagaagaaaaagaagaagctttaaaacaagttgatacattagtaaatcattcatttattacaattaataatgttaataaaaatcaagaagtttatgatactaaagacaaaacgattgaagctattcataaaatcaaaccaatatcaactatcaaaccacaagcattaaatgaaatcactattcaactagacactcaacgtgatttaataaagaataataaagagtctacagttgaagaaaaagcctcggctatcgataaattaattaaaactgcagcaagaatagccgaagcaatagataaagctcaaacaaatgaagaagttaaaaatattaaaaaacaaagtattgatgaaatttctaaaatactacctgttattgaaattaaatcagctgcaagaaatgaaattcatcaaaaagcagaagttattcgcggattaattaatgataatgaagaagcgactaaagaagaaaaagatatcgcattaaatcaattagacacaactctaacacaagcaaatgtttcaattgaccaagcattaacaaatgaagctgttaatagagctaaagaaatagcaaattctgaaattaataaaatttctgtcattgccattaaaaagcctgaagctatagcagaaattcaagaactagcagataaaaaattaaataaatttaaacaaagtcaagaagctactattgaagaaaagcaatcagctatcaatgaattagaacaagctttaaaatcagctattaatcatattcatcaatctcaaaataatgaatcagtgagcgctgcattaaaagaaagtatatctttaatagactcgattgaaattcaagcacataaaaaattagaagctaaagcatacattgatggatatagtgacgataaaattaatgacatatcttctagagcgactaacgaagaaaaacaaatatttgtaagtaaacttaaagcattaatcaatcgtacacataaacagattgacgaagctgaaacatttgtttcagttgaaacaattgtccgaaactttaaagttgaagcggataaattaaactcaattgtacgtaaaaaagctaaagcatcgaaggaaattgaattagaagcagaccatgtaaagcaaatgataaatgcaaatttaagtgctagtactagagtgaaacaaaatgctcgtacattgataaatgaaattgttagtaacgctttaagtcaacttaataaagtaaccacaaataaagaagttgatgaaatagttaacgaaacgattgaaaaacttaagtcaatacaaataagagaagataaaatattgagtagtcaacgttcatcaacatctatgacggaaaaatctaatcaatgttatagttccgagaataatacaattaaatctctaccagaggcaggaaatgctgataaatcactaccattagcaggagttactttaatatctggtttagcaatcatgtcctcacgtaaaaagaaaaaagataaaaaagtaaatgactaa

SEQ ID NO: 2171 - DNA, 201 bp, Staphylococcus epidermidis
cttatcatttatatcaaatcaacttttatgtttaaaattatcatgaaagttgtttttttacaaaaagccccaaatgattttaaatataaattcatttggggcgaagttattgtgataggtttttattattattatataatatcaattttacctcagagttcaattatatcaatgatttgtcctgacacagcatctgcataa

SEQ ID NO: 2172 - DNA, 177 bp, Staphylococcus epidermidis
aaaaaatttcttaatgatactattcgaatgatgtggttttcacaaattctaaacccttcttataaaatgattaatcgatatagagtaaatccaaaagtagatgttttattagaatccttatttattcaattccatagtcaatgtttgaatcaaaatcttataaatgataaagcttaa

SEQ ID NO: 2173 - DNA, 849 bp, Staphylococcus epidermidis
aggagagattatatggagacggttcaattttataacggaagaacaatgccgaaaatagggctcggaacttatagagtaaaagatggcgatgaatgtagagaatctgtaaaatatgctatcgaacggggttatagaagtatagatacggcaatgatttatggtaacgaagaaacggtaggtcaaggtattaaagaaggattagaatcgactggtttaagtcgtgaagatttatttataacttctaaattatggctaactgattttggacgtcaaaatgtggaagatgcctatcgacaatctgttgcaaaattaggactggattatttagatttatatctgatgcattggccaggtacaaatgaagcggtaatgattgatacttggagaggtatggaagacttgtataaacaaaatcaggtgaaaaatattggtgtgagcaattttactccagaacattttgaagcattgcttgcccaagtttctattaaaccggtcattaaccaagtagaatttcatccttatttaacacaaaataaattacgaaagtatttagaagctcaaaatattatcatggaatcatggtctccattaatgaattcacaaattctccatgatgaagtcataaatgaagtagctaatgaagtaggaaaaactccagcccaagttgtaataagatggaatattcagcacgatgttgttgttatacctaaatccgtaacaccacatcgcatagaagaaaatttagacgtatggaattttgaattaagcgacaaccaaatggaaagaatcgatcaattaaatcaagataaaagaattggacctaaccctcttgaatttgacggtaagtaa

SEQ ID NO: 2174 - DNA, 1332 bp, Staphylococcus epidermidis
aaagactgttataaagaaataagaggtaacgggatgacaaagaatgaacaaataattaaacatatcgaatctttatcaattggctctaaaatctctgtacgaaagattgctaaagatcttaatgtgtctgaaggtactgcgtatagagcaattaaagatgcgagtcaacttggaattgtagcaactattgacagagttggtactgttagaatcgagaaacgaagtagggaaaatttagataacttaacgtttaatgaaattgcaaatattgtcgagggccaaatacttgccggtagagctggacttaataaatcagtttcaaaatttgcgataggagcaatgcaatttgatgatattctgaaatatataggcaaacacacattattaattgttggaaatagagaaaatgtacagattgaagctttaaaacgtgaaacttcaatactcatcacaggtggttttcgtccaagtgctgaaattatacgttatgcagatgagcatgaattaccaattatttcttcaagttatgatacattcttagttgctaatatcatcaataaagcaatgtttaatcaaaaaatacgcaaagaaatacttgtggttgaggatatagttaaaccaatcaatgaactatcagtgttatttgattcaatgacaatacatgattacaaaaaaatagcgaatgaaaccggccatacaaggtttcctatagtaaacgaagaatttaaattagtaggtatagtaactagtagagaaatcattaatatgaacgaagaagacctattaggtaaagttatgactaaaaatccattgagtgttaaattaacaaatacggttgctagttgtgcccatttattaatttgggaagggattgaattattaccagtaactgataataataaaaaagctgtcggtgtgattaacagacaggatgttttaaaatcaatgcaattattaggtagacaacctcaaattggtgaaacagtcaatgatcaaattgccaaacatatttcaatacatcaacaaggaataaatgtcgacgtatctccactcattacaaatcattacggtacactaagtaaagcagtatttgttggaattattgaggaaacgattcggcacgaaatgagaaagtataaaaaaggtaatgtcatgatagaaagtatgagtattatctatattaagactgtaccaattgaatctactattgaagtacattatgaaatgttagatgttggccgatattttgctaaattagaagttactatgattaataatggtgaaaaagttgctaatgcattagtaatttgtcaaatgtttgatggattttaa

SEQ ID NO: 2175 - DNA, 219 bp, Staphylococcus epidermidis
ttgtcaattcttacaatacgtaacgtttcttcttctctatcaaacttgaattctacgtctaaatgttttaaacgcgctttcaatttatctctcatttggaagacattcattattaacactccctattttcgcacctttttacagtttacaataaataatgttgagttaacagaaaaaactcagataatcacattaatttgttattataaattaatgtag

SEQ ID NO: 2176 - DNA, 1161 bp, Staphylococcus epidermidis
aacattttctatttaaagggagtgtatatgatgcataccatattattagtagtttttatgataattttaggagcaataattggtggagtaactaatatgattgcaattaaaatgttatttcatccatttaaaccgtattatatttttaggtttcgtattccattcacaccaggtttgatcccaaaacgtcgtgaggaaatcgccagaaaaattggacaagttattgaggaacatcttattactgaagaactaattcgacagaagttaaatcaaccgcaatcgagaaatatgatacagcaattaatccataaacaaataagtaaattaaaaaatgatgatgtgacaataaaaaaaatagctggatttttagggatagatgttaatgagttggtagattataaattgactactaaatttctaaataaactaaacttttggtatgagtcaaataaatatagaaagttaagtgaaatattacctcagtctttcttagatcaatgtaaaggtcaaatagaatatattactgacttcctatgtgaaagggctagaaattatttaagttctgaaaaaggtgaacgtgatatttatgaaatgttagacacatttttcaatgaaaagggacgcatcattggtttactacaaatgtttatgacaaaagaaagcattgctgacagaattcaacatgagttgattagactaactcaacatcctcaatctcaaaaaataattactaaagtattaaatgatgagtatgaaacatttaaagataagaacttagatgagatcattaaagaacaacaatttaaaaattatagtcaattagtacttaatgaattaaaaacttatttaaatctaaaagataaaacagagagacctatcaaacaagttgttccgcagtttattcaattcctagaagatgatacatcaaaacgtatgactgattttattattaaaggtacttcaaaacatttaacaaacattatgaaaaagattaatttacgtcaattagttgaagaacagattaatacatttgacttaaagtatattgaaaatctaattattgatattgccaacaaagaattaaaattaatcatgacattagggtttatattaggaggtatcattggatttttccaaggagtgattgcaatctttgtctaa

SEQ ID NO: 2177 - DNA, 747 bp, Staphylococcus epidermidis
ggaggaattctaatgagaaaattatttctatcaattttatctattataataatttcaagtttttgtgttgcaacagggtttcaaaacgttaatgctgcaaataatgaggtgagcaaacctcaaagtaatgtggatagtaaaactaaacaaaatattattaaaaaaataaaaaaatctaatgcttataaaaagcacgctaattcaacttctattgactcaataaaagatgacgatattattgttcatttggataaaggtaaaaacaccaatgtatattctattaactatgtatttggtaaaaaattagctaaaatgaatgataaccttgcaatgattgaattaaaatataacgaagcaaacaatgaagttttctacaatcatatgatgtattcaaaatttgttaaatataataataaagaatatattaatatgaaaggcattttaaatggcaaaccttattatgaatttaatatagatcagaaaggtcattactacgataaaaactttaaacatacctctaaagatgaaatcgaaaaagattctgctaaaaacttaccacctaaagagcgtggttggtgtgaatgggcagtaggagctttatgtggtaccggtggagctgcaggttgttgggcaactgctacagctttaggtattactactggttggggaggcttttcattagctacaatttgtggtctgataagctctctaggctgtactggtgcaaccaactatatttgtaaataa

SEQ ID NO: 2178 - DNA, 150 bp, Staphylococcus epidermidis
agtatagtatatgactggtcacgtatgcttttcatatacttaactagggtggtaccacgacaaactcgtcccttgctagggacgagtttttttatgctcagtaaagttaatttattcaataagccaacgatcagatgttttattaaatag

SEQ ID NO: 2179 - DNA, 159 bp, Staphylococcus epidermidis
attaaccctctccattttaaatcttctattaaagcattagccattgataaaatcctcctaaattattttataaatttaaaaaagttaaagatatttaataaatatagtgatataagtgatttattcaaacatattaaaaagcgcccctacaaaatgtaa

SEQ ID NO: 2180 - DNA, 1254 bp, Staphylococcus epidermidis
acaatcttgtacattttttcaattaactttgcagatattctaaggagaatcaaacttatggttaaatttatacactgtgctgatttgcatttggacagtcctttcaaatctaaaagttatcttagtccaaatatttttgaagatgtccaaaagagtgcatatgaaagttttaaaaacatagtcgacttagctttaaaacaggaagtcgattttattattatagcaggtgatttatttgatagtgagaatcgtacattgcgtgctgaagtctttttaaatgaacaatttgaaagattaagaaaagaacaaatatttgtttatatttgccatggcaaccacgatcctcttacttctaaaataacaagtcagtggcctaataacgtatccgtattttcaaatcaagtagagacatatcaagctatcactaaatcaggagaaacaatttatattcatggattcagctatcaaaatgatgcgagttatgaaaataaaatagacgcatacccatcaagtcaaggtcagaagggcatacatattggtgtattacatggaacttatagtaaatcttcggtgaaagaccgttatactgaatttaggttagaagacttaaatcaacgtttataccactactgggcattaggacatatacaccaacgtgaacagttaagtgacatgccagtcattaactatccaggtaatatccaaggaagacatttcaatgaattaggagaaaaaggttgtctattggtcgaaggtgatcatcttaaactcactacacaattttatcctactcaatttattaaatttgaagaagctacaattgaaactgatcatacatctaaacaaggactttatgatgttattcaatcttttaaagataaagtaagaactgaagggaaatcattttatagattgaacgtacgcattaatagtgaagacattattgcaccacaagatttaattcaattaaaagaaatgattactgagttcgaagaaaacgaaaatcaatttgtttttattgaagatttaaatcttcaatatgttcaaaatgacgaaatgccaatagttaaagagttttcaccagaattacttgatgatgcgtcactttttgattcggcaatgactgatttatatcttaatccaagggcttctaagtttttagatgactataatgaatttgataaagttgagttagtcaatcatgcagaaagacttttaaaggatgaaatgagaggtgaacaaaatgataattaa

SEQ ID NO: 2181 - DNA, 306 bp, Staphylococcus epidermidis
aaagtagcgtataagacaatgcaacttaaatacaatgaaataaataagaaccaactcatttcgtctgaaacaccgtttctagaaaactttcaagattgtataaaaattaataaaaagaacaaaatatcacaatcaactttaaactgttattataatgcattaaatatctttgatgaaaagtttggcaatacagctattaaaaatttttcacaacttaaatatagcgaaatgttaaaagagtatgcagaaggtcacattattggtggacataaaaaagacatacgaaagcaagtgttcaaaaattaa

SEQ ID NO: 2182 - DNA, 1707 bp, Staphylococcus epidermidis
gaggagaagtatatggtgttatttatcatattagcaatattagtagttattttaattgctattggcgtattgttttatatgcgctcaaacaaaagaaatttaattgaaaaaacagaagagcgtaagaacgaaattgaacaattacctttagatgataacctaagaaaacttactggtttaaatttaaaaggtgaaacaaagactaagtatgatgcaatgaaaaaagacaacacagaaactacaaataaatacttagctccagtggaagaaaaaattcaaaatgctgaagagttgttagagaaatttaaattcacggcagcacaaactgaaattgatgatgctcacgaattaatggatcaatacgaagagaattatcagcatcaagtaactcaagtggacgacattataaacttacataaagaaaatgaagcattgtatgaaaagtgtaaagttgactatcgtgaaatgaaacgtgatgtattagccaatcgtcatcaatttggtgaagcagctgaaccacttgaaaatgaaatcgaaaattatgagcccaagttaaatgaatatgagaatttaaaaagtgaaggtaattatgttcaagctcataatcacattgctgctttagaagatcaaattaaaaatttaaaatcttatatggatgaaattccagaattaattcgagaaactcaaaaagaattaccaggacagtttcaagatttaaaatatggatgtagagacttaaaggttgaaggctatgatttagaccatgtcaaagtcgatggtacaatacaaagtcttaagacagaattaagttttgttgaaccaatgattagtcgattagaattagatgaagctaataataaacttgaaaatattaatgataaattagatgaaatgtatgatcttattgaatatgaagtaaaagccaaaaatgaagttgaagaaacgaaagatatcattactgatgacttatttaaggccaaagatatgaactatacattacaaaccgaaattgaatatgttcgtgaaaactactatattaatgaatcagatgctcaaagtgtaagacaatttgaaaatgaaattcaaagtctcatctcagtttatgatgatattttaaaagaaacttctaaatctgcggtacgttacagtgaagtacaagataatttacagtaccttgaagatcatgtatctgtgattaacaaagaacaagataaacttcaaaatcatcttatccaattacgcgaagatgaagctgaagcagaagataatttattgagagtgcaatctaagaaagaagaagtttatcgacgtttattagcttctaatttaactagcgtcccagaacgttttattatcatgaaaaatgaaattgataatgaagtaagagaagtaaatgaacaatttagagaacgtccaattcatgttaaacaactaaaggataaagtagcaaaaattgttattcaaatgaatacatttgaagatgaagctaacgatgtacttgtaaatgctgtatacgcagaaaagcttattcaatatggtaatagataccgtaaggaccatcatcatgttgataaaagcttaaatgaagctgaacgattatttaaaaataaccgatataaacgtgcgatagagatagctgaagaagcattagaaagtgttgaacctggtattaccaaacatattgaagagcaagtgattaaagaatag

SEQ ID NO: 2183 - DNA, 126 bp, Staphylococcus epidermidis
cccacgtggtattggggcatactcttaggtaaccgatttacaattgtaaaatcaggattccctgagatggtcatcatttggcttaagtcttttctaacaattgatactatttcttcatcggtgtga

SEQ ID NO: 2184 - DNA, 1113 bp, Staphylococcus epidermidis
aaactatatcttattagcatagaattaatatatcatcacatgatggaggttcattatatgactaaaataaaagaaatcaaaaaagttttacaaaaagaagatgctgatgcagcatggattacgacacccttaaacatcttttactttactgggtatcgaagtgagccacatgaaagactcttcgctttgcttattccatcaaatgaagagcctgttttattttgtccaaaaatggaagttgaagaagtaaaacaatcaccgtttaaaggtaaaatcatcggttatttagatactgaaaacccattcgacaaatactctaaaactttctctaaaatgctcattgaaagtgaacatcttacagttaaacgtcaaagagaactaacaaaagcctttaatatagaacactatcaagatgttgatcaatcaatcaaggacttacgcaatatcaaatcagaagatgaaattatcaatataaaaaaagcagctgcgttagctgataaatgtattgaaattggtaaatcctttcttaaagaaggtgttgaagaaagagaagttgtcaaccatatcgaaaacgaaataaaaaaatatggtgttaatgaaatgagtttcgacacgatggtactcttcggtgaccatgctgcttcaccacatggaacacccggtgacagaaaattacagcaaaatgagtttgtactatttgatttaggtgttgtataccatcattattgcagtgatatgacacgcacaattcattttggcacacctaataaggaagcacaaaatatatataacattgttttaaaagcagaaacagaagcaattaaatctattaaaccaggagttaccatcaaagatattgataaaattgctagagatatcatcgaagaagcaggttatggtgattacttcccacatagactaggtcatggattaggtcttgaagaacacgaatatcaagatatatcaagtgtaaataataatcaacttgaagcaggcatggtgattactatagagcctggcatatatgtccctcatgtggctggtattagaattgaagatgatattttagtaactgaaaatggttatgaaatattaactcaatacgaaaaataa

SEQ ID NO: 2185 - DNA, 366 bp, Staphylococcus epidermidis
atgcaatatctatatatttttgtaggtggtgctttaggtgcattgataagattctgtttatcaatgcttaatgaaggttcaaccattccgttggggacatttgttgcaaatttattaggtgcttttttaatgggtagtatcggcgcattaagcctttcactttttaaaactcatcctaacataaaaaaagggcttactactggtttacttggtgcgttaactaccttttcaacatttcaatttgaacttgtaacactatttaatcagcatcattttatactatttactatatatggtgtgacgagttatattctaggaatactaagctgttacctcggtgtcaaaataggaggtagattttcttga

SEQ ID NO: 2186 - DNA, 210 bp, Staphylococcus epidermidis
ttttatcatctatattattctaaatctagtagtataaaaatttatcttaatatatttttaaatgatatcagaatttgttttttgagatccacattgaattatttaatgatttttatatcaaaaaaagtacgactaagatttcaaataaaaatcttaatcgtactcagtgaccacatttgtgatttacagtgtaattccagaatttactag

SEQ ID NO: 2187 - DNA, 1161 bp, Staphylococcus epidermidis
aagccatttcataaagaaacagtaaaggggaaatttatcatggcagaattaaaaagaggtttagaaggggttattgcagctgaaactaaaattagctcgataattgacagtcagttaacatatgcgggctatgatattgacgatctcgcagaaaacgcgcaatttgaagaaataatttttttactatggaattatagacttcctaatgaaaatgagttaagtgaattaaaagaaaaattatttgattatatgactcttaataatagagtatacaagcactttgaggagtatgtgacggatcatgtacatccaatgactgctctacgtacatcagtatcatatgtagctcattttgatccagaagcggaaaatgaatctgatgagaataaatatgatagagctattcgtattcaagctaaaatcgcttctttagtaacggctttcgctagagttagagacggtaaagaacctgtcaaacctaattctgaacttagttatgcagcaaatttcttatatatgttaaggggagaactaccaacagaagttgaagttgaagcatttaataaggcattaattttacatgctgatcatgaacttaacgcatctgcatttacggcacgttgcgcagtatcttcattatcagatatgtattcaggtgttgttgcagctattggttcattaaaaggaccattacatggtggtgcaaatgaacgagtgatgtcaatgcttaaagaaataggaagcattgataatgtagatcactatttagatgaaagatttgcaaataaagataaaattatgggctttggtcatcgtgtttataaagatggtgatccaagagctaaatatttaagagaaatgagccgtaaaatcactgaagaaacagggcaaagtgaactgtttgaaatgtcattagccattgagaagagaatgaaagaagaaaaaggacttattcctaatgtcgatttctttagtgctacagtctatcatagtatgaatattccacatgacttattcacaccaatatttgcagtaagtcgtacttctggttggattgctcatattttagagcaatatcgagacaatagaattatgcgaccaagagctaaatatataggtgaacaaaatcgtaaatatgtgtctattgaagaaagaccataa

SEQ ID NO: 2188 - DNA, 135 bp, Staphylococcus epidermidis
aatagcattcaatatgtttggtttgctataattatattaatacagaacatattaaaaggggcaattagaaaatgtggaagtgggaaacagaaaatgacgcaaaaggcgttgttgtcattgctcataatattttag

SEQ ID NO: 2189 - DNA, 1725 bp, Staphylococcus epidermidis
tatctaattcaaagtatgttgtcaattttatacattgtcactatttctattttaaagtggataaattcaatcggtatgttatactatctaaatgtaagggcttacataaattatcgtatggagggattgggtatgtctatagatacatacacagaaacacttaagataaatcagctaatagaaaaagctacatcacattttcaactatcatcaacacaattatacaaaaaaattttaaaaaatcatgagggtgagttaactgaactgggggcaataaatgttaaaacaggtaagtacactggtcgttcacctaaagataaatttatagtcactgaaccatcgtataaggataatataaattggggagatatcaatcagcccatggatgaagaaacatttctaaaactttacaataaagtactcgattatttaaatcagaaagaggaactttacatatttagtggatatgcagggagcgataaagagtcacgtcttaaacttaaggtgataaatgaattagcttggcataatttatttgctcgtaacatgtttattcgtccagaatctatagatgaagctcaaaatataaaacccaacttcacaattgtttcagcacctcactttaaagctaatcccaaattagatgggacacatagtgaaacatttgtcattatatcttttaaacataaagtgattttaattggtggcacagaatatgctggtgaaatgaaaaaaggtattttctctgtaatgaactatttgcttccaatgcaggatatcatgagtatgcattgttcagctaatgttggagaaaaaggagatgtagcactattctttggattatcaggaactggtaagacgacgctttctgccgatccaaaacgtaagttaattggtgacgatgaacatggttggaataaaaatggcgtttttaatattgagggtggatgttatgcaaaagcaattcatttatctaaacagaaagagcctcaaatttataatgctattaaatacggaacaatattagaaaacacagttacaaatgatgacggtacggtagattttgatgataacacctatactgaaaacactcgcgccgcctaccctattgactatatagagaatattgttacaccttcaaaggcagcacatccgaatacgattattttcttaaccgctgatgcatttggagttatccctcctatttctaagctaactaaagatcaagcaatgtatcatttcttaagtggattcacgtctaaactagctggaacagaacgtggtgttactgaacctcaaccttcgttttcaacttgctttggtgcaccattcttacctttaagtccaacaaagtacgctgatttacttggaaatttaatcgatattcatgatgtagatgtatatctagtaaatactggatggacaggtggtaaatatggtatagggcgaagaattagtctacactatactcgtgaaatggtagatcaagctatatcaggtaaattaaaaaatactaaatatattaaagatgatacatttggcttaaatattccagttcagattgacagtatacctacaactattctgaatcctatcaatgcttggaacaataaagataactacaaagcacaagcttacgatttgattcaacgctttaataataactttaaaaaattcggcaaggaagttgaacatattgccaacaaaggtgcatttaatcaataa

SEQ ID NO: 2190 - DNA, 162 bp, Staphylococcus epidermidis
ttcaaaattcaaatctttaattacaggtttttttccatatccccctgtaagatgttcaacttttactgtcataaggcacctccattgactttattgtatcaaaaaaaattatatagacctaaaaataatctttacaatgatgtagttttaaaaaatgaatga

SEQ ID NO: 2191 - DNA, 993 bp, Staphylococcus epidermidis
aggagctatcaacttatgaaattaatgaataaaattatcgtacctgtaacagcaagtgcacttttgttaggtgcctgtggttcaaatgcaactgaatcgaaggataacacacttatttcttctaaagctggtgatgttaaagttgctgacgtaatgaaaaaaatgggcaaagaacaaattgctaacacatcttttagcattgtattaaacaaagttttagcagataaatataaagataaagtagatacaaaagatattgataaagatattaaaaaagaagagaaacaatacggcggtaaagatcaatttgaaagcatgttaaaacaacaaggtatgtcacttgatgattataaagaacagaagaaattatcagcttatcagaaacaattgttactagataaagttaatgtatcagataaagaaatcaaagaaaactctaaaaaaacatcacacattttaattaaagttaaatctaaatctagcgataaagaaggtttatcagataaaaaagcgaaagaaaaagctgaaaaaattcaaaaagaagtggaaaagaatccaaataagtttggagaaatagcaaaaaaagaatcaatggacagttcttcagctaagaaagatggttcattaggttatgtgattaaaggtcaaatggtagatagcttcgaaaaagcactatttaaattaaaagaaggagaagtttctaaagtcgtaaaaacagactatggctatcacattataaaagcagataaagaaactgattttaatagtgaaaaatcaaatatcaaacaaaaattaatcgaagaaaaggtacagaagaaacctaaattattaactgatgcatacaaagaattattaaaagagtataaagtagactacaaagatagagatattaaaaaagcaattgaggattctattcttgatccagataaaatcaaacaacaacagcaacaacaatcacaaggtggttctggattaactaattcaggttcttaa

SEQ ID NO: 2192 - DNA, 1371 bp, Staphylococcus epidermidis
gggagttgtcttatggctgagaatttacaaagagaattgagcaatagacatgttcaattaattgccatcggaggtgctataggaactggtctgttcctaggtgccggacaaactatcgcaatgactggtccctcaatattacttacttatattattatagggttcatgttatttatgttcatgcgtggattgggagaaattattattcaaaatacgaatttcaaatcttttgctgacgtgaccaacacatatataggaccgttcgcaggatttgtaacgggttggacttactggctatgttggattattactggtatggctgaagtgactgcagttgccaaatatataagtttttggttcccagacatacctaattggattagtgctttattctgtgtacttattctaatgtctttcaatttattaagtgcaaagttgtttggtgagcttgaattctggttcgcaatcattaaaatagttacaatcattgctttaatcgttataggtgtaatcatgattttattcgcattcaagacaccatttggtaacacaagtttaactcatttgtatcaacatggaatttttccaaaaggagcttctggattctttatgtcattccaaatggcattgttctcatttgttggtattgaaatgattggtgttactgccaggagaaaccaaagatccagaaaaactatacctaaagctatcaatagtgtacctattagaattttaatcttttatgttggtgcattagcagtcatcatgtccattattccatgggataaagtagatccagataatagtccattcgttagattgtttgcattaattggtataccgtttgcagcaggaataattaatttcgttgttttaacagctgctgcctcttcatgtaacagtggtattttctcaaacagcagaatgctttatggactttcaaaccaaaatcaagcaccaccaacatttgctagtactaataaacatggtgtgccacataaagcaatcattgcatcatcagctttattgttaattgcagcactactgaattacatattccctgatgcaacacttgtatttacttatgttactacgatttctacagtattatttgttgtggtttgggcattaattattattgcttatattaactatagtcgtaaaaatccagaacttcataagaaagcgacatataaactaccaggcggtcaatacatgggataccttatacttattttctttgtttttgtatttgccttgttatttataaatgttgatacaagaagagcgatttactgcacgcctatttggtttattttattaggtttaatgtacttaagatacaaaaaagctgataaagaatcacgataa

SEQ ID NO: 2193 - DNA, 252 bp, Staphylococcus epidermidis
ccgcttgaccaaggagccatggctccacaggtaggattcgaacctacgaccgatcggttaacagccgatagctctaccactgagctactgtggataaataaaatggagcgggtgatgggaatcgaacccacaacatcagcttggaaggctgaggttttgccattaaactacacccgcttaatgaaatacgattatggggcggttgaagggaatcgaaccctcgagtgtcggaaccacaatccgatgcgttaa

SEQ ID NO: 2194 - DNA, 132 bp, Staphylococcus epidermidis
actggaggccaaatcaataataaaataatcgctaaaattgtacaaaagaatgctgtcatgattggaacaagtcgtttcccactgaagaatgataaggccataggtaaattcgtttcactaaatttgttataa

SEQ ID NO: 2195 - DNA, 132 bp, Staphylococcus epidermidis
acattattacaatatactatcatatttattaaacttaaacatagtaattttcattccattttaaacagtatatttaaaattaaagcaaataattcgcttacatttcaaggtcatgttataaataagttataa

SEQ ID NO: 2196 - DNA, 1371 bp, Staphylococcus epidermidis
atggggttacaaacctatgaatatggtctaaaaccacaagatggatttgaggtgattacacatttcgaattcacctcacaacatttagatattttaaatcgactattcacccctttaatcggagttgaatcaattggactctatcattttatgagtcaattcatagatgaaagtcaacaactcgggttaacgcattatatattcatgaatgaactaaaaattaacttattagatttcagggagcaaatggacaatttagaggctattggattgattaaaacatttgtaaggcatgaaaaaaagtactctcactttgtttatgagttaattcagcctccaacagcctatcaattttttaatgatcctatgttatcagtatttttatttagtgaggttgataaaaaacgttatcaagcacttaaatcttatttcgaaaaagatgagaaagatttaagcaaatatcaacagacaactagaaaatttacagaagtattcaacgtacctaaaaaggtcaatgtttctgatcaaattaatttaaagcaaatcaaacactatgatggtatagatttatctaatgaaacttttgattttgaaatgttgagacagatgttgaaccatcattttattagtaatgaaattatcgataaagaagctaagaatttgattatacaacttgcgacactttatggaattactgaagatggtatgaaaaatgttatattaagttccattaccagtgcacaacaattatcttttgaagaaatgcgtaagaaagctagaacttattacctgattgaacatgataatcaattaccaaaattagagcatcaaacaaataaaattaacgatgaaaaaaaagatcgacaagcggaagatacaacaaatgattggttacaactgctagatgaaacaagtccgattgatatgttagcaagttggtctgattcggaacctacacagtcgcaaaaaagtatgatagaagaattgattaaccgtgaaaaaatgaattttggtgtaatcaatatacttttacagtttgttatgttaaaagaagatatgaagttgccaaaatcttatatttttgaaattgcttccaactggaagaaaattggtatttcaaatgccaaacaagcatatgaatatgcattacaagttaatcaacctaaaaattacgaaacacattctaatgataaacgacagaacaatcgtggaagacaaaatcaatttttatccaaagaaaagacacctaaatggcttcaaaatagggacgatcaagaagaaaataaagaaataaatgatgacactctcgaagaagatcgacaagcatttcttgaaaagttaaatcaaaagtggaaggaggaagataactaa

SEQ ID NO: 2197 - DNA, 525 bp, Staphylococcus epidermidis
acacctgcacaaaaagaagatgaaaagtttatgagcatagaaaattttgtaaatttaaagaagtatgtatctgatccccctattcaatcatatgtatttgtttatattttaatcgtcactggaggtcgctttggagaagttcaaaaactaagtagaagtgatttagattataaaaataatacaatacacttaccaggaacgaaaacagaaacttcagatagaactgtagatatacctgctgcagatatgaatatgttaagaaaaacattatctaaaatgccagtgagtttatcaaatcaattattcagtacaggtgtaggattgattacacacaatgctgtatctaaagtgttacaaaaattttgtttagaaaataaaataggtaaatatactttgcatagtataagacacacgcattgttcttatttactactcaatgacgtatctatctattacacttcaaagagattaggttacaaaaatattaaaactactatggatgcatatttcgcatctattagatga

SEQ ID NO: 2198 - DNA, 201 bp, Staphylococcus epidermidis
agaataaaacagccacaagtattgcaacaattaagccaattactgtcggtgaagaaaaatccattaaaacaacgctcctttatcagtttcaataactctaattataatagaaaaaaggcttattttcgacatatattttataattatttattttctattttacaagtcattgaatttcaacagcatcttttaaaacattga

SEQ ID NO: 2199 - DNA, 165 bp, Staphylococcus epidermidis
tttgaattgcaacatctaaaaattaatttactttcaatgattgtactattgttctacatatttactagtaaatcgtgtatatttaaaatgattcagttttcttttcatggattgacttatgtattgaatatatatagttcaatgacttctcataaaataaaatag

SEQ ID NO: 2200 - DNA, 132 bp, Staphylococcus epidermidis
aagtattttaatgtaaaattacatatgaatacaaagtattttggcgagactcttgagggaacaggacaagctgaagactacaggctgaagctgtcccctaagaaagcgagccaacaatacgaagtattgtaa

SEQ ID NO: 2201 - DNA, 129 bp, Staphylococcus epidermidis
aaatttattaaaatacgccatataccgactctaaaagaaaaaattataaaaacaattccccctattaaaatggaggaattgttttgtttaataggtttggatgacagactcatttatatatgtgattga

SEQ ID NO: 2202 - DNA, 1239 bp, Staphylococcus epidermidis
ggagctgttaaagtaatgcaatatgatcatttattagttagatatggagagcttacgcttaaaggtacgaatagaaaaatgtttgttaatcaacttaaagataatgtgaaacgcgcgcttattccattaagtggttatcatgtcaaaggaaagagggatagaatgtacatagaattatcccctgaagcagacataaatgaaatcattcaacgcttatctaaagtttatggtataaaatcaattagtccagttataaaaattgataaaaacgaagagaaaattaatcaatcagcaatacagttatctcatgactttgaaaaaggttcaacttttaaggttgatgtaaaacgcgttgacaagtcatttcgattggatacgtacgaattgcaacgtcaagtcggtggagcaatactaaaaaaaaataataatataacagtgaatgttaaaaatcctgactatgaaattaaaatagaagtaagaatggatgctatttatatttatgaaaaagtaatcgctggtgcaggtggactgccagtcggtacaggtggtaagacattacttatgttaagtggtggtattgattctcctgtagcgggaatagaagtaatgaaacgtggtgtaactgttgaagcaatacattttcatagtccaccgtttacgagcgaaaaagctaaagataaagttatcgaattaacaagaattctagcggaacgtgttggtcctatcaaattgcatctcgtgccatttacagaaatacaaaagcaaattaataaagttgtacatcctcgttatacgatgacttctacaagaagaatgatgatgcgtatatctgataaagttgtacatcaaataaatgctaatgctatcgtaaatggagagaatcttggtcaagtagcaagtcagacgctaaagagtatgtacgctattaatcatgttacagctacacctgttttaagacctctattaacgttagataaagaagacattattaagaaagcgaaagaacttggtacatttgaaacatctattcaaccctatgaagattgttgtacaatatttactccgaaaaatcctgtaactgaaccggactttgacaaagtaataaaatatgaaagtgtatttaattttgatgaaatgatagaaaatgcagttgaaaatattgaaacattaacaatagatcaaaattataaaagtgcgaaagaacaatctacagattcattgattaaagatttattctaa

SEQ ID NO: 2203 - DNA, 1038 bp, Staphylococcus epidermidis
tggaacgttaaaaaaatttatggtaatttagagttgaagataaatctagttaaggaaaggtatgtcgtcatgaagaagattgcagttttaactagcggaggagattctccgggtatgaacgctgctgttcgtgcagtgactcggacagcaatttacaataatattgaagtttatggtgtttatcaaggttaccaaggtttacttgatgatgatattcataagcttgaattgggttcagtaggggatacaattcaacgaggaggaactttcctcttttccgcaaggtgccctcagttcaaagaagaggatgtacgtaagaaagctattgagaatttacgtaagcgtggtatcgaaggtttagttgttattggaggagatggcagctatagaggggcacaacgaattagtgaggaatgtaaagaaattcaaacaattggtattcctggtacaattgataatgatattaatggtacagattttacaattggttttgatactgcattaaacactattattgaatcagtcgataagattagagatacggcatcaagtcacgcaagaacgtttattgttgaagttatggggcgtgattgtggagatttagctttatgggctggattatctgtaggtgctgaaacgattgttttaccagaagtcaatacagatattaaggatgtagctgaaaagattgaacagggtattaaaagagggaaaaaacattctatcgttatggttgcagaaggttgtatgagcggccaagaatgtgcagatgagttaacgaagtatattaacattgatacacgagtttcagtgttaggtcacattcaacgtggcggtagcccatctggtgctgatcgagtattagcttctcgacttggtggatatgctgttgaactattaaaacaaggtgagacagctaaaggtgttggcattaggaataatcaattaacctctacgccgtttgatgaaatttttgctgaaagtgatcgcaaatttaatagtcaaatgtatgaattagcaaaagaattatcaatttaa

SEQ ID NO: 2204 - DNA, 387 bp, Staphylococcus epidermidis
ataagaactaatgacaatgctataatgattagcggttttaaaatatttgctggtatgtatgtcgcaatgatagcaccaccaccagaagcaacaaatattagtggaaacatctttcctactattttcaagtcaactttacctgaacgtaaaaattttaatgcacttgttaacgtactaaaagaactcgcaaatttatttgtacctaaagcaacagatggtggcaaaccaactgcaagtaatgcgggggttgaaattagtccacccccaccaactacagaatcgacgaatgaagcgataaaaccaaaggcaacaatcatcaacataatcgataaattccaatccatattaagcctaacccctttgtttttattacattacgaattttag

SEQ ID NO: 2205 - DNA, 1194 bp, Staphylococcus epidermidis
gaggaatataacatgcaattcgatacaattgagttggctatagaggctttaagaaatggagagagcattattgtagttgacgatgaagatagagaaaatgaaggagatcttgtagctgttacggaatggatggatgataataccattaattttatggctagagagggtcgtggtctgatttgtgcaccaattgataaatctatagctgaaagattaaaactacaatctatggagcaaaataacactgatatttatggcacacattttactgtaagcattgatcattataaaactactacaggaatcagtgcacatgaacgtacacaaacggctagagcactcatagatgaaaatactaatcctgaagattttcatcgtccggggcacttatttccacttatagcaaaagagaatggtgtgttaacacgtaatggtcatactgaagctgccgtagatttggcacggttaacaggagcacaaccagctggagtaatctgcgaaattatgaatgatgatgggacaatggctaagggtgaagatctccagtcatttaaagaacgccaccatttaaaaatgattactataaaaagtttggttgcttttcgtaaggctgttgaacttaatgttaatcttaaggcaaaggtcaagatgccaacagattttggtcattttgatatgtatggatttacaacggattatagcgatgaagaaatcgttgctattgttaaaggagatttaaaaagcaatcctaatgtacgtatgcattctgcttgtctgactggggatatttttcatagtcaaagatgtgattgcggggcacaacttgaagcgtcaatgaaatatattgacgaacatggtggaatgattatttatttacctcaagaaggtagaggaatagggttaattaataagttgcgcgcatatgagttgatagaaaaaggttatgatacagttactgcaaatcttgctcttggttttgatgaggatttgagagattatcatgttgcagctgaaatattaaagtattttgatataagtgaaattaacttgctcagcaataatcctaaaaaatttgaaggtttagaagattacggcattgagatcgtagatagaattgaacttatcgttccagaaacacaatataaccatagttatatggaaactaaaaaaaataaaatgggacatttaatatag

SEQ ID NO: 2206 - DNA, 417 bp, Staphylococcus epidermidis
tttatgtataaacatattctacttggggtagacactcaaattaaaaatgagaaagctcttaaagaggtgtctcgtttagctggtgaaggaactatcgtcacagttttaaatgccattaatgagcaagatgctcaagcgtcaatcagagctggcgtacatttagataagctaaccgaaaagcgttctaaaggtttagaaagtacacttaaaactctagaagactacggcattgattatgatgaagttattgtaagaggcaatgctaaggatgagctattaaaatttgcaaatagtggtaaatatgaaattattgttctaagtaaccgaaaagctgaagaaaataagaaatttgttttaggtagcgtaagtcataaagtagctaaacgtgctactattcctgttttaattgttaaataa

SEQ ID NO: 2207 - DNA, 150 bp, Staphylococcus epidermidis
aagttcctcctttttactcaaaaagtatttatgttgaaaagccaagttagcgtacaaataaaacacttatttttacatattaataaagtctatgactactatttaacacctattgcttcaattacgcaaatgattattttcaaacaataa

SEQ ID NO: 2208 - DNA, 888 bp, Staphylococcus epidermidis
agaaaggataatatcatgcctgaactacctgaagttgaacatgttaaaagaggtattgagccatttataaaaagtgcaaaaatagagaaagtaacttttgctaaaaatgtaattaacggtaagaataataaccgtgagacgattataaaaggtatggaattagatacttttaaaaaacttactgaaggttatgttataaaaaaagttgaaagaagaagtaagtacattattttttatatagcggatcatgacgatgatagaatcttagttagtcatttaggtatggcaggcggattctttgttgttaataaccttgatgagataagtacaccgaattatcgaaagcattggcaagtcattttcgatttggataataaacaaaaattagtctattctgatatcagacggtttggagaaattagaaatatagtcaattttgatagttatccatctttattagaaatcgctccagaaccatttgaagaggtggcatttgaacactatttagaatgtttgacaatgaaaaaatataagaataaaccaataaaacaaacgattcttgatcatcgtgttatagcaggagctggaaatatctatgcctgtgaagctttattcagagctggtattactccggataaaattactaattcactcactaaacaagaaagaaaatccctcttttattatgttcgagaagttttagaagagggtataaaatatggaggtactagtatttcagattataggcatgcagatggtaaaactggacaaatgcaattacatttaaatgtatataaacaaaaaaagtgcaaggtttgtggtcattcgattgaaacaaaagtgatagctggtagaaatagtcatttttgcccaaactgtcagagataa

SEQ ID NO: 2209 - DNA, 603 bp, Staphylococcus epidermidis
ataatacgtaacgaatattcacatagagaagaggcatatattatgtttttatgtactcggcaaatcgatatacatgcacggttcggtattcaaagaattgcatttttaagtttagttgcgacaatatttacatttttagttagttatgaagtgatgtattattttttagatacaccactctcagatagacatttttttgtacttatagtgtttatattgctcatgtaccctattcataaaatagtacatcttttattctttttgccttattataaatcttttaaaatccataaattatctagtaagaaatgggtaccatattttaatacttatgttaatacgcctgttcacaaaatttatttttgtattaatctcattctacccatctttttcctatctggtatatttataatgctaagtatatatttacctcaatatggacattattttatgtttttattatcacttaacataggctgttcaatgatggatattttatatttaaagatacttctattttcaaatgatggacattatgtcgaagaacatcaatcaggtcttcatattttaaacaaggtagacaatccttatatacaacactga

SEQ ID NO: 2210 - DNA, 147 bp, Staphylococcus epidermidis
tataaaagtaaaataatattaatatcattttacttttatatcacttgtctttatatctgtatcaataatgtaaaaagtggttacatacctttaagatatgcaaccactaatgtttatctatataaggtagcacatcacataaagtga

SEQ ID NO: 2211 - DNA, 636 bp, Staphylococcus epidermidis
aggagcatccttatgcataaagtcattctcgtcgatgatcactatattgtaaggcaaggtttagagtttttattatcaactgtagatgatttatcagttttaaagggttttaaagatggcgcaacatttttatcttatttaaaaaacaatgaaagaccggacatcgtgcttttagacttagtaatgccagagatgaatggtatagaaattactgaaatactcaaacaacaatatcctgaaatcaaagtattagtacttacgagctatgtagatgatgaacatgttatttcagctattgataaaggagctgatgggtatgaaatgaaagatgttgaacctcaaaagttaattgagacaattcataaagttttgcaaggtgaacgtatcatacatcctcaagctaaaagcgtgattaaggccgtatcaaaaaaaccgcattatacgaataagttatctaaacgtgaaaaagaagtgcttaaggaaatggttaaaggtaaaacaaataaagaaattgcaagagcattgtttgtatcagaaaagacagtaaaaacacatgtgagtcatatttttagcaaactagaagtctccgatagaactcaagccgctatttatgcaatggaaaataaattgatttaa

SEQ ID NO: 2212 - DNA, 198 bp, Staphylococcus epidermidis
gttcgaatcctacctgtggagccatggctccttggtcaagcggttaagacaccgccctttcacggcggtaacacgggttcgagtcccgtaggagtcatacaaacagaagtgaaatatcgcttctgtttttttattattatattctatcatggagagttgtccgagttggccgaaggagcacgcctggaaagtgtgtag

SEQ ID NO: 2213 - DNA, 1011 bp, Staphylococcus epidermidis
aacgtttacaaggaggaaattatgacagttacaatttatgatgtagcccgagaggctagggtatcaatggcaactgtttcacgtgtagtaaatggaaaccaaaatgttaaaccagaaacacgtaataaagtaaatgaagtcattaaaaggttaaactatcgacctaacgcagttgcaagaggtcttgcaagtaaacgtacaacgacagttggagttataattcccgatatttcaaatgtttattattctcaacttgcaagaggtttagaagatattgcaacaatgtacaaatatcactcaattatctcaaactcagataatgatccagaaaaagaaaaagaaatttttaataatttattaagtaaacaagtcgatggtattattttcttaggtggaactatttctgaagaaattaaaagtcttattaatcaatcatctgtaccagtcgtagtttctggaacggatggtaaggatgatcatattgcatctgtaaatattgattttaaacaagcagccgaagaagcaacacaatatcttatagagaagggtgctaaaacattttctttaataggtggagaatactctataaaggcacaagatgatgttttagagggccttaaaaatgttttaagtcagcatcaactaaaattagacgatacattacatttaactggcaatgaaagttacaaatcaggtataaaaacatttgaacaattgcaatcgaatttaccagatgctgttctttgtattagtgatgagcaagcaataggtatattgcatagtgcacaagatgctggagtgaaagtacctgaagacttacagattattagttttaacaatacacgtttagtagaaatggtgagaccacagttatctagtgttattcaaccattgtatgatattggtgctgttggaatgagattactgactaaatacatgaacgatgaagaaattgaaaatcctaatgtcatattgcctcatagaatagaataccgtgggacaactcagtaa

SEQ ID NO: 2214 - DNA, 1428 bp, Staphylococcus epidermidis
tgtggtaacaagttagcctctacttatgaaggaaagggagcttctatgaaaaagaataataaacaaaatgacggtgttcaaagaggattaaaagatagacatatttcaatgattgccattgggggatgtataggaactggtctattcatgacttctggtggagctatacatgacgcaggtgcattgggtgctttgattgcctatgcagttattggagcgatggtgttctttctaatgacgtcgttaggggagatggcgacatatttgcctgtgtcaggttcatttagtacttatgctacacgctttgtcgatccttcactaggttttgctttaggatggaattattggttcaactgggtgataacagtagcagctgatgttactattgcagcgcaagttatacaatattggtcccctatgcaaggtataccagcttgggtctggagttgtattttccttattattattttcgcgcttaattctttatccgttagagtatatggagagagtgaatattggttcgcacttatcaaagtagttacagtcatcatatttataggaattggtatcttaactattttagggattatgggtggagaatttgtaggatttgatacgtttacaaaaggagatgggccaatactaggtgggaatttaggaggtagcttgctatcaattcttggtgtatttctagtcgcaggcttctcattccaaggaactgaacttattggtattacagcaggtgaatctgaaaatccagaaagagcagttccaaaagcgattaaacaagtattttggcgtatacttttattttacattctagctattttcattattggtatgttgattccatatgatagtaaggcattaatgggcggtggtgatagtatagctacttcaccttttacattagtatttaagaatgctggattagcttttgctgcttcatttatgaatgctgttatattaacaagtgtattatcagcaggtaactcaggaatgtatgcttcaacaagaatgttatattcgatgagtaaagataaattagcttataattcttttggaaaaacaaataaaagtggcgtaccttatgtatctctaattgcaactggagtactagtcattcttattttcgcattgcaacatttaagtggagatgcatatgaatacattgtagctgctagcggaatgactggttttattgcttgggttggtatagcaatcagtcactttagatttagacgcgcatttgataaacaaaattatgataaatcaaaattaaaatataaagcgaagttattcccatttggtccgatttttgcaggtattttatgtgtaatagttatcattggacaagatgtagattttattaaaacaggtaactttgatatgaatagattttttataacgtccatgggaataccttta

SEQ ID NO: 2215 - DNA, 882 bp, Staphylococcus epidermidis
tttaacaacaatgacctaagaggtgtgaatatgactaagcacaagaaaggctcaatattagctatcataggtttgctaattgtatttgttgttacaggttttatcttcttttcaatgatttcagatcaaatatttttcaaacatgtcaaaccagttgaaaaggttgaaaaattagataaaactttagataaagcatctaaaaagcaaatacacaattatacgagccaacaagtatctaacaaagcaaatacagcttggcgtgatgcgtctggtacagaaattaaagaagctatggatagtagtaaattcatagatgatgataaacaaaaatatcaatttttagatttgtctaagtatcaaggcattgataaaaacagaattaaacgcatgttgtttgatagaccagtactactaaaacatacagatgattttattaatgctgcaaagtctaaacatgtcaatgaagtatatcttatttctcatgctctattagaaacaggcgcagctaaaagtgaactggctaatggtgtagaaatagatggtaaaaaatattacaatttctatggtgttggtgcattagatagtgaccctattaaaacaggtgccgaatatgctaaaaaacatggatgggacacaccacaaaaagctatttatggtggcgctgattttattcataagcatttcttatctcatgacgatcaaaatacactttatagtatgagatggaaccctaaaaacccgggtgaacaccaatatgctactgatataaaatgggctgaaagtaacgcgaatatcattgcagatttctacaagaacatgaaaacagaaggtaaatacttcaaattatatgtttataaagatgacgataaacaccaaaaataa

SEQ ID NO: 2216 - DNA, 2952 bp, Staphylococcus epidermidis
gaggtgaacaaaatgataattaaatcattagaaatatacggatatggccaatttgttcaacgtaaaattgaatttaatcgtcaatttactgagatatttggtgagaatgaagctggtaaatctactattcaagcatttattcactctattttgttcggatttcctactaaaaagtccaaagaaccacgtttagaaccaagattaggtaatcaatatggtgggaaattatcactcattttcgacgatggcattgaagcagaggttgagagaatcaagggaagtgctcatggagatgtcaaaatttatcttaaagatggtactattcgagatgaagtttggctaaataaaaaacttaattacatttcaaagaaaacatatcaaggtatattctcttttgatgttttaggtcttcaagatattcataaaaatctagatgaagagcaactacaagattatttattagaagcaggtgcacttggatcaactgaatttacaagtatgagagatagaattggacaaaagaaagaagaattatataaaaaatctggaaaaaatccaattattaatcaacaaattgagcaacttaaacaattagaaaatcaaattcgaaatgaagaaagtaaacttgatacatatcatcgacttgtagacgataaagataaatcatcaagaagactagaaaatttgaagcaaaatttaaatcaattatcaaaaatgcatgagcaaaaacaaaaagaggttgctctacacgatcaaacacaagaatggaaaaggttagaacagtcgcttaatatagagcctataaattttcctgaaaaagggatagatagatacgaaactgctaaatctcacaaacaatcacttgaacgagataaaagtttgcgagaagaaagattaagcatattaaataaagaggcggagtccatcaatccagtagaccaaaagtatattgattcgtttaatagcctttatcaacaagagactgaaattaaacaaaaagaatttgagttacgttcaatagagaaagatattgctgataagcaacgtgaactagaagctcttcaatctaatataggttggcaagaagtgttttacgacgcagacagtactgaagcgatgaaaagtcatatgagtgatttagtattaggcaagcaagaacaaattgcttatatcaatcagttagaacgtggacttgaagaaaataaaattgaaagaaactctaattctaatgagattaatcaagttgagaatgagcttgttcctgacgaaacctttgaaaagaaaaaggaatatacacaacaagttttagaattacatgaaaaagagaacttgtatgaaaagttaaaagaaacttttgaagaagaacaaacacaaaaaaataaaagacaaaagtttttgagaataggatttattgttttgactattctatcagcagcactttctattttttcttttttcactgcaaatcttatttttggtataatatttgctctattaactgtgatttttgtagtaggtatcattttttctagatctaaagcagtagattatagcacagcaataagtcaggaaattaatgatttagaaaaccaactcacgcaacttgaaaaagaatataatcttgacttcgatttagaatatcaacaacaagttcgtgaacaatggcgtcatgctaaaaaaaataaaaaaatacttgaagaaaaacatcaatatatcaatcaatcattaacgactgcaaatgagcgattagatagtttaaaacatagcattattgaaataaaaaaagagttacgtttatcagaaaaactttctgatgaattagtggttgaaagtatctcaaccattggtcaaattaaagcgcatgataaatacattattgatttaaatcaacaacgcaataatctgctaaaagatatcaatcacttttatgaacgtgcacaatctgtaactgaaccacatttaaaactatttaatcagatgtctttcttccatgatgtgaaacagtggttaaaaaatgcagaagaacaaaatgaggcttggaataaaaatcaaactgaaacgcaattactcaataatgaattaaagcaattgaagtcacgcttaagtgaaacgaatcaaatgattaagcaattatttgattatgttgatgtagataatgaagaagattattatacacatcatcatcattttgaaacatatcaaagtgatttaaatcgatttaatgatttaaatcaatatttagaaaatcaaaattacacttatgaaatgagttcgcaattaagtgagaaaactactgctcaactagaagaagaagatcatagattggctaaacaagttgacgattacaatgatcaatttttagaaatgcaagcagaagttagtgatttaaatgctcagattaatcatatggaaacagatagaactttagcacaattaagacatgaatattatagcttaaaaaatagacttaacgatattgctaaggattgggcaagcttaagttatatgcaagctttagtggaagaacatatcaagcaaataaaagataagcgtctaccacaagtgattaatgaagctgtatctatttttaaaaatttaacaaatggtacttacaatatgattcattatactgaaaatcataaaatacatgtaaagcattctaacggacaagtatttgagccagttgagttgagtcaatctacaaaagaattattatatgtggctttacgtattagtcttattaaagtattaaaaccgtattatccattcccagtgattgtagatgatgcatttgttcattttgataaatatcgtaaagaacgtatgttgaaatatttgagagaactatcagaacattatcaaatactttattttacttgtacaaaagatcatgtcataccggctaaagaagtattaactttaaataaattacaggaaggcgggaaaaaatga

SEQ ID NO: 2217 - DNA, 783 bp, Staphylococcus epidermidis
ggcaaattaaataagtttaaaagaaaggtgactttgatgaaatttcgacgtccaaatcaacatttccaaatcgtagcgcatagaggattacctgaagattatcctgaaaatactattatcgcttatcgacatgcgctcatgttacatatagatatgttggaaattgatgtacattacacaaaagataaagaacttgtcgttatacatgatgatactatcgatcgtacgtcaaatggtaaaggtaaggtttctgattttactttaaaagaattaaaagcgttagattttggtttctataaaggagagaaatttaaaggggagagtataccgacttttgatgaagtgttagatttagcagataacttttcacaaaaattattaatagaaataaaaaagcctagtcagtatccaaatattgaaaatatgattgttgataaattgaaggaaagacaaatatctaaatctaaagtgattttacaatcattcgattttgattgtgtaaaaaaattgtcagcaatgaatttagattatgaattaggtttattaattagtaagaaaaaatattggcacaagttaccaaatttcaaaaaaattgccaaagttgctgattatgctaatcctaattatcaaattgtttcgaagaaatttatgcaacttgctcatgaggaagagttaaaagtattaccttatactgtaaataaattaaaagaatcacaaaaattaatagatattggtgttgacggtattatttccgatgtacctgaagatttatttgagctataa

SEQ ID NO: 2218 - DNA, 135 bp, Staphylococcus epidermidis
aaatactcccttcaaagttttcattatattaatgtccactttgaagggagtttatcaattgatatctccggttttgtgatttataaatttagtcatttacttttttatcttttttctttttacgtgaggacatga

SEQ ID NO: 2219 - DNA, 147 bp, Staphylococcus epidermidis
ggatcagtaaacttaatagcacttaaaagtaaggtatacttcgtgatgaaatttataattaaaaaagaacctgggacaaaatgtttgcttgtctcaggttctttttacgtgcacgtgtataaattttttaattacgtttgtcaatag

SEQ ID NO: 2220 - DNA, 444 bp, Staphylococcus epidermidis
ttgccatcccttgccttgttagagaaacccctttggattggcggagggataaatttctttttccctcctccttttaatttaaataatgaaaaattatattgggaatattttaaagcccaaatttataaaaagctttcagaaccaaaaacaaaaaccatctacagtcaaagaaaaattgatgtggagcctgtttttggatttatgaaggctattttgggtttcactagaatgtccgttcgagggatagataaagccaaaagagaattaggatttgtgctaatggcacttaatataagaaaagtaacagctcaacgagctgaaaataatcaaaaaaataataaaaaagacaatttctatattatttcaatagaaattgtctttttttacttatcctgggactttatgtcccacactcatttttttatactatatctgaaaatctaa

SEQ ID NO: 2221 - DNA, 552 bp, Staphylococcus epidermidis
ttattttcaaacaataagttaacttctatttatccggaaatcattttatgtgcacaaataggagttaattacatgtcatttgaggaagcatataaaaaatacaacaatatcatacattatttgttaaaaagttatcaaatcacttataattatgatgaattttatcaacaaatgctcattaaaatgtggcaacttacactcgattttgatgaacaacaatcttcttcttttaaatcttatctatttatacgcctaaaattctatcttatagatttatttagacaaaaagacaatacgcttaatatatgtagcattgacgccctttcagaactttctccgtcattttcaatcaacgaaatcgatttacttattaaagatatttcacaacagttacttccacgcgaacgagattggttaaccttatatttacaaggatacaaacaatatgaaatttcccaaattttagatttttcacttacaacgattaaaaaaataaaatctaacgcaatacgaaaactacgtcgttatttaaattcatctacaaaggattga

SEQ ID NO: 2222 - DNA, 144 bp, Staphylococcus epidermidis
atacagtcaaaggttttgccaaagacattcaaagttccggtttgtcaattttataaattaaaaaaaacagcaattaagtggatttatttcactagattgctgttttattttagttatataagaagatttgaaagaatagtttaa

SEQ ID NO: 2223 - DNA, 453 bp, Staphylococcus epidermidis
gaactaacaaaggagagatgtaaaatgggaaaaagtactaatttatttaaaattgcattaggcattggtggtgcaattactgttgtagcattatcacgtaaagaaagtcgagataaacttaaacaagaatataataaatataaagaaaatcctgaatcatataaatctagcgctaaagatttagcaactcaaataggtaataaagctaatgaaacaattcaagaagttaagaagaaccctaaagactatgttgaacgtatcaaaagtaatcctaaagaatttttagaagaagaaaagtctaaaattattggcaaaaatgatcagacacaagatgatattgaagaaggaaaatttgatgctgaaggcggcgcaactgtcaataacaatttaagagttgttactgaagatgacttaaaaaataataaaaatgcattacaagataaaaaagaataa

SEQ ID NO: 2224 - DNA, 852 bp, Staphylococcus epidermidis
tttatgacaaaagtttttataaatggtgaatttgttaatgaagaggatgctaaggtttcatatgaagatcgaggctacgtgtttggggacggaatctatgaatatatacgggcatatgatgggaaattgtttaccgttaaagagcattttgaaagatttttaagaagtgctgaagaaataggactagatttaaattatactattgaggaattaattgaattagtacgccgattattaaaagaaaataatgtggtgaatggcggtatttatatacaagctactcgtggtgctgctcctcgaaatcattcatttcctacaccacctgtaaaacctgttattatggcgtttacaaaaagttatgatagaccttatgaagaattagaacaaggagtttatgccattacaactgaagacattagatggttacgttgtgatattaaaagtttaaatttattaggaaatgtattagctaaagaatatgctgttaaatataatgctgcagaggctatacaacaccgaggtgatattgtcactgagggtgcatctagtaatgtttacgcaattaaagatggagtgatatacacgcatccagttaataattttatattgaacggaattactcgccgtgtcataaaatggatagcagaggatgaacaaataccattcaaagaagaaacatttacagtagaatttcttaaaagtgctgatgaagttatcatttctagtacttctgcagaagttatgccaattacaaaaattgatggtgaaaatgttcaagacggacaagttggtactataacacgacaattacaacaaggatttgaaaagtatattcaatcgcatagtatttaa

SEQ ID NO: 2225 - DNA, 738 bp, Staphylococcus epidermidis
atgtataaaaagattaggaggcacactatgtcacaaaaaatattagtggttgatgatgagcaatccatcgtgaccttactaaaatataatttagaaacagcagggtatatagtcgaagtcgcttatgatggtgaagaggcattgaaaaaagttgaaacagaacaaccggaactaattgtattagacgttatgttgccaaaaaaagatggtatagaagtatgtaaaacaatcaggtctgataaaaatttagtaccgattttaatgttgacagcaaaggacgatgaatttgatcgagttttagggcttgaactaggtgctgatgactatatgacaaaaccattttcacctagagaggtagttgccagagttaaagcaatattaagacgttctcaatttgtaaatgaaattgagaaggaagatgttgatgatgaagatattatcattggttcaattagaattcgacctgaattctttgaagtctataaagaagatgaattattagaattgacgccaaaagaatttgaattgttattatatttaattgaaagacaaggaagagttattactcgagaacatatgttgaattcagtgtggaattatgaattcgctggagattctcgaattgttgatgtacatataagccacttaagagataaattggaagaaaatcctaagcaacctaaattgataaagactgtacgtggtttaggttataaactggagagacctaaagcttaa

SEQ ID NO: 2226 - DNA, 795 bp, Staphylococcus epidermidis
tgtaataaaaacaaaggggttaggcttaatatggattggaatttatcgattatgttgatgattgttgcctttggttttatcgcttcattcgtcgattctgtagttggtgggggtggactaatttcaacccccgcattacttgcagttggtttgccaccatctgttgctttaggtacaaataaatttgcgagttcttttagtacgttaacaagtgcattaaaatttttacgttcaggtaaagttgacttgaaaatagtaggaaagatgtttccactaatatttgttgcttctggtggtggtgctatcattgcgacatacataccagcaaatattttaaaaccgctaatcattatagcattgtcattagttcttatttataccgtcatacaaaaagattggggaaatataagaacatttaccgattttacttttacaaaagcagtattatttacattaatatttattgttattggattttatgatgggtttttaggtggtggtacaggctcctttatgctatttacacttttattatttggctttgactttttaagtgcagctggtaatgcaaaggttttaaattttgcatcaaattgtggtgcgttattatttttcatgattttaggtcaggtcaattatttttatggtattattatggcttctagcatgatgataggtgtgttgttaggtgctcaatttgctttgaaaaaaggggtaggatatgtaaaagctttatttttagtggttactgcaatattaattataaaaaatctctacgattttattgtgcagtaa

SEQ ID NO: 2227 - DNA, 123 bp, Staphylococcus epidermidis
gtagtcaaaaataatattagcgcgggatggagcagttcggtagctcgtcgggctcataacccgaaggtcggtggttcaaatccgcctcccgcaatacatgttttattaggtctcgtagtgtag

SEQ ID NO: 2228 - DNA, 1248 bp, Staphylococcus epidermidis
attgagaaaaatataaagagagggactcatgatatgaatatacctaaatcagtatggtggctagttataggtatggcacttaatataaccggcgccagttttttgtggcctttaaatacaattttcatgaaggaagaacttcataagagtttaacaattgcaggtatcgttttgatgattaattcatttggaatggttgtaggtaatttgttaggtggttctttgtttgataaacttggtggttacaaaacgattttaataggtacatttacgtgtgtatgtagtaccacattactcaacttgtttcatggctggccatggtatgcaatttggttagtactacttggatttggtggcggaatgatagttcctgctatttatgcgatggcaggtgccgtttggcctaatggaggaagacaaacttttaatgctatctacttagcacaaaatataggggttgctttaggcgcggcattaggaggttttgtggctgaatttagtttcaattatatttttatggcaaacctcattatgtatgtactttttgccatcgtggcgattacacagttcaatttagagattaatgctaaatttaaaccacaagattcgatagatttaaaaagcaaagaaaataaaaaacgatttactgctatgatgctagtatgtgcaatgtttgcaatttgttggattgcatatattcaatgggaaacaacgatagcttcattcacacaatcaattaatatttcaatgtctcaatatagtgtattatggacaatcaatggaattatgattttagtagctcaacctttaataagaccaattattatcttattaaaaggtaatttaaaacatcaaatgtttgtaggtattttaatttttatgagttctttcctagtgacgagttttgcaaatcactttgctatatttgtagttggcatggtcattttaacttttggagaaatgtttgtttggcctgcagtaccaactatagcaaatcaacttgcaccagttggaaagcaagggcaataccaaggatttgttaattcagcatctacagtgggtaaagcatttggaccatttattgggggtatacttgtagatacatttaatatgagtatgatgtttattgggatgattatattattaagttttgcactgttatttttaagtttctatgataaagtgttacccaagaattttaaaaatcaacatcaatcaagaagacgacgaaatcagaatggtatttaa

SEQ ID NO: 2229 - DNA, 129 bp, Staphylococcus epidermidis
tattcagaaaatgtcttatatttaattgcttcattgaaagtcacttcacgtggcgttgagatgttgacaggtctaagcttgtatctaatatttagtattttattgggcaagaatctagcaacatcctga

SEQ ID NO: 2230 - DNA, 159 bp, Staphylococcus epidermidis
attgtacgaaagggctttatttttttaaagtattttaatgtaaaattacatatgaatacaaagtattttggcgagactcttgagggaacaggacaagctaaagactacaggctgaagctgtcccctaagaaagcgagccaacaatacgaagtattgtaa

SEQ ID NO: 2231 - DNA, 405 bp, Staphylococcus epidermidis
atgttaagaaaatactggattcactttgtcatagttactgttatagtgagtttgatatctataaaaggttttccacttgctttaggcgctttatacttgccactactgttcaaaattgtacaacttcagcttaatttatcaaaaggtcttattgataatgtcaatgtacatacatttataaaaagtaatcagtctggtgtggtgatcagtgtgatttgttgtctattaataacgggagttttgacatacaccttggatgatttttataatgaattaccaggatttttaggtgttttagtaagtataagtcctgttactctcactataggcgtgatactatttgttttaactgcaattgctattgttcaggctactaaagcaaaatatcaacaatctaagaattaa

SEQ ID NO: 2232 - DNA, 123 bp, Staphylococcus epidermidis
tctaaaagaaagaacgtctatacaaatcatttaattgtacgacgttcctcaacagtaatgatatctatatcactctatttctttaaactacatgaaatttcattaagttctttttgtaattga

SEQ ID NO: 2233 - DNA, 1953 bp, Staphylococcus epidermidis
ataggaggaaaaaatatgaatcaaattaatattcaatttccagatggtaatacaaaagaatttgataaagggactactacagaagacatcgctcaatcaattagtccaggattaagaaaaaaagcagttgcgggaaaattcaatggtcaacttgtagatttaacacgccctttagaacaagatggagctattgaaattattactcctgggagtgaagaagcgttagaagtacttcgtcattcaacagctcatttaatggcacaagcattaaaacgtttatacggagacgttaaatttggagttggacctgtaatagaaggcggattctattatgattttgatatggatgataaggtttcatcggatgattttgataaaattgagaaaacaatgaaacaaattgtgaacgaaaatcataaaattgtaagagaagtagttagtaaagaaaaagcaaaagacttcttcaaggatgacccttataaattagaacttattgatgcaattcctgaagatgagagtgtaacactttatactcaaggtgaatttactgatttatgtcgaggtgtacacgtaccttctacttctaaaattaaagagttcaaactattatctacagctggtgcttattggcgtggaaatagtgataataaaatgttacaacgaatttatggtacagcattctttgacaaaaaagatttgaaagcacatctaaaaatgttggaagaacgtcgtgagcgtgatcatcgtaaaattggtaaagatttagaattgtttacaaacaatcaactcgttggtgctggtttaccattatggttaccaaatggtgctacaatacgtagggaaatagaacgttatattgtcgataaagaagtaagtatgggatacgatcatgtttacacaccagtattagccaatgttgatttatataaaacatctggtcactgggatcattatcaagaagatatgttcccagcaatgaagttagatgaagacgaagcaatggtcttaagaccaatgaactgtccacatcatatgatgatttataaaaacaaacctcattcttatcgcgaattacctatacgtattgctgaattgggtactatgcatcgttacgaagcaagtggtgcagtatcaggtttacaacgtgttcgaggaatgacattgaatgattcccatattttcgttagacctgatcaaattaaagaagaatttaaacgtgtagttaatatgattcaagatgtgtacaaagattttggttttgaagattatcgcttcagattgagttatagagatcctgaagataagcataagtactttgatgatgatgaaatgtgggaaaaagctgaatccatgcttaaagaagcatcagatgaattaggtttaacttatgaagaagctattggtgaggcagcattctatggacctaagttagatgttcaagtaaaaacagctatgggaaaagaagaaactctatcaacagcacaacttgattttcttttaccagaacgttttgacttaacgtacattggtcaagatggagaacaacatcgtcctgtagttatacaccgtggtgtagtttctactatggaacgttttgttgcatttttaacagaagaaacaaaaggtgcatttccaacttggttggcgcctatgcaagttgaaattattcctgtaaatatagatttacattatgattatgcaagacttttacaagatgaactaaaatcgcaaggtgtccgcgttgaaattgatgaccgtaatgaaaaaatgggatataaaattcgtgaagctcaaatgaaaaaaataccttatcagattgttgtaggtgaccaagaagtagagaatcaagaagtaaatgtaagaaaatatggttctgaaaaacaagaatcagttgaaaaagatgaatttatttggaatgttattgatgaaatccgtttgaaaaagcatagataa

SEQ ID NO: 2234 - DNA, 471 bp, Staphylococcus epidermidis
ctaattttgaaaagaggtacctatcaaatgagtaaaaatgaattcatcaaaagagtaaataagcaattatggtttttaaatgctaaagaggaggatgcacttaacaaatatattgactcagttgatcagaataaaagtattgatacccataagcccataagattttcaaatgaatatttaaagaaatttatatttaatcataagaaaaaatcgacttctcatgtgttcgtacttttaatttgtatggttttagcttatgcatttttgctcggactttttattttagggttagtggccagcttagctattgtgcatgcctatatcaacccaaatattgatttatcagtttttgttatattaactgttttgattgtcgcgataattataatgattgctagtttatatgctattaaacatacgactgcattgtttactaagaagcttttagaatataaatttaataaaaggtag

SEQ ID NO: 2235 - DNA, 2718 bp, Staphylococcus epidermidis
tgcgtagtgaatactaaactcgcttactcgttatgtatttgtatatatgctaaaatatatgtaaatctgttctggaggttacgtattttgaataaattagtattaatagatggtaatagtctaagctttagagcgttttatgctctccctttactttcaaaccatgcaggtattcatacaaatgcagtttacggctttgctatgctcttagaaaaaataattaaagaagaaaaaccgaatcattttttagttgcatttgatgcaggtaaaacgactttcagacattctaagtacagtgaatataaaggtggtcgtcaaaagactccacctgaattaagtgagcaatttccatatattcgtcaacttttagatgcgtatcatattaaaagatatgaacttgataattatgaagctgatgacattataggaaaattaagtagacaagctgatgaagaagattttgaaaccattatcattacaggtgatagagacttaactcaattagccactgataatgttacaatatattatacaaaaaaaggtgttaccgacgttgatcattatacacctaaatttatagcagagaaatataatggtttagtgccgaaacaaattatcgatatgaaaggtctaatgggggatacctctgacaatattcctggcgttgctggtgtcggcgaaaagacggctattaaattacttaatcaatttgagtcagtagaaggggtctatgaacatattgaggaggtcactgcaaaaaaattaaaagaaaaactcatcaatagtaaagatgatgccttaatgagtaaagatttagcaacaatcaatgttcacagtccgattgaagtatcattagaagatacaaaattaactctacaagacgacactacagaaaaaattgaactatttaaaaagctagaatttaaacaactattagcagatatagacacatcctctacgaatgaagaagtcatagataaaacttttgaaattgagcaagactttcaaaatgtagatttgaatgatttaaacgaagcggtaatacattttgaactcgaaggcactaattatcttaaagacactattctcaagtttggtttttatacaaatcatcaacatgtagtgataaatgctgaggatgtaaaggattataaacatttagttcaatggcttgaagataaaaatacaactaaaattgtctatgatgcaaaaaaaacttatgtatctgctcatcgattagggattaatatagaaaatattgaatttgatgttatgttagcaagctatattattgacccatcacgttctattgatgacgttaaatctgtggtaagtttatatggacaaaattatgtaaaagataatattacaatatttgggaaaggtaagaaacatcatatacctgaagaaccaattctaaacgaacacattgcctctgtgacagaagctatagcagctgtaactccaaccatgaaatcacagttagaagattataatcaaattgaactgttgaaagatttagaattaccattagcaagaattttaagtgaaatggaagaaattggtatatataccgatatcaatgatttgaaagaaatggaattcgaaattcaaaaaaaattggatgtattaatatccaatattcatgagtcggctggtgaagcgtttaatatcaattctcctaagcaattaggtgttgttttatttgaaacattacaattgcctgtcattaagaagaccaaaacgggctattcaacagctgtagacgtattagaaaaactacaaggtgagcatcctattatagatgatattttagaatatagacaacttgctaagttgcaatctacgtatgtagagggattacaaaaagtaataagcaaagatcatagaattcacacacgttttaatcaaacgcttgctcaaactggtagattatcaagtatagatcctaatttacaaaatatacctatacgattagaagaaggaagaaagattagaaaggcctttaaaccaacttctaaagatagtgtgattttatctgctgattattcacaaattgagttacgtgtacttgctcatattacgcaagatgaaagtttaaaacatgcatttataaacggacatgatattcacactgcaacagcaatgaaagtatttaatgttgaatctgaccaggttgatagtttaatgagacgtcaagcaaaagctgttaactttggtattgtatatggtatcagcgattatggattgagtcagagcttgggtattactagaaaacaagcaaaagcatttattgatgattatttagctagttttccaggtgtaaaacaatatatgtcagacattgttaaagatgcaaaagcacaaggttatgtggaaacactacttcatcgtcgtcgatacattcctgatataacaagtagaaacgttaatttaagaagttttgcagaaagaacagcaatgaatacacccatacaaggtagtgcagctgacataataaaattagcaatggttaaattcagtgaaaagattaaagaaactaaatatcatgctaagttattattacaagttcatgatgaactcatatttgaaataccaaaatcagaagtagaagattttagtaaatttgtagaagaaattatggaacaagcattagtgctcgatgtacctttaaaagtagattcgaattatggtgcaacatggtacgatgctaaataa

SEQ ID NO: 2236 - DNA, 474 bp, Staphylococcus epidermidis
gaggactcgaaaatgaattttgaaggtaaattagttggtaaggatttaaaaattgcgattgttgttagtagatttaatgattttattactacacgtttacttgaaggggctaaagatacacttattcgtcatgaagtagaagatacaaatattgatgtagcttatgtgcctggcgcattcgaaattccactcgttgcaaaaaaattagctcaaaaaggtgaatatgatgctgtgataacattaggatgtgtgattagaggcgcaacttcacattatgactatgtatgtaatgaagtagctaaaggtgtttctaaagcaaacgacatttcagatactccggtgatttttggagttctaacaactgaaagtattgaacaagcagttgaaagagctggtactaaagctggaaataaaggttcagaagcagcagttagtgcaatcgaaatggctaatctaattaagcaaatcaattaa

SEQ ID NO: 2237 - DNA, 498 bp, Staphylococcus epidermidis
cgcaatacgaaaactacgtcgttatttaaattcatctacaaaggattgacatctatgaaatgtatatcaacgcattcacttttatatattcaaactgcgttttcaacaaatgttgaaacctatattcagtatgaacattacgctattcatttaccatgtacacctgaaaaaacattacattatttattggaattacatcaaaaatcctatcataatcaatgtatgttatctaaaaatattttaaacattaaaaaattcatacctatctatattaatgaggaaaccatattatttccagttacgcaaaaacgtgcaccgattaaatattttatcaatgcacgaaatattataggaattcattcttcaattcataccacaatgattgtttttgaagatggtacgactatcgaactgaacatcccctatacacttgtaacaaaaaaatggcagagaaatcttaccgtaggtcatatcataaaaaaaactaccttttattaa

SEQ ID NO: 2238 - DNA, 1026 bp, Staphylococcus epidermidis
atggcaacgaatattgcaattaacggtatgggtagaataggtagaatggtgttacgaatagcactaaataataaaaatttaaatgttaaagcgattaacgctagttatccacctgaaacaattgcacatttacttaattatgatacgacgcatggagtttatgataaaaaagttgaaccgattgaaagtggtattaaagtgaatggacatgaaattaaattactttctgatcgcaatccagaaaatttaccatggaatgagatggatattgatgttgttatagaagcgacaggtaaatttaatcacggagataaagcagttgctcatattaatgcaggtgctaaaaaggtattactcactggaccgtctaaaggtggagacgttcaaatgattgttaaaggagtcaatgataatcaacttgatattgatacatacgatatttttagtaatgcatcttgtactactaattgtatcggaccagttgcaaaagtcctcaatgataaatttggaatcataaatggtctgatgacaactgttcatgcaataacaaatgatcaaaaaaatattgataatccacacaaagatttaagaagagcacgttcttgtaatgaaagtattattccaacgtcaacaggtgctgctaaagcacttaaagaagtattgcctgaagttgaaggtaaacttcatggaatggctttaagagtaccaacaaaaaatgtctctctcgttgatttagttgttgatttagaacagaatgttacagttacacaagttaatgatgcatttaaaaatgccgatttatcaggtgttcttgatgttgaagaagctcctttagtttctgtagactttaacacaaatcctcattcagcaattattgattctcaatctacgatggttatgggacaaaataaggtgaaagttatcgcttggtatgataatgaatggggttattcgaatagagttgttgaagtagctgacaaaattggacaattaattgatgataaagcaatggtaaaagccatttaa

SEQ ID NO: 2239 - DNA, 2508 bp, Staphylococcus epidermidis
ctgttagcgaataagggtggtaacgcggcacaggtcgtccctttcaaatcattaatagtagagatgtctttttatgaattaggaggaaatgtgttgaattataatcataaggaaattgaaaaaaagtggcagaattactgggaagaaaataagacctttaaaacgaatgataatttaggacaaaagaaattttatgcattagacatgtttccttatccatctggtgctggtttacacgtaggtcatccagaaggatatacggcaacggatatcatctcacgatataaaagaatgcaaggttacaatgtattacatcctatggggtgggatgcttttggtttgccggcagaacaatatgctttagatactggtaatgatcctcgtgaatttacacagaaaaatattcaaactttcaaaagacaaattcaagaattaggatttagttatgattgggatagagaagtgaatactacagatcctgaatattataaatggacgcagtggatatttattcagttgtataataaagggttagcttatgttgatgaagttgctgtcaattggtgtcctgcattaggtactgttttgtcgaatgaagaggttgtcgatggggtatcagaacgtggcggtcatcctgtttatcgtaagcctatgaaacaatgggtactcaaaattacagaatatgctgatagattactagaagatttagatgagttagattggcctgaatcaattaaagacatgcaacgaaactggattggacgttcagaaggtgccaaagtaacatttaaaattgagcaatctgaccaaaatattgaagtgtttacgacacgaccagatacaatctatggtacttctttcttagttttaagcccagaacacccacttgtgaatgaaattacgacaagtgataaagaacaagaagtcaaattgtatcaaaatgaagcatcaaaaaaatctgatttagaacgtacggacttagctaaagaaaaaacaggtgtgtttactggaacatttgcaattaatccgctctctggcgataaattacctatttggatagcagattatgttttatcaacttacggtactggtgcagtaatggctgtgcctggacatgatgagcgagatcatgaatttgctacgaagtttaatttaccaattatcgaagttatagagggtggcgaagttcaaaaatatgcatacacaggtgaaggaaaacacattaattctagagaattagacggtctagaaaatgaagcggcaataagtaaagcgatagaattgcttgaatctaaaggtgctggtgagaaaaaagtcaattataaattacgtgattggttatttagtaggcaacgttattggggagaaccaattcctattatacattgggaagatggatcaatgactacagttcctgaagatgaattgcctttactacttcctgaaacagatgaaattaagccatcaggtaccggtgaatctccacttgcaaatatagatgcgttcgtaaacgttatcgatgaaaagacaggtatgaaggggcgccgagaaaccaatacaatgcctcaatgggctggcagttgctggtactatttacgttacattgatccacataacgaaaaaatgatagcagatcctgaaaaattaaagcattggctacctgttgatttatatattggaggcgtggaacatgcagtacttcacttattatatgcaagattctggcataaagtgttatatgacttaggtgttgtaccaacaaaagaaccattccaaaaactatacaatcagggaatgattttaggcgaaggcaatgaaaaaatgagtaagtctaaaggtaatgtgattaatccagatgatattgttgcatcacatggtgctgatacattacgactatatgaaatgtttatgggacctttagatgctgcgatcgcatggagtgaaaaaggtttagatggttctagaagattcttagatcgtgtttggagacttatcattactgatgaaaattcaatcaataaaaaaattgtagattctaacaatcattcacttgataaggtttacaatcaaactgtgaaaaaagtaacagaagattttgatacacttagttttaatactgcaatcagtcaattaatggtgtttattaatgagtgttataaaaccaatgaagtttacaaaccttatatcgaagggtttgtaaaaatgttatcgcctattgcaccacacattggtgaagaattatgggatcgattagggcatgaaaataccattacttatcaaccatggccaacatttgatgaaagtttattagtagatgatgaagttgaaatcgtagttcaagtcaatggtaaagttagagcaaaaatcaatattccaaaagatttatctaaagaagaaatgcaagacttagccttgtctaatgataatgttaaaatgagtattgaaggaaaagaagttaaaaaagttattgctgtacctcaaaagctagttaatatagttgctaaataa

SEQ ID NO: 2240 - DNA, 183 bp, Staphylococcus epidermidis
atgatggcgaacaaaaaagattccaaattaaattatcatgaagaagaaaatgctatggttaccgacttagatgatttaaaagaattaggaaaagaaatggaacagatttcacaggaaaatgatgaagaaaaattaaatcaatctcatgataacgaagttcgttcagatttaaaaaaacagtaa

SEQ ID NO: 2241 - DNA, 3534 bp, Staphylococcus epidermidis
ataattaagaaaggtagtgtaattatgagctggtttgataaattatttggcgatgacaacggttcgaatgacgatttgttacgcaaaaataaaaatagacgtcagtctcagcaatcaaaacaaaataatcaagactcattactgcctcaaaataatgatatttatagtcgaccaagaggtaaatttagatttccaatacaagtttctgaaaatgaatatacgcaaaaaaatgaaaattataatgaacataaccaagaagaaacaaacgatataatgagatcatataaccagcatgataatcctgaatttgattcttctggtaaaagacatcgacgccgacgccaagcgtattcaaaacacgatcaatctaagattacacaacaaaagcaatttgcagataacaattatacaaataataacagtgtttttaatcaaaacgacaataagaaatcttcacaacaacgtaaatcaatacaatctgaaaatatcaaaaacaaagcaaacactaagaatacgtcgacatctcctgaatttacatatttaaatcatagttttaaatcaagcgaggtaccctcagcgatttttggtacaaaaaaacgaagaccgattgagaatggtgtcataccgccagaacataaggaattaaatgataaagagattgttcaacaggatgaagtctcgcattcaacgaaatcaatagatgcatcaaaaaatgtttctaatagtaacgataacaatattgaaaaaaatcaacagaaaaaacaacaaacaactgctcaaactgagtcatcatcagaaaatatgcataatgttgaaaagtcaaattatcaaactactaagcgtaaaacaccaaattactctaaagtagataatacgattaatattgaaaatatctatgcttcacaaattgtagaagaaatcagaagagaaagagaacgtaaagttctacagaaacgacgttttaagaaagccttacaacaaaaacgtcaacaaaatcaacagtcagaagaggattcaattcaaaaagctattgatgaaatgtatgctaagcaagcccaacattacacaggcgaaagttcattggatttagaaaatgaaagtaatcaagattcgtcatctaatagtctagagaaacaatcaaatagcagcaacattgacaataaagaagcccaaaataacacacctttatttaactacgaagaaattgacttagatacgacatcagatgtatataaagttaatgaagaagaaactgaatctaaaaatgatgaagatttagtatcatcaaatcattatcattctaatgatgatgcggaagtagaagatgccgaatatcacgaattagatgataaccgacaacaaaaccaaagtaactctcaagacgatataattagttcaaaatcaagtacttcaaatatgtatgataatgcaatcagtgcaagtgtagataataacactgaaagagctaaatcaaatgaagataaaaatgatacagaaattacacacttagatggaacaacaagtgcaaaagttagtgacgagaaaattgaatctaatacaaacaatcatttagaacaagataagaatgtaaaattaaaaaatgtaaattcattaaaatcttcaaattctgatacaggtcaaacaagaaaacaacgttttggtggtagtagaccgtttaatgttttaatgacaccatcagataaaaagagaatgatggatcaaaaccacaaaaaagtaagtgttccagagcttaaacctgaaaaacaagcgaatgcaaatcatagaaaagacagcgaatctaataaatctgaagaatttaaacaaatcaatactaatagagaaaccgattctaatagttatgaatctaatggcatagagcatgatatgaattcatcaagtgatgagcacgtatatgaaacaccatccaaacaacaggatgagcaaatacaaaagctacaagatgattttcattttgaaaacgcaaatcatgctaaaattaacaattcaaatgaaactggcaatcaaagtaatataagtcattcaaaacggtcacaatattcaacaaatgaaagtaaaaatattgatacacaaacttcaaattcaagtacatcaaatcaaaattttcaacgtattcgtaaaggaccgaatattaaattgccgagttatcaattattggaagccccagaaccacatgaaaaagatcaagattggatagataataaaaagcaagaattaaacgacgcattatattatttcaatgtgcctgcggaagtgaaaaatgtaacagaaggaccgagtgttactcgattcgaattatctgttgaaaaaggtgtcaaagtatcaagaatcacggcattacaagatgatataaaaatggctttagctgctaaagatattagaattgaagcaccaattccaggtacaagtttagtaggtattgaagtgccaaatcaaaatcctactaaagtgaatttaaggtcaattattgaatcacctaaatttaaaaatacagagtccaaacttacagttgcaatgggttatcgaattaataatgaacccttattaatggatatcgctaaaacgcctcatgcacttatcgctggtgctacagggtcaggcaaatcggtatgtatcaatagtatcttaatgtctttactttataaaaatcatccagaagaattgcgtttattactcattgatccgaaaatggtagaacttgcaccgtataacgatttaccacatcttgtatcacccgtaataacagatgtaaaagcagctacacaaagtttaaaatgggctgttgaagaaatggaaaaacgttataaattgtttgctcaatatcatgtcagaaatattactgctttcaataaaaaagcaccttatgagcaaagaatgcctaaaattgttatagtaattgatgagttagctgatcttatgatgatggcaccacaagatgtagaacaatcaattgcacgtatagctcaaaaagctcgagcttgtggtatccatatgttagttgctacacaacgaccatcagtgaatgtaatcactggtcttattaaagctaatatacctactagaattgcatttatggtttcatcgagtgttgattctagaacgattttagacagtggtggcgctgaaagattattaggttatggtgatatgctttatttaggtagcggtatgaataaacctatacgtgttcaaggtacatttgtttcagatgacgaaatagatgaagttgttgactttattaagcaacagcgtgatcctgaatatttatttgaagaaaaagaattattaaagaaaacacaaactcaagcacaagatgatttatttgatgatgtatgtgagtttatggttgaagagggacatatttctacttctcttatccaaagacatttccaaattggttataacagagcggcaagaattatcgatcagctagaacaattaggatatatttcaggtgctaatggttctaaaccaagggatgtttatattacagaagcggatttaagtaaagaataa

SEQ ID NO: 2242 - DNA, 831 bp, Staphylococcus epidermidis
aaaatgtggaagtgggaaacagaaaatgacgcaaaaggcgttgttgtcattgctcataatattttagaacatacaggtagatatgcatatgttatcacgatgttcagacgaaatggttatcacgttatcatgggcgatttaccgggacaagggcaaacttcacgagctcaaaagggacaaatagatgattttaatacgtatcatgaaaatatattagagtggataaaaatagctaatgaatataaaattccaacatttgttttaggtgtgggactaggtggtctcatcattttaaatctgcttgagaaaacagaattacctattgagggtatcttgttattttcacctatgttagaactaaagagagactataaagggtgcaaaaataaattgatttctaatgttggtaaaatttctaaagatactagatttaaagttggtataactcctcaagatttaacacgtaatgatgaaattattgaagaaacagcaaatgatggactaatgcttaaaaaggtaacatatagttggtataaccttataaatgaaaagatgaaagaaacaatggatcatatcagagatattaaacctatttcagcattgataatgtatggtaccaatgataaaattttagaaactcaatctattaatgaaatgaaagataaattaaagtcgaaagagatgtactttaaagtttgggatggattatatcatgaaatacataatgaacctgaacgcgatttggtgatgagatatgttctatcatttttgaataatagtgtaaatactatgggttttatagtaaatgaagaggaaattgaagacatttaa

SEQ ID NO: 2243 - DNA, 981 bp, Staphylococcus epidermidis
attccaaaccttacttcattgattcaaattaaagatttaaaaggaaggtttttattaatgactaaaacaataggcttattagtaatggcgtatggtacaccatataaagaaagtgatatagagccttattacactgatattagacgtggaaaaaaaccaactgaagaagaactgcaagatttaaaggatagatatgaatttattggtgggctttctcctttggcaggaacaaccgatcgtcaagccgaagcattactcgaagcattaaataaagaacaagatgatgtgaattttaaactttatctcggattaaaacatatatctccatatattgaagaagcagtagagcaaatgcataatgatggaattaaagaagcagtaacagttgttcttgcgcctcattattctagtttttctgttggctcttatgatcaacgtgctcaagaaaaagcagatgaatatggcatccagttaacacatattaaacactattatcagcagccaaaatttattaaatattggacggaaaaaattaatgaaacattagaacaaatacctaatcaagaacatgatgaaactgtattagtagtttctgcacatagtttaccaaaagggttaattgaaagaaataatgatccatatcctcatgaattgcatgaaacagcggaaattcttaaacaggaatctaacatcatccatgttgctgaagggtggcaatcagaggggaatactggaacaccttggttaggcccagatgtccaagatttaactcgtgatttatataaggaacaccagtttaagcactttatctatacgccagtaggttttgtttgtgaacatttagaggtgctttatgataatgattatgaatgtaaagtggtttgtgacgatattggggtaaattactatcgtccagaaatgcctaacacacatccattatttatcggtgctattgttgacgaaattcaatcacatatataa

SEQ ID NO: 2244 - DNA, 1167 bp, Staphylococcus epidermidis
ttaaaatttgaaggagaagtgttatcagtgatttatttagacaatgcagccactaccaaagctgatcaagatgttgttgattcattcgtgaaagtgaaccaaacattatacttcaatccaaatagtcctcatcatgcaggggttcaagctgaacaattattattaaaagcaaaaagtgaaatcaatcgtatattaaacttaaataatcagtttgatatcatttttacaagtggcgcaactgaatcgaataatatactgctaaaaggtattgcgtatatgaaaaaagaaactgctaatgagattatcacatcagtcttagaacatccttcagttttggaagtaatgaggtatttggaaagggaaaaaggttttaaattaaaatacgttgatgtgacaaaagaaggtaagttggacacagaacacttaaaatcattaatgacagataaagtaggacttgtgacatgtatgtatgtcaataatattatgggacaaattcaacctattgaagaaatagcaaatattgtaaaaaattacccacgtgcacactttcatgttgatgcagtccaggctttaggtaaagtgcctatgcaaattaatcatattgatagtttgagtttaagtggtcataagtttaatggacttaaaggtcagggactactacttttaaaaaatattcaaaacatagaacctatagtacatggtggtgggcaagaatatgggctacgaagtggtacaattaatctaccaatggctatctctatggttagagctataaagaatgcagttgatcaaacaaaagagcttaatttacgtttaagcaattataaaaataaattactttcatttttagcagaatataaaaatgtatttatcaactctcctcaaaatgcatcacctcatattataaatataggatttccaggtgttaagggtgaggtacttgttaatgctttttccaaacaaaacgtaatggtttcaactacaagcgcttgttcttctaagatgaataaattgaatgaggttttacttgcaatggaaattgcagagtcaaaaatagaaggtagtataagaatttctttaggggcacatacgactgaaaacgatatattaagttttatgaatgcatttgaatctgtatataaggaaattaaggagctgttaaagtaa

SEQ ID NO: 2245 - DNA, 135 bp, Staphylococcus epidermidis
tttcaatctgaggtatttttgttggtttataaaaagacgaaagtagttaatcaaattgttaacttagtgctaataattttgttgaatccgcttgtttcatttaaaatttttataacttcctcacttgcttgttga

SEQ ID NO: 2246 - DNA, 222 bp, Staphylococcus epidermidis
aacgatgacctaccattggtaattgtacggcactcaagatttgttccggtacaggagttggtccaggtgttaataataaaggttggtaatactgcattgtacattcctcccataataagatttatttattttagcaaaaattctgaatatttaaaacccttattatatagctatcacataattaaaacgtttacatgtttaaaatttgtgatagctatatga

SEQ ID NO: 2247 - DNA, 135 bp, Staphylococcus epidermidis
actggaaatgatataattaaattaccaggtcattgtacaagggtagtcgctatggctaccttatttttttatacaaaaaaagcgactaaaaagtcgcttttaaaagtgttatttctttttattaaaatacattaa

SEQ ID NO: 2248 - DNA, 1665 bp, Staphylococcus epidermidis
gttatgagtgaaagtaaagaaatggttcgtggaacctttttaattacaataagtattttaattacaaaagtattaggtgtcttatttattattccgtttactgctttaataggtggacaagccaacatggcaccttttacttatgcttatgcaccatacaatatagctatagctatagcaacagctggtgttccgcttgccgcgtcaaaatatgttgctaaatataatgcactaggtgcatataaggtcagtcagaagttttataaatcaagttttgtagtcatgagtattacaggaattgtaggtttcctagttttatatttattagcaccatacatagctgaactaaccttatcacgtaatactcatggtaatagtggatggacagtagctgatatcacttggattattagaataataagtatggtagttatatttattccagttctcgcaacttggagaggaatatttcaaggatacaaatcgatgggacctactgcagtgtcagaagttacagagcaaattgcaagaattgtatttattttagtaggtagttatttaacgctcaatgtatttggaggtacagttcttcaggcaaatggtattgcaacgtttgcagctgcaataggtgcaatcgcaggaatacttacattatggtattactggattaaaagaagaaaaaatattaaaaaaatggtcgactcagatacagcgaatctaaatgtttcatacgggaaaatgtataaagaaattattgcttatagtataccgtttgtcatagtaagtttgaattttccactatttaatttggtcgatcagtttactcataatggtgcgcttaaccttgtaggtgtcaaacctggtttgcaagatatattctttaacatgttaaacatgtctacaaacaaaatagtaatgattccaacatcattaagtgctggatttgctgtcagtttaataccatttataactaaaacctatgaagaaggtagatatgcagagatgcatcgacaaattagaacttcgattggagttttaatgttcattactgttccagctagtattggtatcatggcattagcgcaacctttgttcacagtattctatggttttgatccagttgttcacggtcacgatccaaatttcgatggaagtagattattattttattatgctcctgttgcaattttaatttcattattaagtgttacagcatcaatgttacagggtatcgataaacaaaaactaacagtttttgttattttaggatctgttttaattaaactgattctcaattatcctttaattatgttattacacacacctggcgctgtattaagtacagcaatagctttattatttgcaatttgttgcaatttctatattcttaaaaaatatgcaaactttaaatttagttacagttggatacatttagctaagattattctaatttcaatcatcatgatgattggggttgaggtgattttcttcattttaagattattcttggaaccaactagatttaattacttgattattgttgcaattggtgtcattgtgggagcaatcatttatggtggtattacaatcaagactaaattagctgatgaatttttaggtgatattcccgctaaaataagacgtaaagtgaagatgttgcgatga

SEQ ID NO: 2249 - DNA, 627 bp, Staphylococcus epidermidis
aggaagagtgaaataatgtctaaagtgattgggataactggtggtattgccactggaaaatcaacagtttcagaattattaacagcatatgggtttaaaatcgtagatgctgatattgcttcacgcgaagcagttaaaaaaggctctaagggtcttgaacaagttaaagagatttttggggaagaagcaattgacgaaaatggtgagatgaatcgtcaatatgtaggagagatagtttttaatcatcctgacttacgcgaggctcttaatgaaatagttcatcctattgtaagagagataatggaacaagagaaaaacaattatctagaacatggatatcatgtaattatggatatcccattgttgtacgaaaatgaactacaagatactgtagatgaagtttgggtggtttatacatctgaaagtattcaaatcgatcgtttaatggagaggaataatttatcattagaagatgctaaagcacgtgtttatagtcaaatatctatagataaaaaaagtaggatggcagatcatgtgatagataatctaggtgataaattagaacttaaacagaatttacaaaaattacttgaagaagaagggtatattcaatcggagagtgaatag

SEQ ID NO: 2250 - DNA, 147 bp, Staphylococcus epidermidis
aagctcaacgagctgaaaataataaaaaaatttaaaaaagacaatttctatattatttcaatagaaattgtctttatttacttatcgtggacttttttgtcccaacttctatatttttttatcatcacaatattatgccaactctga

SEQ ID NO: 2251 - DNA, 258 bp, Staphylococcus epidermidis
atgaccttagatatgcccgcttcaatgattttatccacacaaggtggcgttgaaccatggtgtgtacaaggttctaatgaaacgtatatggtagcaccttgggtatttaaacctgccatttcaatagcctgtacttcggcatgtttatctcccttttttaaatgtgcacctaaacctacaatcctaccgtttttaacaacaacggatcctactggtggattaacacctgtttgtccatttaccatttttgctaattga

SEQ ID NO: 2252 - DNA, 948 bp, Staphylococcus epidermidis
ctaatgttagattttgaaaaaccactttttgaaattagaaataaaattgattctttaaaagaatcgcaagaaaaaaacgaagttgatcttcaagatgaaatagatatgctggaagcatcattaaaaagagaaactacaaaagtgtacactaatctaaaaccttgggatcgtgttcaaatcgctcgtttaccagaaagaccaaccacattagattatattccctatatttttgattcatttattgagttacatggcgatagaagttttagggatgatccagcaatgattggtggaattggttacttagatggtaagtcagtaacagttataggccaacaacgtggtaaagacacgaaagataatatttatcgtaattttggtatggctcacccagaagggtatagaaaagctttgcgtttaatgaaacaagcagagaaatttaatcgtccaatatttacttttatagatactaaaggtgcttatccgggtaaagcagctgaagaaagaggtcaaagtgaatcaattgcaaaaaatttgatggaaatggcttcattaacggtaccagttattgctgttgttattggtgaaggcggaagtggcggcgctttaggaattggaatctcaaatcgtgttctgatgcttgaaaatagtacttattcagttatttcacctgaaggagcagctgcacttttatggaaagatagtaacttagctcaaattgccgctgaaactatgaaaatcactgcgcttgatttactagatttaggtattatagatgaagtgattaatgagccacttggtggtgcacaaaaagatgaagaagtacaagctttatcaattaagaaaatgttccttaaacatttaaatgaattaaatcaactcacacctgaagaattagcaaatgatcgttttgaaaaatttagaaaaattggttcagttgtggagtaa

SEQ ID NO: 2253 - DNA, 210 bp, Staphylococcus epidermidis
cgtcatctagaagcctctaaccttatcttgtcaatttctacaatcattatctttcaattaatcattcttttattacttttattattcaaatacagaaatatatcccctctatatttattttttatattttttgtaaattataaaaaatacaatatagatgacatttggtgttctactttaaaatcaataactagtgttataaaaggttga

SEQ ID NO: 2254 - DNA, 1242 bp, Staphylococcus epidermidis
caaatgtcagaacaagaaaagaatcaacaccactatcgtaattcttcacagaagcgacacacttttccatggattaaaacaattattgttgcaataatcgctggaattattggagcacttctcgtcttaggtattggtaaactcctaaataaaactggttttaacaatgaaggtgctactgttcatcaagtttcaaatagtcatggtggcaatcagctagatggtaaaagtaatcaatacaaatcagtacatgacatgattaaagacgtttctcccgcaattgtcggcgtgataaacatgcaaaaatctacaaaccttgatgatttattcaacggtaaggcatctaaatcaaaagaagcgggaattggttccggtgtgatttatcaaataagtgatggttccgcatatatcgttacaaataatcacgttgttgatggtgcttcggaaattaaagttcaactacataattcaaaacaagtagatgccaaattaataggtaaagatgccctaacagatattgctgttctaaaaataaaagatacaaaaggaataaaagcaattcaatttgctaattcgtcaaaagttcaaacaggagatagtgtttttgcaatgggtaatcctctaggattagaatttgcaaattctgttacatcaggaattatttcagctagcgaacgtacaattgacgccaatacttctgctggtaatactaaagttaatgttttacagacagacgctgcaataaatcccggtaattcgggtggtgcattagtggatattaacggaaatctcgttggtatcaattccatgaaaattgcggcagcacaagtagaaggtataggttttgctatacctagtaatgaagttagagtgaccatcgaacaactcgttaaacatggtaaaatcgaacgcccttcaatcggtataggtcttataaatttaagtgatattcctgaaaactatcgtaaagaactacatactcataaagacaaaggcgtttatgtagctaaagtagacagtgaaaatgccattaaaaaaggtgatattattactggaatagatggtaaacaaataaaagatgatacagatttaagaacttatttatacgagagcaaaaaaccaggtgaaatggttactctaaaagttatcagagatggtaagacacaagacattaatgtaaaattaaaaaaacaagcatctgcatctgaatcatctcaatcacaaagtcaatttgctcaataa

SEQ ID NO: 2255 - DNA, 792 bp, Staphylococcus epidermidis
aaacacttggattttattaaggaaaagcgcatgccaatcgaatatgaaactcatttttttaatgaagtaacatatcttgtagattatttaaaagtcaaggctctgatgatgattccgaaaaataaaaaagatatcaaacgtatcgttatatacttaagaggtggtaaagggcaagttggaagagtgagagctgcaagacttatgcaatttgcaaatgaatatactttagttataggtccttactatagaggaaataatggaagtgaaggaagagatgaattttaccgcggtgatttaaatgatgtaacgcatttgattcgacttttaaatcaaaactatccttctgcatttatacatatggtaggattttcacgtggaggtctacaaggattacttacttttaatgatttgcctgtagatagttatatgatttggggtggcgtatctgatatacatttaatgtatgaagaacgagttgacttgagaggtatgctacgacgaatggttggacatccaaaaaaagatgcgaaagcttataaaagcagagatgcaatgcaatttataaaaaaagatagtcctcctattctcattattcatggtggcaaagatattcaagttggaatacatcaagcttatgatttagaaaaaaaattaaaatccaaaggaatttattatcaaacctattatcaattggatgaaggtcatgtaccacgacctcctgcgatgagagacgtaattcgatatatacatcaatggatgaacgacgtcgaaaataaaaatttaaatatatag

SEQ ID NO: 2256 - DNA, 1284 bp, Staphylococcus epidermidis
aaaggtatggaggttatcatcatgtatcaaacaattgttatcggaggtggcccaagtggggctatggctgcggttgctgcaagtgaaaaaaataaatcagttttattaatcgaaaagaaaaaaggtcttggacggaaactaaaaatctcaggtggtggtcgttgcaacgtaactaatagacttccatatgatgaaatcataaaaaatattccgggtaatggtaaattcctatatagccctttttcagtttttgataatctttctattataaatttttttgaaacccgtggagtcaaacttaaagaagaagatcatggtagaatgtttccagtttcaaataaatctcaagatgttgttgatgtgcttattaaccaactcaaagaaaatcatgttgaggttaaggaagaaacaccagttgtcagtgtttcgtatgaccataattttaaagttaaaacacaaataggtgaatttgaaagtcacagtttaattattgctacaggcggtacatcagttcctcaaaccggttctactggagatggttacaaatttgcaaaatctctaggtcattctataacagaattattccctactgaagtgcctatcacttcatcagaaacttttatcaaatcaaatcgcttaaaagggttaagtttaaaagatgttaatttatcggtcttaaagaaaaatggtaaaaaaagagtaagtcatcaaatggatatgatattcacacattttggaattagtggtcctgctgctcttagatgtagtcagtttgtttataaagagcagaaaaatcaaaaaaagaaaaatatccatatgcaattagatgtttttcctgaactaaacgtagatcaactatctcaaaaagtgagaaaaatacttaatgcagaaccagataaatatattaaaaatagcttgcgaggattaatagaagagcggtatttattgtttattctcgaacaatctggtattaatgatgaaatgactgcacatcatttatcaaatcaacagtttcaaacttttattaatcttctaaagacttttacctttacagtagatggcacacttccattagacaaagcttttgtgacaggcggcggtatttctttaaaagaaatagaaccaaaaactatgatgtctaaattagtgccaggattatttttatgtggcgaagtcctagatattcatggatacactggaggttataatataacaagcgcattagttacgggtcatgttgctggaatgtttgctggtgaatttaaaatagatcaaaacaaataa

SEQ ID NO: 2257 - DNA, 162 bp, Staphylococcus epidermidis
cacacattactaaggaataactttataactgttcttgttagtacaattaaatatttagtaattttatgggtaaatacgattattttcatatcaatgaattacaagtattgttatacgtgtaacttttgtgaaaaatttcttatgtatccagaatacgaatag

SEQ ID NO: 2258 - DNA, 1494 bp, Staphylococcus epidermidis
gctcaactactgatatttaataagcaagtaggtataattatacgtgtatataatttggaggaatgcattgtgaatttttggttacaggaacaagctcaatcaaatggaaatcgattagcgattgttacaaatcagttatctttaacgtacgaagaattatatcatcgtgcaaaaacaatcgcggaatatttaacttctttaaatcagaaaaggattggtttatatataagcaatgatattgattcagttgttttgattcatgcttgttggttagctcatattgaaatagctatgataaatacacgtttaacgcgacatgagatgataaatcaaatgaattcagtcgacatagcaacgattgtacacacgttgcctttagaattagaagggtttaatttatatcattttaatgatttaacacaattagataaacatgatgtttcaggttacaaatttaatttagaatcgattgcatcaattatgtttacgtctggaacgacgggacctcaaaaagctgtgcctcaaacgtttaataatcatttagccagtgctaaaggctgtaaacaaagtttaggattcgaacaaaatactgtgtggctttcggtcttacctatatatcatatttctgggctcagtgttattttgcgcgcagtgatagaaggattcactgtcagacttgttaaaaagtttcaaactgatgatatgttaacacaaataaagacttatccaatcacccatatgtcccttgttccacaaacgttaaagtggttaatggatgcaggattgactcaaccattttctttagaaaaaattctgctaggtggtgctaaattatcaccacaattaattgagcaagcattgacttatcgtttacctgtatataattcttttggtatgacagaaacttgctctcagtttctaacagcctcacctcaaatgctcaaagaacgtttcgatactgttggaaaaccaagtgaaaatgtcgaagtgaaaataaaaaatcccaacgcatatggacatggagagttattaattaaaggtgaaaatgtgatgaatggttatttatatcccaaatatttaaaagacacatttgataatgatgggtattttcaaactggagatatagctgaaatagatgatgaaggttacgtcataatatatgatcggcgcaaagatttgattataagtggtggagagaatatttatccttaccaaattgaaacaatcgcaaaagactttgaaggcattgaagatgccgtatgtgtaggaatatcagatgatacttggggtcaagtaccaatattatattatgtgacaaatcaagatattaatcaaactgaattaatagaacattttgagaatcatttagctagatataaaattcctaaaaaatattatcaggtcaaatctttaccttatacatcgacaggtaaattacaacgtaaaaaggtcaaaagtgaagacttgaatgagggaaagaataatgaaagttaa

SEQ ID NO: 2259 - DNA, 123 bp, Staphylococcus epidermidis
ctaacggcactaatctctttaaatcaaattgaaaaagcaatcaacgctcacgattgcaaaacacttcaagacttgagtaattactttaacttacctactacacatttatttctaacaatgtga

SEQ ID NO: 2260 - DNA, 1473 bp, Staphylococcus epidermidis
atgtataaacttttgcaacatttgggtaggtctctcatgttacctgtagcagttctgccagcagccgcaattattgtaggcataggtcatgttttagatgctttaaatatacttcctcaagctgcactctttttcacaagtgttgggaccactatattagagcaattaggtatattatttgctattggtgtagctatcggtatggctaagaagaatgatggcgcagtagcattagcggcagcgttaggattttttatagttacagtagtactatctccagaaaaattagcaactttgttacaaattaaagaatctaaaattgatttagcattcagtcaaatgaataatggaaatgtgtttgtagggattattataggtttgattgctgcatatagttataacaaatttagtgaaacgaatttacctatggccttatcattcttcagtgggaaacgacttgttccaatcatgacagcattcttttgtacaattttagcgattattttattattgatttggcctccagtttataatgggatagttacttttggtaagtggattgttggtatgggtccattcggtgcattattatatggtttttttaatagattgttaatacctactgggttgcatcatgcgctcaataatgtattttggtttgatactgctggaataaatgacataggtaaatttcaaagtggtaaaaatgccattaagggaattactggcagataccaagcaggatttttccctgttatgatgtttggtgtaccggcagcagctttggcgatgtatcatactgcaaagacgaatcaaaaaaaacaagtttatgcttggtttttagcaagttcagtttcggcattctttgtaggtgtaactgaacccatagagtttgcattcatgtttgtagctccagttttatttgttattcatgctgttttaactggattatcattatttatagcagcaatgtttcattggacagcaggattttcatttagtgcaggtcttatagattatgtgctttcattggttaatccgatatctaatcaaccttggatgttattattgcagggtgtagtcttttttattatctattacgttatctttagagttgtcatacaagtctttaatttaagtactataggtaggggagataatgaacttatcgatccaacatcaaatgatacttctgaaatggaagtattacagaacaaaaccactacaagtaaatattatcaaaacgcaaaacgtattttagacggattaggtggtaaagaaaacattattagtttaaatcattgtgcaacaaggcttagattggagcttaaagataattcgattatagatgagcagaaaattaaaaatgctggagctattggtataactcaaaatggacaccattatacccaagtgattattggaacacacgtacaacaagttgccaatgaaatggatcaccaaatgaattag

SEQ ID NO: 2261 - DNA, 276 bp, Staphylococcus epidermidis
atatttagttggaggcctttatcaatgttgaaaaaaatattattatctctagttgtattttatcaacgttttatttcgccacttacaccaccaacatgtcgattttatccaacatgttcacaatacactagagaagccatcgaataccatggtgcactaaagggactttatctcggtgtacgacgcatacttaaatgtcatccattgcataaaggtggctttgatcctgttccattaaaaaaagataaaaattctaaaaccacacatcatcattaa

SEQ ID NO: 2262 - DNA, 1620 bp, Staphylococcus epidermidis
ctcaatttatggaggttattagacatgagtcataagatattagtatcagacccaatttctgaggatggtttacaaagtattttaaaacatccagaatttgacgtagatatacaaacagatttatctgaaaatgatttagtaaatatgatttcaacttatgatgctcttatcgtacgaagtcaaacccaagtaacagagcgaattattaatgctgcaacaaatttgaaggtcattgcaagagctggtgtaggtgtggataatattaatatagaagcagcgactttaaaaggtattttagtaattaatgctcctgatggtaatacaatttctgctacagaacattcagtagctatgttgcttgcaatggcacgaaatattcctcaagcacaccaatctttacgtaacaaagaatggaatcgtaaagcatttagaggggttgaactttatggcaaaaccttaggtgttatcggtgctggtaggattggtttgggcgtcgctaaacgtgcgcagagtttcggtatgaaaattttagcgttcgatccttatttaacagaagataaagcgaagtcattagatattcaaattgcaactgttgatgaaattgccgaaaaatccgactttgtaacagttcacacaccattaacacctaaaactcgaggaattgttggttcatctttctttaacaaagctaaacaaaacttacaaatcataaatgttgccagagggggtattatagatgaaactgcacttattgaagcattagataataacttaatagatcgtgcagctattgacgtatttgaacatgaacctcctactgattcccctctcattcaacatgataaaattattgtcacaccacatcttggcgcctctactgtagaagcgcaagagaaggttgcagtctctgtatctgaagaaataattgaaattctaactaaagggaatgttgagcatgctgtgaatgctccaaaaatggatttaagcaaagttgataaaacaactcaaagctttataggtttaagtacaactattggtgagtttgctattcagcttctcgatggtgctccgagtgaaattaaagttaaatatgctggtgacttagcgcaaaatgacactagtttaattacaagaacaattataacgaacatcttgaaagaagatttaggtaatgaagtcaatattattaatgcattagcaatacttaaccaacaaggtgtcacgtataatatagaaaaacaaaagaaacattctggctttagtagttacattgagctagaactagttaatgatcaagataaaatcaaaattggcgcaacggtattcgcaggttttggcccaagaatagtacgtattaatgattactcacttgattttaaacctaaccaatatcaattagtaacatgtcataaagataaacctggtatagtaggacaaacaggcaacctattgggaagtcacggaattaatattgcgtcaatgactttaggacgtaacgatgctggtggagatgctttaatgattctttctattgatcaacaagcaagtgaggaagttataaaaattttaaatgaaacaagcggattcaacaaaattattagcactaagttaacaatttga

SEQ ID NO: 2263 - DNA, 1188 bp, Staphylococcus epidermidis
atcttattatgggaggaatgtacaatgcagtattaccaacctttattattaacacctggaccaactcctgtaccggaacaaatcttgagtgccgtacaattaccaatggtaggtcatcgttctactgactttgaggaaattgctagtgaagcatttaaaggtttaaagccagtatttggtagcaaaaacgaagtacttattcttacatctagtggcactagcgtattagaagcaagtatgcttaacatcgcgaatcctgacgatcatattgtgataattgtttctggtgcatttggaaatcgctttaaacaaatcgcacaaacttattataatcatgtacatgtatatgatgttaactggggtgaagctgtaatagttgatgactttatcacttatttaaagcaattaaacgttccagtcactgcagtattcactcaattttgtgaaacatctactggtgtcatacatccagttcaccaattaggtcatgcacttaaagcttttgataattccttatattttattgttgatggtgtaagctgtatcggtgcagtggatgttgatttaacaaaagataaaatcgatgtattagtttcgggaagtcaaaaagctatcatgctaccaccaggtctagcatttgttgcttatagcgatagagcaaaaaaacgatttgctgatgtaaaaacaccgagattctatttagatttaaataaatacataaaatcacaagagcaaaattcaacgcccttcacccctaatgttggtctatttagaggaataaatgcttatgtagaacttgtaaaaaaagaaggattaaatcacgttatttcacgccattttaaaatacgtaatgccttaagagcagcactaaaggcacttgaattagaattattagtaaaagatgatgctcatgcctcacctactgtgacctcatttgttccaaaaaatcaagaagaacttaatatcattaaaaatcaacttaaatctcaattcaatataactattgctgggggacaaggacacttaaaaggacaaattttgagaattggtcacatggggaaaatatctccttttgatattttagcagtcgtgtctgcattggaaattattttaacttctaatagaaatgtcaattatattggaacagggataactcaatttatggaggttattagacatgagtcataa

SEQ ID NO: 2264 - DNA, 1167 bp, Staphylococcus epidermidis
aatagcatatgtaattttaaaaaggtggcaaagctaatgaacaataaactaaaaaaagaaattatagactttgctcattctataggcattgatagtattggatttactactgcagatccttttgatgaattgaaacaaaaattagaggaataccatgcaaaagggtatgcatcgggttttgaggaatcaaatatatcattacgtacagaacctaaactaagcttacctagcgcacgttctattattgcaatagctgtgggttatcctaataaacttaaaggtgcaccaaaaagtgttaaaggtgatcgtagaggcatgtttgcaagagcatcatggggccaagattatcatagcattatgcgtaagagacttgataaattagctgatttcatcaaagaaaaagtacctgatgtcgaaatccaatcgatggttgataccggtgtattgtcagatagagcagtagcagaaagagctggattaggattcacgggtaggaatggatttgtgatttctcctgaattagggacttggtcttacctaggtgaaatgttagtaagtataccgtttgaacctgatgatcctttattagatagttgtggtgactgcacaatttgtgttgatcgctgtccaacaggtgcacttgttggaaatggtcagttaaatagccaaaaatgtattagttttttaactcaaactaaaggttatcttcaagatgaatatcgatataaaattggaaatagattatatgggtgtgatacatgtcaacaagtttgtcctaaaaatcgtggtattaatactcagcatgatgatattgtcttggaacctgaaattttgaaaccacgtcttgtacctttacttcaaatgagcaacaagaaatttaaaagtacatatgggcatttggcaggtgcttggagaggtaaaaaaccaatacaaagaaatgctattatagctttggcacattttaaagaagaaagtgctataccagaactaaaagaagttgcattaaatgatccaagacctatgattagaggtactgcatattgggcaattggacaaattttagaggatgatgctatatcttttattgatgagcattatgaaaatgagattgaagaagtgcagctcgaaatgaaaaaaggtttgcaaatgaggagagaacaaaaatga

SEQ ID NO: 2265 - DNA, 969 bp, Staphylococcus epidermidis
aaaggaaaatgtattatgggtaactatttcccgtatgcctttgaagataaacgctatcacacatggaactatcatttaaaaaacaagtttggtcagaaaatatttaaggtcgcattagacggaggttttgattgcccaaatagagatggtactgtagctcatggaggttgcacattttgttctgcagcaggaagcggtgactttgcaggtaatagagctgaaccaattgaagttcaattcaaaaaaataaaagaacgtatgcatgaaaaatggagtgaaggtcaatatattgcatactttcaggcgtttacaaatacgcatgcacctgttgaagtactaaaagaaaaatatgaacctgtcttaaaagaagatggcgtcgttggtttatcaatcgcgacaagacctgattgtttgcctgatgatgttgtagaatatttagctgaacttaatcagcgcacttacttatgggtagagttgggcctacaaactgtgcatcagtcaacttccgatttaataaatcgtgctcatgatatgcaaacatactatgacggcgtaacaaaattacgcaaacataatataaatgtttgtacgcacataatcaacggcttaccaggtgaaaattatgacatgatgatggagactgctaaagaagtcgctcagatggacgttcaaggtattaaaattcatttattacacttgctaaaaggaacgcctatggttaaacaatatgaaaaaggtatgctcgagtttatgagtcaacaagattataccaatcttgtttgtgatcaacttgaagtattacccccagaaatgattgtgcacagaatcactggagatggacctatagatctaatggttggaccaatgtggagtgttaataaatgggaagtattaaatgaaattgataatgagcttgctagacgaaactcctatcaaggtaaaatgaacaagcagagtatacaatcatga

SEQ ID NO: 2266 - DNA, 1416 bp, Staphylococcus epidermidis
tctcgaatgtggaaagaaaaggttctagagtacgaaaatcaaatgattgaagatcttaaaggtttattatctatagaaagcatcagagatgattctaaagccactgctgatgcacctgtgggaccaggaccgagagaagctcttgattacatgtacaatttaggtaaaagagatggtttttcaacgcatgacgttgatcatatagctggtagaattgaagctggtaaaggagaagatgtattaggtattttatgtcatgtcgatgtagtacccgcaggcgatgggtgggattcaaacccattccaaccagtagtgacagacaatgcaattatagccagagggacactggatgataaaggacccaccattgctgcctattatgcagttaaaattttaaatgagatgaaggtagattggaaaaaacgtatacacattattatcggaactgatgaagaatcagattggaaatgtacagacagatatttcaaaacagaagaaatgcctaccttaggttttgctccagatgcagaattcccagcaatacatggtgaaaaaggtataacaacctttgatttagtacaaaatgaagtgacagaagatacagatgaacctgactatgagttattaaaatttgaatctggtcaaagatacaatatggttcctgattatgctaaggcagaagtgctcgtcaaagaaaatatgacagatgtcattcaaaactttgaaaactttttacaacaaaatcaactacaaggtgaaagtacagttgacagtggtattttaatattaacaattgagggtaaagcagttcatggcatggatccatctttaggtgttaatgcaggattgtttttacttaaatttttagcaagtcttaatctaaataaaagcgcaaaagatttcgtagaattcaatgagcgatacttatttgaatctcactttggtgaaaaaatgggtatgaagttccatactgatattatgggagatgtcactactaatatcggggttatcagttatgataaagaaaaagcaggcagttatggtattaatctaagatatcccgaaggatttaaatttgaagacgcaatcgatagatttagaagtgaaattaatgaactaggttttaatttagaacttggcaaagttcaaaaaccacactatgtcgataaaaatgatccatttgtaaaaacacttgtaaacgcatatagaaatcaaacaggtgatatgactgaaccatatacgattggtggaggaacatatgcgagaaatttagataagggtgtcgcatttggtgcgatgtttgcagattcagaagatttaatgcatcaaaaaaatgagtatataactaaaaagcaattgatcaatgcaacaagtatttatttagaagctatttacgctttatgtgtggaggattaa

SEQ ID NO: 2267 - DNA, 201 bp, Staphylococcus epidermidis
ggaatatttcgtgccattgcaagcaacatagctactgaatgttctgtagcagaaattgtattaccatcaggagcattaattactaaaataccttttaaagtcgctgcttctatattaatattatccacacctacaccagctcttgcaatgaccttcaaatttgttgcagcattaataattcgctctgttacttgggtttga

SEQ ID NO: 2268 - DNA, 189 bp, Staphylococcus epidermidis
agcattctgctgtttgagaaaataccactgttacatgaagaggcagcagctgttaaaacaacgaaattaattattcctgctgcaaacggtataccaattaatgcaaacaatctaacgaatggactattatctggatctactttatcccatggaataatggacatgatgactgctaatgcaccaacataa

SEQ ID NO: 2269 - DNA, 204 bp, Staphylococcus epidermidis
cccgaaggtcggtggttcaaatccgcctcccgcaatacatgttttattaggtctcgtagtgtagcggttaacacgcctgcctgtcacgcaggagatcgcgggttcgattcccgtcgagaccgccattacaattatggttcagtagctcagttggtagagcaatggattgaagctccatgtgtcggcagttcgactctgtcctga

SEQ ID NO: 2270 - DNA, 225 bp, Staphylococcus epidermidis
attggtatgctgctttacaattacgttcctcaaaacaaatggtctcagtggtttaaaacttatggcgttgaagaaagtgtcaatttgaataaacgtatgaaatggtacacagttattcaagcaataggtcttattcaatggtatgaagaacaaaaacgctatagagatatgaatacatggctgaaatttttaaatgaagtaatgaatagtaacttatttatataa

SEQ ID NO: 2271 - DNA, 972 bp, Staphylococcus epidermidis
ataatatttagaagtttaaagggagtaattaatatggaagtaaaaatgaatgaaataatggaagcattagaacaaagtgaattaattattattcacagacatctaagaccagatccagacgcatatggttcgcaattaggtttgaaatattacttacaaaagaagtttccaaacaaacaaatttatgcagtaggagctaatgaagattctttgaaattcataggtttgatggacgaaattgacgatgatatgtacaagaaagcgactgtagttgtatgtgatacggcaaatgcgccaagaatagatgaccaacgttatgatacaggtaccaaacttttaaaaattgatcatcatcctgctactgatcagtatggagatattaactatgttaataccaaagcttcttccactagtgaaataatttacgaattcattttacatttcaatgatgaacatatcattgatgaacaagttgctagagtattatatcttggcatcgtcggtgatactggacgttttttatttaataatacaacgccacgaacaatgcaaattactggaaaattacttacatatccttttgatcacaaccaagaattaaacaaaatgtctgaaaaggatccaaaactattaccatttcaaggatatatattgcaaaattttgatttaaatgataaaggattttgcaaagttaaaataactaaagacatacttgaaaaatttcaaatacaacctaatgaagcgtctttatttgtaaatacaatcgcagatattcgaggattaaaaatatggatgtttggcgttgatgaaggagatcaaattagatgtcggttgcgttctaaaggtcatattattattaatgatgtcgctaatacatttggtggtggtggacatccaaatgcatctggagtttcagtaaatagttgggagcaattcgagcaactcgccgaagctttaaacgacaagttataa

SEQ ID NO: 2272 - DNA, 330 bp, Staphylococcus epidermidis
tgtttatctaggaggcagtttatggctcggtcaaaaaagtacttttatcttagtctattaatgataattttaagttttttctttaataccaataattcattattgagtaatatatttcaatcgtttatgaaaattgttgtagttacaagtatcgttaatattataatacttattttatcgattgtttttgccgataaatctataaagtatgctaaggaaagttcagattggattagatttgcaagcaaaatattaccattgattattttaatcactattattatccatattctttcatctttacatacttttggttacatttttaaataa

SEQ ID NO: 2273 - DNA, 156 bp, Staphylococcus epidermidis
tgcaagtctagttggtttctccattttatcccctcaaatttagcattttatcattattatacatctcattctttgtttttaaaaactcacaatgtcgatgttattaaaactttcaaaataaaacaagttatagagtcgtgcaaatatatgatatga

SEQ ID NO: 2274 - DNA, 123 bp, Staphylococcus epidermidis
attcacactagatcagccactaacatcaaaaacaatattagtgggtcgcaggctcaatttactgccggttgggaatttcaccctgccccgaaagaaatatatgaaattgttatgattaattga

SEQ ID NO: 2275 - DNA, 420 bp, Staphylococcus epidermidis
aaaacttatagtcgtaaagcaaatgaaattatcttggctacacgggtcgaaaatttattatcaaaagatgaaatcatatatacgtatttaaatatcgtcccatttggtcatgactacaacggtgccaatataactggtatatcgtctgcttcatatagtctgtttggtatacctgcaaaagatttgaacattgcacaatcagcttatctcattggcttactgcaaagtccatacggctatacgccttatgacgaacacggcaaagtaaagccttaccatcttttaaaattgagcatgaaacgtcaacaatacgtacttaaacgtatgcgtgttgaaggaaaaatttctaaacaacaatacgaaaacgctaaaaaatacaatattaaacagcacttgctgaaacaatcgaaagacgaataa

SEQ ID NO: 2276 - DNA, 1386 bp, Staphylococcus epidermidis
atgtcagtcagaattgaacatgatacatttggagaaattgaagtaccagaagacaaatattggggtgcacagactgaaagaagtaaacgaaattttccagtcggcaaagagcatatgcctatacaagtcatttacggatttgctcaactaaaaagaggtgcagccttagcaaatcatgaattaggaaaattgagtgatgaaaaaaagaacgccatcgtttatgcttgtgatcgtattttaaatggagaactagataatcattttccacttgtgatttggcaaacaggtagtggtactcaaagcaatatgaatgtaaatgaagtcgtaagctatgtagctaatgaataccttaagaaacatggaagtaaggaaactatccatccaaatgatgatgtaaataaatctcaaagttcaaatgatacatttcctacagctatgcatgtcgcattgttccatgaagttgaaactaagttagagccagcacttaaccatttacgtcaaacttttaaagaaaaagaagaccaatatcaatcaatcattaaaattggacgcacacatttgcaagatgcaacgcctattaaactaggtcaagagataagtggttggcgctatatgttagaaaaatgtgagcaattactatcagaatcaaaaaagcatattttaaatttagcaattggtggaactgcagtaggaacgggaattaatgctcatccagaatttggtcataaagtagccaaatatatttcccaaaacacagggtatgctttcgtatcatctgaaaacaaatttcatgctttaacttctcatgatgaaattgtacaattacatggaacattaaaagcgctagcgacagatttaatgaaaattgcaaatgatattagatggctagcctctggaccgcgtgcaggtcttgctgagatttcaattccagaaaatgaacctggatcttctattatgccaggaaaagtaaatccaacacaatgtgaaatgttaactatggtagcagtacaagtcatggggaatgatacgacggtaggtatcgcaagttctcaaggtaattttgaactaaatgtatttaaaccggtaattatgcataacactttacaatctatttacttattagcagatggaatgaatacctttaataaaaactgtgcaattggtattcaaccgatagaagaaaatattaataattatttaaatcaatcattaatgctagttacggcactgaaccctcatattggatatgagaaagcagctcaaatagctaaaaaggcacacaaagaaggacttactttaaaagaatctgcaatagaaagtggatatgtaactgaatcacaatttgaagagtggataaaaccagaagatatggtagacccacattga

SEQ ID NO: 2277 - DNA, 207 bp, Staphylococcus epidermidis
aatctggtcagaaagtcgttgttgcaaaaagttggggccgttatgccaagcggaatggtaattaaagatgcccaattacgtggggtagattctagtggtatgatttgctcaatgaaagaattaaatttgcctaatgctcctaaagaaaaaaggaattatggtaccttaacaatgactatgatattgggtcaggcaatttttgaataa

SEQ ID NO: 2278 - DNA, 630 bp, Staphylococcus epidermidis
  modified_base (616)..(616): a, c, g, t, unknown or other
aatatatggctcacgaaaaactatttcttgagccattttctagttgaaagtgaggtgaacgtgttggagcagttttatcagttagggtggacacttgattcggcaggaggagcttctggtgaagcatatatggctgaacaagatggacaaaaattatttttaaaacgaaattcaaatccttttattgctgcgctatctgcagaaggaattgtacctaaacttgtttggacgaaacgtattgaaacaggtgaagtagtaacagctcagcattggaaaaatggcagagaattaaatgaagatgaaatgaaccaaacaagagtcgctgaactactacataaaattcacggttcaagacctttattaactatgctaaagcgtatggagatggaacctattacgcctgacattatgttgaataaaattaacgcatcactttcaagagaagttttgacacatcatgttgtgagaagagctttaacttaccttgaagatcatttaccgaatttagaaccccgtttctttactgttgtacatggaagagttaaacataacaactggttattatcagaatcggatgaactttaccttgtggattggggaaggtgcatgattgccnaaccagcgaattga

SEQ ID NO: 2279 - DNA, 129 bp, Staphylococcus epidermidis
aaacggaacagttcaaaaactctttcattttgtttttttagtgtaatgagattatattacaactataattcattcggtaacttccatagtaaatatggtggttgccgttttttaattcaacaaacataa

SEQ ID NO: 2280 - DNA, 234 bp, Staphylococcus epidermidis
aatatctgcagtatattctgctactttttcactattatcaaatactttaaaattcattgccatgttaactacactcctctaagtttgctcttttatttaagtcgatttaatttaaagtataccctttgtattaattatcaaactattattttttattggctcacaattaatataacatttcttgggtttatcttgcatttactttatctattagcgttaattatgaaaggttag

SEQ ID NO: 2281 - DNA, 1230 bp, Staphylococcus epidermidis
atgtctttaagagatgacgctttagaaatgcatagagagaaccaaggtaaactagaaattacaccaaatgttaaagtgacaaataagcaacaattaagcttagcatactcacctggcgttgcagaaccttgtaaagaaatccatgaagattcaagaaaagtatatgagtacactattaaaggaaatacagttgctgttgtaacggatggaacagctgttctcggtttagggaatattggagcagaagcaagtattccagtaatggaaggaaaggcagcactgttcaaaagttttgcgggtattaatggtgtgccaatatctctagatacaactgacactcaagaaatcataaaaacagtaaaacttattgcaccaaactatggtggaattaatcttgaagatatatcagctccccgctgttttgaaattgaagaaaccttaaagaaagagaccaatatacctattttccacgacgatcaacatggtacagctattgttactatggctgggttaatcaatgctttaaaaattgtagataaagagttaacgaatataaaagttgtattaaatggtgcaggtgcagcaggtatcgctatagtgaagttacttcatgcttatggtgtgaataatatgattatgtgcgattcaaaaggtgctatttattctggcagaaattttggtatgaatgatacaaaaacatatgtagctaagtggacgaataaagataaagttgaaggttcacttgaagaagtgattaaagatgcagatgtttttataggtgtatctgtagcggatatattaactcaagatatggtgaagacaatggctgatgatccaattatttttgctatggctaatcctaatcctgaaatcaatcccaatgaagccaaacaggcaggtgcaaaggttgtgggtacaggtcgatctgattttccaaaccaaattaataatgtattagcatttccaggtctttttagaggtgcattggatgttgaagccactcatattaacgaagatatgaaaaaggcagctgtagaagctatcgttcatttaatagacgaaaatgagttacatcctgattactgtataccaggaccgtttgataaaagagtagctccatcagtagccaaaaatgtagctaaagctgctatggaatccggtgtagcaagaattaaaattgatacacaagaaatatttgataaaactatgaaacttactgacttaaaatag

SEQ ID NO: 2282 - DNA, 1806 bp, Staphylococcus epidermidis
attagcaaaagaattatcaatttaaatttatttgggaggattataaaaatgagaaagactaaaattgtatgtacaataggaccagcttcagaatcagaggaaatgctcgaaaaactaatgaatgcaggaatgaacgttgcgcgtttaaatttctcacatggtagtcatgaagaacataaagcaagaattgatacaattcgtaaagttgctaaacgtttaaataaaacaattggcttgttattggatactaaagggccagaaattcgtacgcacaatatgaaagatggacttattgttttagaaaaaggcaaagaagtcattgtcagtatgaatgaagttgaaggaacacctgaaaaattctctgtaacatatgaaaatctaatcaatgatgtcaatattggatcatatatactattagatgatggtttagttgaacttcaagtcaaagaaattaacaaagataaaggcgaagttaaatgtgatatcttaaatactggtgaattaaaaaataaaaaaggtgttaacttacctggtgttaaagttaatttacctggtatcactgataaagatgccgatgatatcagatttggtataaaggaaaatgtagactttatagctgcaagttttgtaagacgtccaagtgatgttttagatatccgtcaaattcttgaagaagaaaaagcagaaataacaattttccctaaaatcgaaaaccaagaaggtatcgataatattgaagaaattcttgaagtatctgatggattaatggtagcacgtggtgatatgggtgttgaaattccaccagaaagcgtaccaatggttcaaaaagatttaattagaaaatgtaataaattaggaaaacctgtaattactgcgactcaaatgcttgattctatgcaacgtaatccacgtgcgacacgtgcagaagcaagtgacgtagctaatgcaatatacgatggtactgacgctgtaatgttatcaggcgaaactgcagcaggtcaatatcctgaagaagctgttaaaactatgcgtaatattgcagtttctgctgaagcagcgcaagactataaaaaattattaagtgatcgtactaaattagttgaaacttcattagtaaatgcaattggtgtttctgttgcacatactgccttaaacttaaatgtaaaagctattgtagcagcaactgaaagtggttcaacagcacgtacgatttctaaatatcgtccacattcagatatcattgctgtaacacctagcgaaaaaactgctagacaatgtgcaattgtatggggagtaaatccggtcgttaaagaaggacgtaaaacaactgatgctttactaaataatgctgtagcaacagcagtagaaactggtagagtttcaaacggagatttaattattattactgctggtgtacctactggagaaaaaggaactacaaatatgatgaaaatccacttagtaggtgatgagattgctaaaggccaaggtgttggtagaggatctgttgtaggccatgcaattgtcgcagatagtgctagtgatttagaaggtaaagatttatctgataaagttattattacaaattctgttgatgaaacattagtaccatatgttgaaaaagctataggtctaattacagaagaaaatggtattacttcaccaagcgcaattataggtttagaaaaaggcatacctactgttgttggtgtagaacaagcaactaaagaaattaaaaatgatatgttagtgactttagatgcgtcacaaggtaaagtgtttgaaggttatgctaacgtcctttaa

SEQ ID NO: 2283 - DNA, 216 bp, Staphylococcus epidermidis
gttttaaaaagtgaaaggcttaatgcgccgatactacccattaaaaaagcacctaataaatttgcaacaaatgtccccaacggaatggttgaaccttcattaagcattgataaacagaatcttatcaatgcacctaaagcaccacctacaaaaatatatagatattgcatctatatttcacctcaaaatataaaagagttgattattattatttaa

SEQ ID NO: 2284 - DNA, 924 bp, Staphylococcus epidermidis
ctaatgaaaagtttcagaaatatcatgggcgattctcaaaatctagataaacgtatacaaaaaataaaacaaaatgtaatcaatgatactgacgttaaacattttcttgagaaaaatcgtagtaatataactaatgagatgatagacgaagatttaaatgttcttcaagagtataaagatcaacaaaaagtttatgatggacatcgctatgatgattgtccgaattttgtaaaaggacatgttcctgaactatatattgaaaatgaaagaatcaaaattagatatctaccttgcccgtgtaaaattaaacatgatgaggaacgatttgattcacaacttattacatctcaccatatgcaaagagatacacttcatgcaaagctcaaagatatttatatgaataatcgagagagacttgatgtagcaatggcagctgatcaaatctgtacagcaattactaacgatgaaaaagtaaaggggttatatttatatggtccttttggtacaggaaaatcattcatattgggtgctattgcaaatcaacttaaatcgcaaaagatttcatcaacaattgtatatttaccagaatttattcgcactttaaaaggtggctttaaagacggtagttttgagaaaaaattacaacgtgtgcgagaagctaatattttgatgttagatgatattggcgcagaagaagtcacaccgtgggtaagagatgaagtgattggtcctttattacattatagaatggtacatgaacttcctacattttttagttctaactttaattatagtgagcttgagcatcatctttcaataactagagatggcactgaaaagactaaagcagcacgaattattgaaagaattaagactttatcgacaccttattatttgactggtaaaaattttagaaacaattga

SEQ ID NO: 2285 - DNA, 1017 bp, Staphylococcus epidermidis
atgagggaaagaataatgaaagttaaggcaatcaatctatatacttataaggaaccttttaaatcaccaatttcaacaccgaaagtgaagttaacgcatcgagaaagtttgtttacggaaatagtaacttatagtggagaaacttattatggagaatgtaatgcatttttaactaattggtatgataaagaaacaatactcacagtcgtaaacagattaagacagtggataccgcaagtacttcataaagatatgacatcttttgattcatggttaccttacctaaatcaaatgaatgatgtgccagctgctagatcaatggttgtcatggctgtttatcaaatgtataacgacttgcatgattttgaagtacaatacggtgctacagttagtggcttaactaatagtcaaattgaaacattattagaaacaagaccgaaacgtataaaacttaaatggtcaacatcactcatcaaagatcttgaaactatacgtttattaaattttgattgtgatattgctatagatgcaaatgaatcattaacaaagccatcatttttacaattagccaacgtaaatacatcagatattatatatattgaagaaccttttaaaattctagaagatttaaatgatattgatatgtctatttttcctagaattgccatcgatgaaaaggcactttctatagaaaaaatacaatcaataattcagcaatatcccatacaagtcgtcgtgttaaaaccatttagacttgggggaatagatagaatgttaaacgccatgaaaattttgaaagaaaaaaatataaggtttgtagttgggggcatgtatgagtttggtctaagtagatattttacagcaatgttagctaaagaaggaagttatccgggtgatattacgccacacggttattatttttctaacgatatcgtagagacaagtggcatattaaaagggggaatgatttatttcactccccctaaagtcaaacgttctttacttaacaaagtttaa

SEQ ID NO: 2286 - DNA, 963 bp, Staphylococcus epidermidis
attacaggaaggcgggaaaaaatgagaaatgtagaaaaattaaatcccggcgactcagtggatcattttttcttgatccatcgtgcaactcaaggtgttacagctcagggtaaagattacatgacactatttctgcaagataaaagtggtgatattgaagctaaattatggactgctacgaaagatgatatgcaaactttaaaaccagaaacaatagttcatgtcaaaggtgatatcatcaattatcgtggacgcaaacagatgaaaatacatcaaatacgtcttgcacaagctgaagacaaagtgtcaactaaagactttgttgacggtgcgccaatgtcacctacagaaatacaagaggaattatcgcattttatgttagatattgaaaatgctaacttacaacgcattactagacatttaattaaaaagtatcaagatcgttttttcacttatccagcagctagttctcatcatcataatttcgcgagtggattgagttatcatgttttaacaatgttgcgtatagcaaaatctgtatgtgatatttatcctctgttgaatagaagtctattatatagtgctatcattttgcatgatttaggtaaagtaagagaattgagtggtccagtggcgacgacctatactgttgaaggaaatttacttggtcatatctctatagcaagtgatgaagttgctgaaacagccaaagagttaggcattgatggagaagaggttatgttacttagacatatgattttagcgcatcatggtaaaatggagtttggatcgcctaaattgcctcatttaaaggaagctgaaatactttactttatagataatattgatgctaaaatgaacatgtttgataaagctttcaaaaaaacagaaaaaggtcaatttacagaaagaatttttggtttagaaaatagacaattttataatccaacaacacttgattaa

SEQ ID NO: 2287 - DNA, 654 bp, Staphylococcus epidermidis
ttaatgatgagagttcgttacaaaccgtgggccgaagattatttaaagaaccatcctgatttagtagacatggatggtgctcacgcaggtaaaatgtctgagtggttcgaaaaagaacaaccgatttatattgaaattggttcaggaatgggacaatttataacaacattagcagcacaatatccagagattaattttgtatcaatggaacgtgaaaaaagtgtgatgtacaaagttcttgataaaacaaaagaaatgggtcttaaaaatttaaaaatgatttgtaatgatgctattgagcttaatgagtatttcaaagataaagaaatatctagaatttacttaaatttttcagatccttggcctaaaaagcgccatgcaaaaagacgtttgacgtatcatacataccttgcattatataaacaaatacttaaagatgacggtgaaattcattttaaaactgataatcgtggtttgttcgcatttagtatagaaagtatgtcgcaatttggaatgtactttactaaaatgaatttaaatttacacgatgaagatgatgaagataatatagtgacagaatatgagaagaaattctctgaaaagggatctcgtatttatcgaatggaagctaaatttcataaatgtttcgaatag

SEQ ID NO: 2288 - DNA, 483 bp, Staphylococcus epidermidis
gaggaagtgaggaacgtggagtttgaggataaagatggaaggattgtaacattgaactataaaaatgaaaatgatatgcctaatggcaatcacgttcttgcaattccggtatacaataatcagttattatttacaaaccatcaacatcgtgggatagagtttcctggtggtaaagttgaaataagcgaacaaagtaaagaagcagtaattagagaactatacgaagagacgggggcaatcgcaaaatttatctattattttgcacagtatagtataaaaatggagcatgatgagccgtttataaaggacgtttacttcgttgaagtaagtcatttggaatatgtagatacctattacgagactttaggcccttgtctttatcatcaaattaatgatattcctttaaataaaagaagttttttaatcaatgataaggcgattcttcattgtttggaaagggtgaaaacacttggattttattaa

SEQ ID NO: 2289 - DNA, 462 bp, Staphylococcus epidermidis
ttaaattggaggtcaattcatatggttagacatgattttaaagttaaaactgaatggctaggtggacgcgaagaagtaggtaaacttcgaggagatattatcaatgaaaatatatccatcccctcttcactcggtggccaaggagaaggcacaaatccagatgaattactagtaagtgcagcatcatcttgttacatcatttcactcgctgcaacactagaaaagagtggttttactaatgtaaaaattaatcaacagtcaataggtacagcctcgtttgaaaataaaaaatttaaaatggaacgtattacacattatccctcaattaaagtaccctcttctcaaacagaaaagcttaaaagtattttagataaattattagtgattgcagataataattgtatgatatctaatgcaatacggaataatgtcattatttcaattgaacctaatttaatataa

SEQ ID NO: 2290 - DNA, 759 bp, Staphylococcus epidermidis
agtcaatggaggtgccttatgacagtaaaagttgaacatcttacagggggatatggaaaaaaacctgtaattaaagatttgaattttgaattagaaaaaggtgaaattgtaggtttaataggtctaaatggtgctgggaaaagtactacaattaaacatatgctaggattgattaatccaatggaaggcaaattatcaatttcaaatattaaaattaatgaagatattgaaaattatagaagaaagttatcttatatacctgaatcaccagtcatctatgatgaactaactttagaggagcacattgaaatgacggcgatggcttatcaattaagtagagaagaggttatgcgtagagctaaaccattacttaaagtttttagattagaaaatgaacttaaagtatttccaagtcatttttctaaagggatgaaacaaaaagtgatgattatttgtgcatttatagttgatccagaattatatattattgacgaacctttcctcggtttagatcctttggggatacagtctatgttagatttaatggtagaaaaaagaaatgaaaatcgaacagtattaatgagtacacatattttggctacagccgaaaggtattgtgatagatttattattttagataaaggtgaaattgttgcatttggtaatcttgatgagttacgggaacaaacaggattaaaagataaaactttagatgatatttacatccatgtcacacaaggtagtagtgcttatgaataa

SEQ ID NO: 2291 - DNA, 1278 bp, Staphylococcus epidermidis
acaaatgatggaggacaatgtcttatgtcaaaattaattttggcggtaaatgctggtagctcatctttaaagttccagctaattaagatgcctgaagaaaaactagtaactaaaggtgtgatagaacgtattggtttaagcgattctatcttcaccattcatgttaatggcgagaagcttactgatatcagagatatccataatcatgaagaagccgttaatataatgttagatagttttaaagaacatgaaatgattaaagacatcactgatattcaaggaacaggtcatcgtgttgtacacggtggtgaaactttccctaaatcagttgttgttactgatgaagtagaatctcaaattgaagaattaagtgaattagcacctttacacaatccagctaatttaatgggaattagagcttttagaaagttattaccagaaatcccacacgttgcagtgtttgatacttctttccatcaaactatgcctgaacaagcttatttatatagcttgccatatcattactatgaagactatggcatacgtaagtatggtttccacggtacaagtcataaatatgtatctcgtagagctgctcaaattgttggtagaccaattgaagatttaagaattatttcttgtcacatcggtaacggtgcatctattgcagctatagatggtggagaatctattgatacatctatgggattcacaccacttgctggtgtaacgatggggactcgttcggggaatcttgatccagcattaataccattcattatggaaaaaacgggtaaaacagctgatgaagttttagaaatacttaataaagaatcaggattattaggtcttactgggacatcaagtgatttgcgtgatttaactgaagaagctaaacatggacgtcaacgttcccgtgttgctctggatttatttgcttcaaaaattcacaaatatattggctcttatgcagctagaatgcatggtgtagatgttattgtatttactgcaggaataggtgaaaattcacatattattcgtggtaaagttttagaaggacttgagtttatgggtgtttattgggatcctaagaagaatgaaagtttacatggtgaagaaggttatattaactatccacattcacctgtaaaagtacttgttgtacctactgatgaagaagtaatgatatctcgtgatgtgattaaatatggtaaacttaatgataatacacccaaaaaagaagaatttgataccaacgaaagtatcgaagtgaattaa

SEQ ID NO: 2292 - DNA, 126 bp, Staphylococcus epidermidis
cgaagggaaggaggtgcatatatgattttagatatctttgtacacatcatcaccactgttattagtggttgtatagttgcgttgtttacgcattggctacgtcaacgtaatgacaaacatcgatag

SEQ ID NO: 2293 - DNA, 171 bp, Staphylococcus epidermidis
gtggtggagggacatggacccaatgaaacccagcaacctctttatttaaagaaaggtgccaaaccgtttgcagacaaatatggtctgaacgataagagcgaatggacgtttaagagccttctctctatctatatagtgaagaaggctcttttatttagctctcatatttaa

SEQ ID NO: 2294 - DNA, 600 bp, Staphylococcus epidermidis
agtgtttttatttacaatagaattaataaaggagtgagaggaaagatgacagacattataattgtacactcaaaacatggtaattctaaaaatcattggtacgaatggttaaggcataatttaactttggaagggtatgatgtttctttattcaatcttgaagcaaatgatcatgctcaaattgatgagtgggttaatgaaatgaaacaacaactacatatccgtaaaaaagatacatattttgtgacccacggatttggctcaatcgctgctttaaaatttcttgaagaaacgcatcatcacattgaaggtttctttagtatcgcaggatttaaagaagatgcacaagatatagacgaagatgtagatttaaaaggggtaaccatcgattacgataaaataaaagagcaagtagataaattttatggactcacgtctaaagatgatcaatatgtttcatacaaggaaacacaaaggctgatgaattcacttaatggacatacacgtgtagtagaagatgggggacactttttagaagaggaaggttttgtaacatttacttctttaattaacagaatgcaaggatatatgactaggtag

SEQ ID NO: 2295 - DNA, 540 bp, Staphylococcus epidermidis
tgtataattattaaaaaggaggtcaaaacaatgaagtgtttgttcaaaatgctatcaatcataataataatgttaagtactttcaccttattcatcagtccgagtacatatgcaaatgaagatgaaaattggactaaaataaaaaatcgaggagaactaagagttggattgtcagctgattatgcacctttagaatttgaaaagacgatacatggtaaaactgaatatgcgggtgtagatatagaattagctaaaaagattgcgaaagataatcatctaaagctaaaaattgtaaacatgcaatttgatagcttattaggtgcacttaagaccggtaaaatcgatattattatctccggtatgacaacaactcccgaacgaaaaaaagaagtggattttacaaaaccttacatgattacaaataatgtgatgatgattaaaaaagatgatgcaaaacgttatcaaaacatcaaagattttgaaggcaaaaaaattgctgcgcaaaaagggacagatcaagcccacccttgcacaaactga

SEQ ID NO: 2296 - DNA, 1458 bp, Staphylococcus epidermidis
agtcggtatatggcgtattttaataaatttttaagcaattctgaaaggaagcgtggaaaagtgagtaagaaagtggcaattattggagcgggaatcactggtttatctagcgcatatttcattaaaaaacaagacccttctattgaagtaactatcttcgaagcctcaaatagagtaggtggaaagattcaaacatatagatcagatggttacacaattgagttaggccctgagtcttatttaggtcgtaagacaattatgactgatgtggcaaaagatattggattagaaaatgaccttataacaaatactactggccaatcttatatttttgctaaaaataaattatatcctattcctggtggctcaattatgggaattcctacagatattaaaccatttattaaaacaagactcatttcacctattggtaaattaagagcggggcttgatttgtttaaaaaaccgatagaaattgaagatgatatttctgttggtagtttctttagacaacgattaggtaatgaagtattagagaacttaattgaaccactaatgggtggtatttatggcactgatattgatcaattgagcttaatgagtacatttcctaactttaaggaaaaagaggaacaatttggtagtttgattaaaggaatgaaagacgaaaaagaacaacgtattaagaaacgtcaattatatccaggtgctcctaaaggacaattcaaacagtttagacacggattgagttcttttatagaggctcttgttaaagatattgaaagtaaaggtgtccacatacgatataacacgccagtcaaagatatattgatttcgcaaaaagattatgaaattttattagaagatgacagtaaagagaaatttaatggcttacttgtaacaacaccacatcaagtatttctgaactggtttagtcacgatccagcatttgattactttaaaaacatggattctactactgtcgcaacagttgttttggcctttgatgagaaaaatattaccaatacgtacgatggaactggctttgttattgcaagaacaagtcaaacggatattactgcatgtacttggacatcaaagaaatggccatttactactccagaaggtaaagttttaattcgagcatatataggaaaaccaggtgatactgtagtagatgatcacaccgatgaagaaatagtatcaattgttagaaaagacttaagccaaatgatgaccatctcagggaatcctgattttacaattgtaaatcggttacctaagagtatgccccaataccacgtgggtcatattaaaatgattaaagaaattcaacaacatattaaaacaacttatcctagattacgtgttacaggggcaccgtttgaagctgtcggtttaccagactgcatacaacaaggtaagaatgcagttgatgaaatattagaagagttataa

SEQ ID NO: 2297 - DNA, 351 bp, Staphylococcus epidermidis
actaatgatatgaattatgtaagaggagaatttgtgatgaagtcagttaattttaaaaaaataactatattgtttttttctacagcttttttaatattaatcttttctctcatttttttgacgaagaaaaaactgtataacgccgaattattactaaatgaagtcaaaacttattttagagaagtaaaaggttcctatattgtgcaagaaccaatcgttttagaaaatataaatcataatcaaccaatataccaaggtggtatcacagtattaaaaaatgaccatcttattaattatgaattttatgcagatgctgtgtcaggacaaatcattgatataattgaactctga

SEQ ID NO: 2298 - DNA, 474 bp, Staphylococcus epidermidis
ataaatagtattgatagacagagtttcacagatttaattcaaacaaaatttaagatggtccgtatagaagcaggctatactcaagatacaatggcacaaaccattggactttccaaaaaaacattggttcaaattgaaaaagaaagagttctaccaaactggactacatgcgtatcaatttgtgctttattcagagattcagatgtattaaatagtacattcggttgtgatccgctcgaaattgtacaaacaatttctagaaaccattgtgcttatccaaatcactcaacaacaagtgatatttactggaatactattgatacacgtaatggtttcattttacaaagtaataaagtaagtaacatttatcgtgttctcaataatgaaaaacagccaatctttggtacttcaaaaatgagggaagctgaaacttacttcaatagaaatgctaaagaagaattaatacacgtataa

SEQ ID NO: 2299 - DNA, 1329 bp, Staphylococcus epidermidis
gtaaggagtattgaaatgacacactatcattttgtcggaattaaaggctcaggcatgagttcattagcacaaatcatgcatgacctcggtcatgaagtacaaggttcagacatagaatcatacgtttttacagaagttgcattaagaaataaagggattaaaattttaccttttgatgcaaataatattacaaaagaaatggttgtcatccaaggtaatgcatttcctgataatcatgaagaaattgttagggcacatgaattaaagcttgatattataaaatatcatgactttcttggtcatgttataaatcaatatacatctgttgctgttacaggtgcacacggtaaaacgtctacaactggtttgttgtcacatgtgatgaatggagataaaaagacatcattcctaatcggtgatggtacaggtatgggactaccaggaagtgactattttgcttttgaggcttgtgaataccgtaggcacttcttaagttatcatccagattatgcaattatgactaatattgattttgaccatccagattattttaaaaatatcgatgatgtttatgatgcattccaacatatggcgttaaatgttaagaaaggaattattgcttggggtgatgatgaatatttacgtaaattagatgtagatattccggtttattattatggctttaaagaaacagatgacatctatgctaaaaatattcaaattactgaaaagggtacgcaatttgatgtatatattaaaggcgaattttatgatcaattcttatccccacaatatggaaatcacaacattctaaacgcacttgctgtaatagcaattagttatttagaaaacatgaatgtagaaaatattaaagaagcactgataacatttggtggtgtaaaacgtcgttttaatgaaacaaaagtatcaaatcaagtaatagtagacgattatgcacaccatccaagagaaattagtgctacaattgagacagcgcgaaaaaaatatccgcaaaaagatgttgttgccgtttttcaaccacatacgttctcaagaactcaagcatttttaaacgaatttgctgagagtttaagtaaggcagaccaagtatttttatgtgaaatattcggttcaataagagaaaatacgggagatttaactatagaagatttaatcaatcgtattgacggctcgacgcttatagatgaaaatagtattgatgtattagaaaaatttgataacgctgtaattttatttatgggcgctggtgacattcaaaagttactaaaagcttatttcgaaaaattaggcgtaaaaaatgatttttaa

SEQ ID NO: 2300 - DNA, 198 bp, Staphylococcus epidermidis
ttgtttttcattacgaagttttattctgttaatttagtaacattaaacattatcagttacagtttaaattctctttattcctattggaatgttagaatgagtgagttttgtagcttcatctatttcccttcaatctatagtttattattcggtgaaatatctcggaaaaagtatttaacaatttcggtactcatataa

SEQ ID NO: 2301 - DNA, 240 bp, Staphylococcus epidermidis
ttaggtttcatcactagtaaaaaagacatggactatataactaagaacatcaacagttttactaagagacttgcagaggctatcaatggtagacaaataaacgcactaaaaagcaacccatctagcaaaaagataacttggaactggggaggtactttctaccctaacgcacctaaaagtggtattagagttagaaggtcgctaggtatcaatggcgctattgttgaaagtggctcgtga

SEQ ID NO: 2302 - DNA, 441 bp, Staphylococcus epidermidis
aggagtgtcattattatgtcagaaacgatattcagtaaaattatttcaggtgagattcctagttttaagatatatgaaaatgattatgtttatgcattccttgatatatctcaagtttcaaaaggacatacgctattagtacctaaaaaaccttcagcaaatatatttgaaactgatgaagaaacaatgaaacatataggggttgctttacctaaagtagcaaatgcaattaaaaacgcatttcaccctgacggcttaaacattattcaaaataatggtgaatatgccgatcaatcagtatttcacattcatttccatttaataccgagatatgaaaatgatatagacggatttggctataaatgggaaacacatgaagatgtaatcgatgatgaaactaaacaaaaaatagcaacacaaattcaagcacaaatatcttaa

SEQ ID NO: 2303 - DNA, 159 bp, Staphylococcus epidermidis
aacgtttacatgtttaaaatttgtgatagctatatgatttatattaaattaggttcaattgaaataatgacattattccgtattgcattagatatcatacaattattatctgcaatcactaataatttatctaaaatacttttaagcttttctgtttga

SEQ ID NO: 2304 - DNA, 207 bp, Staphylococcus epidermidis
tctttatacataaggcacctcgttaattttgtttattggtatttattaaattatgcgaaaggtccttatttttcaaagtattttaatgtaaaattacatataaactcaaagtattttggcgagactcttgagggaacaggacaagctgaagactacaggctgaagctgtcccctaagaaagcgagccaacaaaacgaagtattgtaa

SEQ ID NO: 2305 - DNA, 636 bp, Staphylococcus epidermidis
gcaggtgacattatgtacaattttataagtaagattttagatgttattttagtgaaaatgtctaaatcattatatgttattggtaaggaaaatattcctaaagatagtaaatatgttgtaacttgtacgcatgaaagttataacgaagtaatcatgttaggaatggcattactacctaatcaaatccattatatggctaaaaaagaattatttaagaatcagtgggctggtaaatttttgaaatcactaaatgcatttccagttgatagagaaaatcctggtccaagtacattaaaaaaaccagtgaatttacttaaagaacataaaactataggtattttcccaactggtcatcgtacttcagtagagggagccccattaaaacgtggtgcagctactatagcaatgcttgggaaagcacctatcttaccagcagcttatgtgggtccaaaaaaaattcatggtttgattacaggtcaagcattaatcaaaattggtaaaccaattgagatggatgatattccaaaggatttgaagcggaacgagaaagttgatttcttaaccaaagaaatcgaaagacgcacaactcaattacaaaaagaacttaatgaaatttcatgtagtttaaagaaatag

SEQ ID NO: 2306 - DNA, 153 bp, Staphylococcus epidermidis
gcctgggacataataattgttccaggctttcttatttatattttattatttttaaatccatggattcttcatcgactgtcaacaaacagatatggtaaaatgaaagaatataaggtaaagttatttctcatcattcatactgtaaaattttag

SEQ ID NO: 2307 - DNA, 1116 bp, Staphylococcus epidermidis
catttaagcatattaaaatacttaattaagtgcaatatgctatcattggtaagaatgattcaattgtggggggactcaagggtgcgcagcaaaaacgatacaattttaaaagctataaaaggagaaagtacgtcacatacacctgtttggtttatgagacaggctggacgttctcaacctgagtatcgaaaattaaaagaaaaatattctctatttgaaatcacacatcaaccggaattgtgtgcatatgtgacacatttaccagtagataattatcaaaccgatgcggctgtattgtacaaagatattatgacaccactcaaaccaattggtgtagatgtcgaaattaaatcaggaataggacctgtaatttccaatcctattcaaactgttaaagatgtagaaaggctatcccaaatagatcctaaaagagatgtcccatatgtattagatacaattaagttactcactgaagaaaaacttaatgtacctttaataggttttacaggagcgccatttactttagcatcttatatgattgagggagggccttcaaaaaattataattttactaaagcgatgatgtatagagatgaggaaacatggtttgctttaatgaaccatctcgtcgacatttctattgattatgttgtagcacaagtggaagcaggagcggaaatcattcagatttttgattcctgggttggtgcactcaatgtgaaggattatcgctattatattaagccagccatgaataaattgatttctggcattaaagcttattatgatgtacctatcattctttttggtgtcggtgcaagtcatttaattaatgaatggaatgatttaccgatagatgtactaggccttgattggagaactacaataaagcaagctgacaaaatgggagtcaataaagcaattcaaggtaatttagacccatctgtactgttagcgccatgggatgtcatagaatcacgactcaaagacatattaaatcaaggtttaaatcgtggaaagcatattttcaatttaggtcacggtgtatttccagaagttaaaccagaaactttgcgaaaagtgactgaatttgttcataattatacagcgaaatag

SEQ ID NO: 2308 - DNA, 129 bp, Staphylococcus epidermidis
ttaaatggcatttcatcctcaaactcatctcaattgattatgtttgttgaattaaaaaacggcaaccaccatatttactatggaagttaccgaatgaattatagttgtaatataatctcattacactaa

SEQ ID NO: 2309 - DNA, 570 bp, Staphylococcus epidermidis
ttattattaattaaatattctgtttattatgttaaaatagaattaagaaagataaagggggcaataatgatgatttcttataaaaacatattaatcgcagtcgatggatctcacgaagcagaatgggcttttaacaaagctgtcggtgttgctaaacgtaacgatgctcaattaactattgtgaatgtaattgactcacgtacgtattcttcttatgaagtatacgatgctcaattcacagaaaaatcaaagcatttctccgaagaattacttaaaggttataaagaagtagccacaaatgcaggtgtaaaaaatgtggacacacgtttagaattcggctcacctaaagcaattatacctaaaaaattagcgcgtgatgttggtgctgatttgattatgagtggtacatcaggtttaaatgcggtagaacgttttattgttggctctgtatcagaagcgattgttcgacatgcaccttgtgacgtattagttgtgcgtacagaagaaatgcctgaagatttccaacctcaagtagcaacacctcaattacgtgaaaaatatcaagattag

SEQ ID NO: 2310 - DNA, 867 bp, Staphylococcus epidermidis
ggagtgttaataatgaatgtcttccaaatgagagataaattgaaagcgcgtttaaaacatttagacgtagaattcaagtttgatagagaagaagaaacgttacgtattgtaagaattgacaatcacaaaggtgtaacgattaaacttaacgctatcgtcgcaaaatatgaagaacaaaaagaaaaaattatagatgaaatttgttattatgtcgaggaagcaatcgctcagatgggtgatgaagtgattaataatgttgaggacatacaaattatgccggttataagagctacaagtttcgacaaagaaactaaggaaggtcatgcatttgtgttaacagaacatactgctgaaactaatatatattacgctcttgatctagggaaatcttatcggctaatagatgaaaatatgttacaaacgttaaatttaactgctcaacaagtgaaagaaatgtcactatttaatgttcgtaagttagagtgtcgctatagtacggatgaagttaaaggtaatattttttacttcatcaacacaaatgatggatatgatgcaagtcgtattttaaatacttcttttttaaatcatattcaacaccaatgtgaaggtgaaatgcttgttggtgtgccacatcaagatgtattaattcttgcagatattagaaataaaacaggttatgatgttatggctcatttgactatggaattctttactaaaggacttgttccgattacttctttatcatttggttatgataacggacatctagagccaatatttattttggggaaaaataataaacaaaaaagagatcctaacgttattcaacgtttagaagcgaacagaaaaaaattcaaaaaagattaa

SEQ ID NO: 2311 - DNA, 144 bp, Staphylococcus epidermidis
gactcctcctttttcttttttgttgttatgaaaaaacaaaaaagagtgttacatgcttatcgagatatattgttttatgtgtcttcaccttatagcgacagttacgcgacacgtccacattgggaacaacatagagctagataa

SEQ ID NO: 2312 - DNA, 312 bp, Staphylococcus epidermidis
atggagtcaataacagtagatgaattaaagaaaaaaatattagattcaaatccagttaacattgtagatgttcgcacaaacgaagaaactgaaatgggtgttattcctggagcaaaaacaattcctatggatgaaattcctgataatttaaaagaattcaataaaaatgacacgtattatattgtgtgtgcagcggggtcacgcagtgctaaagtagtttcatatttagaagaacaaggtgttcatgctgtaaatgtcgaaggtggaatgaatgcatggggcgatgaaggtactgtaattgataatatttaa

SEQ ID NO: 2313 - DNA, 1695 bp, Staphylococcus epidermidis
ttatataaaatcaaggggctgaatattttggcacaattatcagatttagaaatagcaaacttatcaaaacttaaaccaataagtgaaattgcaagaaaagtagggattactgaggatgctttagaaccatacggccactataaagctaaaatagatattaatcagatacaagaacagaagaaaaaagggaaagtcgtattagtaactgctatgagcccaacaccagctggtgaaggaaaatccacagtaactgtaggtttagcagatgcatttaacaagttgaatcataatgttactgttgcattacgagaacctgccttaggaccaacttttggtattaaaggaggcgcaacaggtggtggttatgctcaagtacttcctatggaagatattaatttacattttaatggtgattttcatgcaattactactgcaaacaatgcactttccgcatttatcgacaaccacctacatcaaggaaatgaattgggaattgatcaacgaagaattgaatggaaacgtgttttagatatgaatgatcgtgcgttacgtcatgttaacgtaggattaggtggtacaactcacggagtacctagagaagatggttttaatataacagttgcgtcagagataatggctattttatgtctaagccgaaatatcaaagatttaaaagaaaaaataagtcgaattaccattggttatacacgtcatcataaacctataacagtttctgatttgaaagtagaaggtgcattaactttaatacttaaagatgcgattaaaccaaatttagttcaaacaattgagggaactccagctcttgttcacggaggcccttttgccaatattgctcatggttgtaactctatattagcaactgaaactgctagaaacttatctgatattgttgttacagaagcaggatttggttctgatttaggtgccgagaagtttatgaacattaaagctcgtgaagcaggtttcgatccatcagcagttgttgttgtagcaacgattcgtgctttgaaaatgcacggtggtgttgcaaaagaccaacttcaacatgagaacatagaggctgttgaagcgggacttgttaatcttgaaagacatgtgaataatattaaaaaatacggtgtcgaaccaatagtagctttaaatgcatttattcatgacacaccttctgaaacagcgtgtgtgaaacaatgggctaaagataatcaagtacgtattgctttaacagaagtatgggaaaaaggtggagaaggtggaattgaacttgctaaccaagtgttcgatgtaatgcagaaacctcaaaactttaagcatttatatgagttaaaacaaccactcgaagctaaaattgaaacgattgttaaagaaatttatggaggttcaaaagtaaatttcagtagtaaaacacaaaaacaattaaagcaatttaaagagaatggctgggatgaatatccgatttgtatggctaaaactcaatattcatttagtgatgatcagacattgttaggtgccccgaatgattttgaaataacaattagagaacttgaagccaaaacaggcgctggattcatcgttgcattaactggtgctataatgactatgcctggtttaccaaagaaaccagctgcactaaatatggatgttactgatgatgggaaagcaataggtcttttctaa

SEQ ID NO: 2314 - DNA, 1143 bp, Staphylococcus epidermidis
ggggataaaatggagaaaccaactagacttgcattacttaaggaaatagccgaatttctaaatgaagaaactgaaatatatagcatgatgcaaggagctttgcgtttacttataaatgggagcgacttttcaactggttggattttctatattgatgaagaggggcaccatgatttagtttcctctgtagatttacctgaagctttatctaaaaaccattgttactatttgacaaatggttcttgttggtgtgtgcaagcatatcaaaatcataaattaactaaagcttctaatataataaattgttctagaatcaatttagctaatcatgcttatgataaagaaacgaatcatattactcatcatgctactgttccattgcagtctgggagcgaaagattcggtttgcttaacgtagcatctcctaacaaagaacattatagtgaagaagacttagaactattagaatctgtagcatttcaaattggttcagctataaagagaattcagctaactaataaagaaaaagaaaatgccaaaattaatgaacgtaatcgactagctagagacttacatgattcagtaaatcaaatgttattttctttaaaattaacggctcacgctgcaaaagggataactactgacgagcaagcgcaaagagcttttaagactattgaggaaacaagtcaaaatgcagtaaatgaaatgagagcactgatttggcaactaaaaccagttggattagaacaaggcttaattcatgcattacactattatagtaaaatgttaggattagatttgaaagttactattaatggactaatagatttatctaatgatatcgaagaaaatgtatacagaattattcaggaagcaatgaataatgttattaagcacgctaaaactaacaaagtttatcttgatttatcacaaaatgttgattatcttgaggtagatattagagataacggtcaaggttttgacacgcaatcaattaatacgtttttatttaatggtttaaaaaacataaagcaacgtacacagtatttgaacggtaaagttactatagaatcaaaaataaatcagggcactcggatttatattaaaattccattgaagttaaaggagcatccttatgcataa

SEQ ID NO: 2315 - DNA, 834 bp, Staphylococcus epidermidis
gaggaaaaaatgaaatttacaatacctaaacaatttaacgattatacattgagagagattttccaatatttaaaattacctaaaaaagacttacatcaactgaatatgtctaaagaaattttaattaataaagagtacggtacattattaaataatgttaaaactggtgatcatgttgagataccaacccctaatgaagtaagtaattatttaccaagttatcgatatgctcaaatttattacgaggatgatgacttggccattgtcatgaaaccaaaaggtgttaaaacgcatcccaatgatttaaaagagagcaacacacttatgaaccatgtgatttacactgttgatagtgaatatgttgagcccatacatcgactagatcaagaaacagtaggtttattgatagttgctaaaaatccgcttatgaaaaaaatcttagaccgaatgttagaatataatgaaattacgcgtatatataaagcaaatgtcaaagcgttgttacctattaagccacaaacgatagatatgcctattggtaaagataaatttcattcaaacaaacgaagaatttccaacacaggtcaacgtgcaatcactcacattattaactctaaaatgattaaagaaggtgtatgtcaactcgacattaaactagatacaggtcgaacacaccaaattcgtgtgcaccttgctgagattggccatccagttattggggatccactttatggaacttcaacattacgacaattagagctaaatagtcatcaaattgaatttactcatccactgactcaagaaattatttctgtaagtctagatgataaatag

SEQ ID NO: 2316 - DNA, 147 bp, Staphylococcus epidermidis
attcatcgaattcagtatcgggaattttttctacaatatcatttacatgtcgtgaaaactcatttactggctattatgctagggaattatgtcccagcctctttattttttatgtcttttaatgccaagaataagagacgtcaataa

SEQ ID NO: 2317 - DNA, 360 bp, Staphylococcus epidermidis
attttcttgattactattttgctcgttatgttaggtggaggaataggtgctgtacttagagcccttatcacaaatatatgccaacgcttattcaatagtaaaattcctattgcaacatctatagtaaatattacaggtagcttaattatcgggtttatgatgggacacgcactcgatagccatcatatgtttcctttctttgttacaggtgttctcggaggtttaactactttttcaacattatcatctgaacttgttaatatgttaagccctcaatttaaaccaatacgttttgtagtttattccctattacaatttattttaggtttcattgcttgcttttatggatatcgcatctaa

SEQ ID NO: 2318 - DNA, 729 bp, Staphylococcus epidermidis
gtgccagtgattaatattaaaaatttaaataaaaaatttggagcaaatgaagtattgagagatattaatcttactgttgaaaagggtgaagtggttgcaataattggaccatctggaagtggtaaaagcactttactccgttgtatgaatttgttagatgtaccttcaaaaggtaaagttatatttgaagataatgaattaactcaacataatgttcatttagataatttacgacaaaaaatgggtatggtatttcaaaattttaatttatttcctcataaaaaggtcattgaaaatgtaatgttggcaccacttttattacataaagatagtaaagatcaattaaaagagaaagctttatatttacttgaaaaagtggggcttaaagacaaagcagattcatatcctaatcaactgtctggaggtcaaaaacaaagagttgctattgcaagagctttggcaatggaacctgatgttatgttatttgatgaaccaacatctgcacttgatcctgaagtagtaggggatgttttaaaagtaatgagacaattagcgaatgaaagtatgacaatggtgattgtcacgcatgagatgaactttgctaaagaaataagtgataaagtagtatttatggccgatggtgttgtggttgaatctggtacaccacaaaacatatttgaaaatcctcagcacagtcgaactgaaaattttttatcacgagtgttataa

SEQ ID NO: 2319 - DNA, 504 bp, Staphylococcus epidermidis
tgtacggtgattaaacttgggagggtgacatatatgaaatgcccaaaatgtaattctacacattccagagtggttgattcaagacatgcagatgaggccaatgcgattagacgtagaagagaatgtgaaaattgcggaacgcgttttacaacatttgaacatattgaagttagtccattaatagtagtgaagaaagatgggactagagaacaatttttaagagaaaaaatattaaatggtttagtaagatcttgcgagaaacgaccagtacgttatcaacaacttgaagacataactaataaagtggagtggcaacttagagatgagggacaaactgaaatttcttctagagaaattggagagcatgttatgaatttgttaatgcatgttgaccaagtttcctatgtaagatttgcatctgtatataaagaattcaaagatgttgatcaactcttagagtcaatgcaaggtatcttgagtgataataaacggagtgataaatag

SEQ ID NO: 2320 - DNA, 1053 bp, Staphylococcus epidermidis
ttaaaaaagatgatgcaaaacgttatcaaaacatcaaagattttgaaggcaaaaaaattgctgcgcaaaaagggacagatcaagcccacccttgcacaaactgagattgaagatagtaaaatttcttcactcaatagattacctgaagctatattatctgtaaaaagtggaaaagtagcaggtgtagttgttgaaaaaccagtaggtgaggcatatttaaaacaaaattcagaactaacattttcaaagattaaatttaatgaagaaaagaaacaaacatgtatagctgttcctaagaactctcctgtacttttagataagctaaatcaaacgattgataatgtaaaagaaaaaaatttaattgatcaatacatgacaaaagcagccgaagatatgcaagatgatggaaattttatttctaaatatggcagttttttcattaaaggaattaaaaatactattttgatttcattagtaggtgtggtattggggtctattttaggctcttttatagctttattaaaaataagtaaaattagaccattacaatggatagcaagtatatacatagaatttttaagaggtactcctatgcttgtgcaagtgtttattgtattttttgggactactgcagctttggggttagatatttcagctttaatttgtggtactattgcgcttgttataaattcttcagcctacattgccgagattattagagctggtattaatgctgtagataaaggacaaactgaagctgctagaagtttaggattgaattatagacagactatgcaatcagtagttatgccacaggcaattaagaaaattttacctgcattaggtaatgaatttgtaaccttgattaaagaatcgtctatagtttccacaattggagtgagtgaaatcatgtttaatgcacaagttgtacaagggatatcttttgatcctttcacaccattgttagttgcagcattactatatttcttacttacatttgcacttacacgtgttatgaattttattgaagggagaatgagtgccagtgattaa

SEQ ID NO: 2321 - DNA, 1284 bp, Staphylococcus epidermidis
tttaggaggattttatcaatggctaatgctttaatagaagatttaaaatggagagggttaatttatcaacaaacagatgaagagggtatcgaagaattattaaataaggaacaggtcactttatattgcggcgcagatcctacagctgatagtttacatattggtcacttgttaccttttttaacattaagacgcttccaagaacatgggcatcgtcctatcgtcttaattggtggaggtactggtatgataggagatccttctggaaagtctgaagagcgcgtgttacaaacagaatcacaagttgaagctaacgtcaaaggcctgtctaatcaaatgcatcgattatttgaatttggcagtgataaaggggcaaaattagttaataataaagattggcttggtcaaatttcgttgattagttttcttagagattatggtaaacatgttggcgttaactatatgctaggaaaagattctattcaaacacgtttagaacatggtatctcttatacagaatttacttatactattttacaagctattgattttggctatttaaatcgtgagttaaattgtaaaattcaagtaggcggatctgatcaatggggtaatattacaagtggtattgaattaatgcgacgaatgtatggacaaactgaggcatatggcctaacaatcccattagtaactaaatcagatgggaagaaatttggtaaatcagagtctggagctgtgtggttagatcctgaaaagacaagtccatatgaattttatcaattttggattaatcaatctgacgaagatgtaattaaattcttaaaatattttacttttttagaaaaagaagaaattaatcgattagaacaatcaaaaaatgaagcgcctcacttacgtgaagcacagaaagcactagcggaaaatgttacgaaatttattcatggtgaagcagctttaaaagacgctatacgtatttcaaaagcactgtttagtggagatttaaaatcattatctgctaaagaacttaaagaagggtttaaagacgtacctcaagtaacgttatctacaaaaacgacaaatatagttgaagcacttattgaaacaggtattgcttcatctaaacgccaagcacgtgaagatgtaaacaacggtgcaatatatattaatggtgaacgtcaacaatcagtcgattatgagttaagtagtaaagaccttattgaagatgaaattacaataattcgacgaggaaagaaaaaatatttcatggttaattaccaatcataa

SEQ ID NO: 2322 - DNA, 708 bp, Staphylococcus epidermidis
acctgctacttttcatcaaatagatacacaggaggacgttttatgcaacaagaaacgacatcatggtacaaacaagaatggtttatagttttatcacttttattcatttttccactaggtttatttctcatgtggaaatttagcaagtggccatctattgcaagaacaatcattactgttgcaatttcagttatcgtattagcaagcattacctattatggtaatctacaaatgattgtaccagcaacatcaaattcaaataacgaaactaaagaaactacagagaataatgtaaatgataaagacgagcgaaatcataaaactgcagtagaagaaacaaaaactaattatgactccaccaaagaaaatactaaagaacctggaaaagaaaatgaatctgcaacacgattggagaactctgcgcttgaaaaggcaaagtcatattatgatgattttcacatgtctaaactaggaatttatgatattttaacatctgaatatggagaaaaatttgataaagaagatgcacaatatgctatagatcatctagaggctgattatgaaaagaatgcacttgagaaagcaaaatcatatgccaaagatatgcatatgtctaatgactcaatttacgatcttttggtgtctaactacggtgaaaaatttacagaatcagaagcaaaatatgctattgagcatttggataattaa

SEQ ID NO: 2323 - DNA, 1284 bp, Staphylococcus epidermidis
caaatgcacttaaatgaggcttttacttatttaagtgcttttgttttaggaggaaagtttatggaacattataatcgtgataatttcgagaaaagccatacaagcgaagaattgtatcatcgcacatctcgttcacaatctaactcattgaagcgtaaggattttgtagttagtttcatagcaagtgcgatagtaggttctgctgttggattgtactataaaaataaaatatataaaaaaacggatgaattgaaagaaaaagaacaagatttacgtagtaaagttgaaaactatagacaacgagcggaagatacagtggtttctgttaaatctaaagttgagcaattaaaatatgattccaaagataatatccatgcagatgaattacaagctcaaaaagctgctattcaacgcgaaacagacttagcggatgaatcaccggaagcgcaagcaattcaagaagcaaaaaaagaaacaaaacaagtggatgatgtgagaccatcagcaacagaattagcagctcaacaaaatgctattcaacacgaaacagacttagcggatgaatcaccggaagcgcaggcaattcaagaagctaaaagtgaagttgattcaaacaataaaacatctacgacgcacatagatagtgagaaagaaccttctgctgaagaaattgcaattgctcaaacggcagttaaagaagaagcacgcaatcatgatttagcaaacctttctgcaagtggagaagatactaaaagtaagtcagaaactgaaacagaaaaattagctgcagcggcaaaagcaaaaaaagatagaataaataataataatgaagttgctagtaacacgaaaaatctaatgcaagaagaagctataaaagcttcaaataactctgatgttccaaatcttgtaactaatttaaatcaatctcaagcatcagatactaattcagttgcttatcgcttagcacaggcagcaaaagaaaaaagatctaagctcacaaatggctctaaagaaacacaacttacagaagcgttgttaaaagaaccatcaattgctaaagctcaaacaaaattgaagcgtatccctacacttattactgaatctaaaaaacattcaaataatccgcacagccaaaaaaattcgaatcagactaagaatataacagcaactaaagaggattccaaaggcaaacagcaacatacacctaaccaaaacaaacgtaataaacaacaaaaagtagaaaaaactagtagcaaaattgaaaaacgaacatttaatgattaa

SEQ ID NO: 2324 - DNA, 183 bp, Staphylococcus epidermidis
actctcaacttcaattttaatattatttgccaagttttatattataattattatcttaagctttgtcatcctattccatttacaataattaagataaaaaggtatggaggttatcatcatgtatcaaacaattgttatcggaggtggcccaagtggggctatggctgcggttgctgcaagtga

SEQ ID NO: 2325 - DNA, 273 bp, Staphylococcus epidermidis
gttaaacttgtgttaccaaatggtgtcttgaatgcgaataaaatcatgattacacctataacgattaaagcaatgattgtaactattttaatgattgcgaaccagaattcaagctcaccaaacaactttgcacttaataaattgaaagacattagaataagtacacagaataaagcactaatccaattaggtatgtctgggaaccaaaaacttatatatttggcaactgcagtcacttcagccataccagtaataatccaacatagccagtaa

SEQ ID NO: 2326 - DNA, 924 bp, Staphylococcus epidermidis
aggagcgttgttttaatggatttttcttcaccgacagtaattggcttaattgttgcaatacttgtggctgttttattctttatactcttcttaatagcgaaccatagtaagaagaaagtgaagaatcaaacagaagcacattataaagaaaaagaacaacatctaaaagaatctcatgaagaagctttagaaaaagagagagttgagaataaaaaagttgttacaaaacaaaaagaagattttgacgtgacagttagtaacaaaaatcgtgaaattgatgcgttgaaactattctcaaaaaatcatagtgaatatgttacagatatgcgattaattggtattcgtgagagactagtaaatgaaaagagaatacgccctgaagatatgcatattatggcaaatattttcttgcctagtaatgagttaactaatattgaacgtgtgagtcatcttgtacttacacgaactggcttatatataattgattctcaattattaaaaggccatgtttataatggtattagtggtgcgcaatttaaagaattacctacgatgtcacaagtttttgacacgctcgacttagattcatcacagccacagacattggtcttagatcaaaatgaagatcaacattcattatcttttgttaattattcagataagattaaacatattgaaaaattagcaggagatttacaaaatgaattgaataccaaatatacgcctacatcaatactgtattttaatcctaaaaaggataatgatgttacaatttctcattatacgcagtcatcaaatgttaaagttttagttggtcctgaacaattagatgaattcttcaacaagtttgttttccatggacgcatacagtacaatgtggatgatttacaagatatcatggttaaaatcgagtcattcaattaa

SEQ ID NO: 2327 - DNA, 708 bp, Staphylococcus epidermidis
agtgaagatgttgcgatgagattagataaatttctagctaatatgggtgttggaacgcgatcagaagttaaacagttactcaaaaaaggatctgttaaagtcaaccaaaatatagttaagttacctaaacttcatgttaatcctaattctgatgagataatggtaaatgatgaagtagttagttatatcgacaaagtgtatatcatgttaaacaaaccaaaaggttatatttcagcgacagaggatgaggtgcatcctactattattgatttgatacctgaatatgcacatttaaatatttttccggtcggacgtttggacaaagatacagaaggattactccttgttacaaatgatggacagtttaatcatgaagtaatgaatcccaataagcatgtttcaaagacttatgaagtctattcaaaacacccaataactcaattcgatattgataaatttaaatccggaatagaattatcagatggaaaattaaagcctgcaattttaaagaaagttgataattatgtatcacatgtcactatttacgaaggaaaatatcatcaagttaaaagaatgtttcatagtatcgaaaatgaggtattagaattgaaacgcataaagattgctcaactagaactagatcataatttagatttgggtagttaccgtttgttaacacaaatagattttgataatcttaagaactaa

SEQ ID NO: 2328 - DNA, 189 bp, Staphylococcus epidermidis
ttcctatgtgtttattatcatttcgtagatgtcgatatcaaaattttaaccattttactaaaaggtatgttttttattttggcagaaatctgtaatagtctgtttaaaacattttgtatatgtttcatatcttttatagcaattgaaatgattttattagctgattttgtcatagtacttcttaaatga

SEQ ID NO: 2329 - DNA, 192 bp, Staphylococcus epidermidis
aatattagtgtctcaggtttttttattaacaataaatttaaaataaacctatttctatcttatcttgaacattcactctgcttaaatttcatatttcttttattaaagtttcctttaagaaaatatatgttgaagttactatttcgtataattgttaagggtaaatttataacttttattaagattatgtaa

SEQ ID NO: 2330 - DNA, 411 bp, Staphylococcus epidermidis
agattatttttctgcacgtcacttgctaaaagaaagtattattcatttaacaagtggacaaattcaacaattacaatatggaaaggaattttgatatttatgattaaacttgaatcagaacaacaatttgaagaattaaaaaaagggtatacagtatttgaattcactgctggatggtgtccagattgtaaagtaattgaaccggatttacctaaattagagaaaaaatacagtcaattacaatttgtgtctgtagatagagatcaatttatagatatttgtgttcaaaatgatattttaggcattcctagttttcttatctttaaagaaggtcaacttttaggaagctatataggtaaagagagaaaatcaattgatcaaattgatcaatttttatctcaacacatttaa

SEQ ID NO: 2331 - DNA, 615 bp, Staphylococcus epidermidis
aggagtgtagttaacatggcaatgaattttaaagtatttgataatagtgaaaaagtagcagaatatactgcagatattctacgtaagcaatttaataataatccaactactattgcaggatttcatttgagcaaagaacatgcaccagtgtttgatgaacttaagaaaaatgtagaaaatcatacagttgatttcagtcaaataaatattttagattatgatgataatcattcttattatgaggctttgggtgtgccaacaggccaaatttattccatttcttacgaaaatgatgcaattgactttatctcagataagattaagactaaagaaaataaaggcaaactgacaatgcaagtccttacgattgatgaaaatggtaaacttgacattagcgttcgtcaaggtttgatggaagctagagaaattttcttagttattactggtgctaataaacgcgatatggtagaaaaactttaccgtgaaaatggtaagactagttttgaaccatcggatttaaaagcacaccgtatggtcaatgttatcttagataaagaagcggctgcaggcttacctgaagacgtaaaagagtacttcactgcacgttttgcataa

SEQ ID NO: 2332 - DNA, 132 bp, Staphylococcus epidermidis
tcacttaaagtaattacattatctaatccgcttgatgcacaccatcttttttgggcgaaaggtaaatctactgatatcgttaaaactacaccatcttctgctgaagcttcttcattaaactttcgagtttga

SEQ ID NO: 2333 - DNA, 1014 bp, Staphylococcus epidermidis
ttatttagagttaattcatactatcaatcacggatggacacttttttaaatagaaagggatattttatgtctgaagaaaatactattatggaacgtctatttcataaattagatgataaagctaaaacgttaaacaaagaaaatggacagagttttatcgaaaatttagggttagctatggaagatatttatacaaaccaaagagaacttttagaacaagcaacgcttcaagatagaaggaaagcttttcaatttgcatatttaagtttattacaagaagaaaatattcaagctaatcatcagatcacgcctgactctataggactcattctcggttttcttgttcaacgctttttagaacataaaaaggaaatgcacattgtagatattgcaagtggggcaggtcatctaagtgcagctgtgaaagaagtactttctgataaaacaattatgcatcatctgatagaggtagatccagtgctatcacgtgtaagtgtgcatttggctaattttttagagataccgtttgacgtttatcctcaagatgcgattatgccattaccattggaagaggctgatgtcgtgattggagatttcccaataggatactatcctttagatgaacgtagtagagaaatgaagttaggctttgaaaagggacacagttattcccatcatctgttaatagaacaatctattaatgcgctaaaaggggcaggttatgcatttttagttgttcctagtcatctctttgaagatgataaagtgaaacagttggaaaatttcattgctacagagactgagatgcaagcatttttaaatttacctaaaacattatttaaaaatgaaaaagcacgtaaatctatattgattttacaaaagaaaaaatcaggcgaaactcgaccagttgaagtcttattagccaatatccctgattttaaaaatcctcaacaatttcaaggtttcatttctgaattgaatcagtggatagtcacaaatcatacaaaaaaatag

SEQ ID NO: 2334 - DNA, 366 bp, Staphylococcus epidermidis
ctcaaaggagtgcaaagacttatggcagtaaatttatatgattatgcaaatcaattagaacaagctttaagagatagtgatgaatataaagctattaaagatgcatttgctaaagtaaaagaaaacgaagaatcaaaaaaattatttgatgaattccgtgaaactcaaatgagcttccaacaaaaacaaatgcaaggggaagaaattcctgaagaagatttacaaaaagctcaagaacaagctcaagctatagaaaaagatgaaaatatttctgaattaatgaatgctgagcaaaaaatgagccaagtattccaagaaattaatcaaatcatcgtaaaacctttagatgaaatttacgctgactaa

SEQ ID NO: 2335 - DNA, 3204 bp, Staphylococcus epidermidis
gagaccatggtagcacatttaaatattcatacttcttttgacctgttagattctagtttaagaattgatgcattaatagataaagctaaaaaagaaggatatcgtgcgcttgcaataaccgatacaaatgtattgtacggttatccaaagttttatgatgcttgtattgcagctcacatacatccaatctttggtatgactatatatttaacggatggtctctatactattgaaacggttgttttagcaaaaaataatcaaggactcaagtcattatatcaaatttcttctgctataatgatgagaaataaagaagaagtgccaattgaatggctaaaaagatacgacgaacatttaattatcatatttaaagaggctgagttgtctcataagcaaattattgatgcttttgaaggtaagaaagaattatatttaaatcacaatagtaataatacattgactggcaaacgtgtatggatgcaatctgcaagatacttaaatgaagatgatgctgaaaccattccagcgttacatgccataagagataatactaagttagatttaatacatgagaaagaaacacttgatgaacattttcctagtatagaagaacttcaaacactaaatcttagtgaagatatgattactaacgcgaatgaaattgaagaattatgccaagcagaaattgcataccatcaatccctgttgccacaatttgtgacacctaatggtgaaacttcgaaagattatctttggacgatacttatacataggttacgagaatgggaacttaatgataaaacttatttcaatcggttgaaacatgaatataaaattattactgatatgggtttcgaggattattttcttattgtaagtgatttgattcattttgctaaaacacatgaagtgatggttgggccaggtcgtggttcatcagcagggtcattagtaagttatttattaggtattactactatagacccgttaaaatataatcttttatttgaaagatttcttaatcctgaacgcgtaactatgccagatattgatattgattttgaagacacgagacgtgaaaaagtaattaagtatgtacaagataaatatggtgaacatcatgtatcaggtattgtgacatttgggcatctgttagctcgtgctgttgctagagatgtaggaagaataatgggatttgatgaaacgagtttaaatgagatttcaaaacttattccacataaattaggtataactcttgaagaagcataccaaaagccagagtttaaagcatttgttcatcgtaatcatagaaatgaacgttggtttgaagtgagtaaaaagttagagggattaccaagacatacgtctacgcatgctgcaggtatcattatcaatgatcaaccattattcaaatttgccccattaacaactggtgatacaggattattaacgcagtggactatgacagaagcggaacgtataggattattaaaaattgatttcttgggattacgcaatctatcaattattcatcaaattattttacaagttaaaaaggatttaaatataaatattgatatagaagctataccttatgatgataaaaaagtttttgatttattatcaaacggtgacactacaggtatatttcaattggaatcagacggtgttagaagcgtattaaaaagattgcaacccgaacattttgaagatatcgtagctgtcacatcattatatagaccaggaccaatggaagaaataccaacttatataacccgtagacataatcctaaccaagttgcttatttacatccagatttagaaccaatcttaaaaaacacatatggtgttatcatttatcaagaacaaataatgctaatagcaagtcaagttgctggttttagttatggtgaagcagatattttaagaagggcaatgagtaaaaagaatcgtgcaatcttagaaagtgagcgtcaacatttcattgatggtgcaaaaaataacggttacggtgaacagataagtaagcaaatttttgatttaatacttaagtttgcagattatgggttcccacgtgcccatgctgttagttactcaaaaattgcatacattatgagctatttaaaagtgcactatcctcattatttttatgcaaatatcttgagtaatgtaataggaagtgaaaaaaagactgcagctatgattgacgaagctaagcatcaaagaattagcatcttgcctcccaatattaatcaaagtcattggtattataaggcaagtaataaaggaatatatctgtctttaggtacaattaaaggaattggatatcaaagcgttaaattaattattgatgaacgtcagcagaatggaccttatagagatttctttgatttttcaagacgtataccaaaaagggtgaaaaatagaaaattacttgagtctcttatcttagtaggcgcattcgacacttttggcaaaactagagcgacattattacaagcaattgatcaagtattagatttgaattctgatgttgagcaagatgaaatgcttttcgatcttttaactcctaaacaatcgtatgaagaaaaagaggaactacctgatcaattattaagtgattatgaaaaagaatacctaggattctatattagtaaacatccagttgaaaagaaatttgaaaagaaacaatatttaggcatatttcaattgtctaatggaagtcactaccaacctatacttgttcaatttgaccatatcaaacaaataagaacgaagaatggtcaaaatatggcatttgtaacgatgaatgatggaagaacgatgatggatggagtgattttcccagataagtttaaaaaatacgaaacttctatttcaaaggaacagatgtatatcgtattaggtaaatttgaaaagcgtaaccaacaaatgcaacttatcatcaatcaactttttgaagttgaagcgtatgagcaaacaaaattgtctaattcgaaaaaagttattttacgtaatgtaacacatctagaaccacaatttgaacattcaaaagtagaatctaatgaacaacatgcattaaatatttatggttttgacgaaagtgcaaataagatgacaatgttgggacaaattgaacgtcaacgtcaaaattttgatctattaatacaaacttattcgccagctgatattagatttatttaa

SEQ ID NO: 2336 - DNA, 1287 bp, Staphylococcus epidermidis
aatatggaggttaattgtatgtctgcagaaaaaataacacagagtaaagatggtttaaatgtacctaatgaacctattattccgtttattattggtgatggtattggaccagatatttggaaagcagctagccgagtaatcgatgcagctgttgaaaaagcgtataatggagaaaaacgtatagaatggaaagaagtcttagcaggtcaaaaagcttacgatgaaactggagaatggttgccacaagaaacgttagaaacaatcaaagaatatttaattgctgttaaaggtcctttaacaactccaattggtggtggaattcgttcattaaacgtagcactgagacaagagttagatttattcacttgtttacgtccggtacgttggttcaaaggcgttccttcaccggttaaacgacctgaagatgttgatatggttattttccgtgaaaataccgaagatatatacgcagggatagaatttaaacaaggtacatcagaagtaaaaaaagttatagatttcttacaaaatgaaatgggagcaactaatattcgtttccctgaaacttctggtattggtataaagccagtatctaaagaaggtacagaacgtctagtaagagcagctattcaatatgcacttgataataatcgtaaatcagtaactttagttcataaaggtaatattatgaaatttactgaaggttcatttaagcagtggggctatgatttagctcataatgaatttggtgataaagtgtttacatggcaacaatatgatgaaattgttgaacaaaagggtaaagatgctgcgaatgaagcacaaagtaaagctgaacaagaaggtaaaattattattaaagactctattgctgatatcttcttacaacaaatattaactcgtccagctgaacatgatgttgtggcaactatgaatttaaatggtgactatatctctgatgctcttgcagctcaagttggaggcattggtattgcgcctggtgctaacattaactatgaaactggacatgccatttttgaagcaacacatggtactgcacctaaatatgctgatttaaataaggttaatccgtcatcagaaattttaagttcagttttaatgcttgaacatttaggttggcaaaaagccgcagataaaatcactgactctattgaggcaacaattgcttcaaaaatcgtaacatatgattttgcgcgtcttatggatggtgcaaaagaagtttcaacatctgattttgctgatgaactaattaagaatattagataa

SEQ ID NO: 2337 - DNA, 459 bp, Staphylococcus epidermidis
atgaacttattttacaatcctaaaggtgttggagatgttgcatttattcaaattgaaccttcagttggtccttttgaatatgaacaaaaacatggtgtggtagaaatcaaaaaagaaaatgaggtagtaggttataatatatttaatgtgtctaataatgtgacaataaatgataatggacatattaaactaactactgaattaatcaaagatttacaacaactgattactgaagcaggttttgattatcaacttgatactgatgtatcgcctaaatttgtagttggttacgtagaaactaaagaaaaacaccctaatgcagacaaactaagtgtgttgaatgtaaatgtcggtactgaaaaacttcaaattgtttgtggggctccaaatgtagaatctggtcagaaagtcgttgttgcaaaaagttggggccgttatgccaagcggaatggtaattaa

SEQ ID NO: 2338 - DNA, 732 bp, Staphylococcus epidermidis
ggtatactattaaaagatattacttttaggagggtaactcttatgaaactttcatttcatggtcaatcaacaatttattttgaaggtaacggcaagaaagttatagttgatccatttatctctggcaacgataaatgtgacctagatgaacaaacgttagaggtagattacattatcttaacacatggtcacgctgaccattttggtgatgtagttgaattggctaatcgtaatcatgcaactgtgattggttcggcagaattacaaggatatttatctacttatcacggagtcgaaaatgttcatggcatgaacattggtgggaaggctaaatttgattttggaacagtcaaatttgttcaagcattccatagttctagctttacacatgacaatggtgtgcctgtatatttaggtatgcctatgggaattattgtcgaagctgaaggcaagactatctatcatactggggatacaggattatttagtgatatgaaactgatagcagatagacacccagttgatgtatgttttgttcctattggagataactttactatgggaatagaagatgctagttacgctattaatgaatttattaagcctacaatcagtgttcctattcattacaatacattcccgttaattgaacaagatccagagcaatttaaggatgcagttcaggtaggggaagtacaaattcttaaaccgggtgaatcagtggaattttaa

SEQ ID NO: 2339 - DNA, 447 bp, Staphylococcus epidermidis
tcatgcatatttcttgttatactgggtatgaaatactattacaattatccgacaaataaagtgaggagaatcataatgaaagtctcaagaatattatttggtttaggtgtaggtgctgttgcaggatttgcagttgctttaagacatcgtgataaccaaagcgtaaaaaatcatacgattgatgctagtcaacccactggagctcaatcagaattacaacgtgaaatagagaatatgaaacaatccttcaatgatattcttaattacggttcacaaatcaagaatgaaagtattgaatttggaagttcaattggcgaagagtttaaaggattgattggtaattttaaatctgatattaatccaaacatcgaaaaattacaaagccacattgaaaatttacaaaatcgtggcgaagatattagtaataacctttcaaacgataagtag

SEQ ID NO: 2340 - DNA, 882 bp, Staphylococcus epidermidis
cagaggatatttggaggtttaccaatgtttaaagatttttttaatcgaagtaagaaaaagaaatatttaacagttcaagattctaaacaaaatgatgtacctgctggtataatgacaaaatgtcctaaatgcaaaaaaataatgtatacaaaagaattgaatgaaaatttaaatgtatgctttaattgtgatcatcatatagctttaaccgcatataaaagaatagaagcaatttcagacgaaggatcatttatagaatttgatagaggtatgacatctgctaacccattagactttcctgggtatgaagaaaaaattgaaaaagatcagcagaagactggacttaatgaagcgttagtgtctggtactgcgaaattagacggaatacaatatggtgtcgcagttatggatgctcgttttagaatgggaagcatgggctctgtagttggtgaaaaaatatgtagaattattgattattgtacagaacatcgtttgccatttattctgttttctgcgagtggtggagctagaatgcaagagggaattatttctttaatgcaaatggggaaaacaagtgtttctttaaaaagacattctgatgcaggactattatatatttcttacataactaatcccactactggaggggtttctgcaagttttgcttcggttggagatattaatttaagtgaacctaaagcactaatcggatttgctggtagacgtgttatagaacaaacaattaatgaaaagttgcctgatgatttccaaactgctgagtttttattagagcatggtcaacttgataaagtcattcatcgaaaagatatgcgtgagactttatcaaatattttaaaaatccatcaagaggtgagtaactaa

SEQ ID NO: 2341 - DNA, 1110 bp, Staphylococcus epidermidis
aaatactctttaagtgttcaaactctttatgtaaacgctttcttaaacttaattttcatgatacactatttaaaaatatcatactctagtataacggaggtattgcatatgtcattatttaaagattttttcattgcgttatctaatcatacatatcttaataaaatagctaaaaagatgggacctcaaatgggagcaaatcgtgtagtcgcaggaaatacgattcatcaattaattgagactatacaatatttaaatgattataatatttcagttactgtcgactcattgggtgaatttgttaatactagagaagaaagcattaaagctaaagaagagattttagaaattatcgatgcaatatataacaataatgtaaaggcacatatgtcagtcaagataagtcaacttggaagtgagtttgatttaaatcttgcttatgaaaacatgagagaaattttacttaaagctgataagaatgggaagatgcatattaatattgatacagagaagtacgatagtctttctaaaattcaacatattattgatagattgaaaggtgaatttaaaaatgtgggtacagtcgttcaagcctatctgtatgaagccgatgatataattgataaatatcctgaattacgtttgagacttgtgaaaggtgcttataaggaagatgcgtcaatcgcttttcaatcaaaaaaagaaattgacgcaaattatattagaattattaaaaaacgactactaaattcaaagaactttacatcggtggctacccatgacaatgaaataatcaaccaagtcaaacaatttatgaaagaaaatcatatcagcaaagataaaatggaatttcaaatgttgtacggtttccgcacggaattagcacaaaaaatagctaatgaaggttatttttttacagtttatgtaccatacggtaatgattggtttgcgtactttatgagaagactagcagaacggcctcaaaacttgtcattagctataaaagaatttactaaacccaaaatcttaaaaaaggcaaccttgggtataggtatatttgcaactttattgacgtctcttattcttggcattaaaagacataaaaaataa

SEQ ID NO: 2342 - DNA, 126 bp, Staphylococcus epidermidis
aaaaaatcatttaggactcatttttattttaataggaaaaattttcttttaaatgtaaacggtttatttcaacattgctcatacaatttaaatagtgctatactacaattaaacaaagaacaatag

SEQ ID NO: 2343 - DNA, 1053 bp, Staphylococcus epidermidis
ggtgatcaattgagtagatttatggatgatgctattcaattagcaaaaatggtaaatggacaaacaggtgttaatccaccagtaggatccgttgttgttaaaaacggtaggattgtaggtttaggtgcacatttaaaaaagggagataaacatgccgaagtacaggctattgaaatggcaggtttaaatacccaaggtgctaccatatacgtttcattagaaccttgtacacaccatggttcaacgccaccttgtgtggataaaatcattgaagcgggcatatctaaggtcatctatgctgttaaagatactactttagtaagtaagggtgacgagattctgagagaagctggtatagaggttgaatttcaatataatgaaaatgcagctgcattataccgtgacttttttactgctaaaagaaacgaagttccagaagtaactgtaaaggtctcatctagtttagatggtaaacaagcaacagactttaatgaaagtaagtggataacaaacaaagaagttaaagaagatgtttatcaattaagacatgagcatgatgcagttattactgggcgtagaaccattgaagcagacaatccattgtatacaaccagggttcctgatggaaagcatccgattcgagttattctttctaagaaaggtcaactcgattttaatcaacaaatatttaaagatactgcatcggagatatggatttacactgaaaatgaaaaattaaaaacaaataaaagttttattaaaataataaatataagtaattgtgatacaacgacaatattacaagacttatatcaaagaggtattgggaaactgctagtcgaggcaggcccaaatattacatctcaatttctccaatccaaacatctaaatgaactcattttatatatagccccgaaattaattggtggttctggcaaacatcaattttataagactgacgaggtcattgatttgcctgaagcaactcaatttgaaattgttgattccaagttaattaatcaaaatttaaaattgaaattacgaaagaagtga

SEQ ID NO: 2344 - DNA, 450 bp, Staphylococcus epidermidis
aattcacaattttttatttgggagatgttaattttggctaatagtgaaaagaacagggtttatggtattttacaattagagacattattcaaagagattgattcaatttttaatacaatcaaagaagaatatggaatgtctaaagaggaaattttgattttacttacacttttggaaaaaggctcaatgactttaaaggaaatggataaatatgttcatattaaaccgtataaacgtacacgtacttataataatttagttaatcttgagtggatttacaaagaaagacctcaagatgatgaacgtacagttattattcattttaatgacaagcaaaattctaaaaaagaagatttgttaaagtttattgatgactcaattaaaatcaagtctgaaccaatgcaatctagtttacaatctattttagcagttgaatttaacgtgctttaa

SEQ ID NO: 2345 - DNA, 126 bp, Staphylococcus epidermidis
aaaagacaattcctatattatttcaatagaaattgtctttatttacttatcttggaccttttagtcccagtctcaattttatatgtactaaaattattaaacacagatagaaaagatgctatttaa

SEQ ID NO: 2346 - DNA, 171 bp, Staphylococcus epidermidis
aaacccctttcctcagactatagtatgacaaggaaaggggggtgtaactacataattgatagcgatttaattatgcatattttatttataaatataaagaatgttgcatctattctttgtaaaggatttaaaaaatcagtgttgtatataaggattgtctaccttgtttaa

SEQ ID NO: 2347 - DNA, 192 bp, Staphylococcus epidermidis
atgaattcttcaacaagtttgttttccatggacgcatacagtacaatgtggatgatttacaagatatcatggttaaaatcgagtcattcaattaaattattaaagaaatactttatttttcatatgagtgcttattatagtcttcaaaacaattactacaaattaattgttttgaaggcttttttgatttga

SEQ ID NO: 2348 - DNA, 156 bp, Staphylococcus epidermidis
gttttgacttcatttagtaataattcggcgttatacagttttttcttcgtcaaaaaaatgagagaaaagattaatattaaaaaagctgtagaaaaaaacaatatagttatttttttaaaattaactgacttcatcacaaattctcctcttacataa

SEQ ID NO: 2349 - DNA, 252 bp, Staphylococcus epidermidis
ttaatatcctccttagggaaaaagatgggtagtaatgttaaagattctaaaattacaccgaataaaataagtttatttaccggttctttagttactaatgaaataactacgatagtacaatataaaaatatggagagtattttttttcgctttacaagacgtctaggtataggttgtttcttagttgctgcaggtgcgtataaaatcgtaataattaatccgactaatgccatagataaaagaacaaaatag

SEQ ID NO: 2350 - DNA, 216 bp, Staphylococcus epidermidis
atgtcattatctaatgaagaaatgatttctaatataagacaaaaattaaatattgtaaatcaagcattacttaatccggaaaaatttaaatcaacacctcatcaagacataagcgaaatatatgaattcgtaatgtctaaagattcattctcgcctagtgaggttacggctattgctgaccatttaggacagcttagacaagatatggaggattaa

SEQ ID NO: 2351 - DNA, 1497 bp, Staphylococcus epidermidis
atatttaagtcgattggagatgttaaagtgtaccaatataacgacgatagcttaatgttacacaatgatttatatcaaattaatatggctgaaagctactggaatgatggtatccatgaaagaatagcagtgtttgatttgtattttcgaaaaatgccatttaatagtggatatgcggtattcaacggattgaaacgcgttgtgaatttcatcgaaaactttgggtttacaaatgaagatatcacatatttaaaatcgataggttacgaagaagattttctaaactacctaaaagatttgaaatttacagggaatattaaatctatgcaagaaggtgaaatttgttttggtaatgagccattattaagagttgaagcacctttaatccaagcgcaacttattgaaactattttgttaaatatcattaatttccaaacattaattgcaactaaagccagccgaattcgtcaaatagcaacgcatgacactttgatggaatttggtacaagaagagctcaagagatcgatgctgcactgtggggcgctagagcagcctttattggagggtttgattctacaagtaatgttagagcaggaaaactttttaatatacctgtatttggcacacatgcacacgcactagtacaaacatatggtgatgagtatatagcattcaaaaagtatgctgagcgacataaaaattgtgtgttcttagttgatactttccatactttaaaatcaggagtaccaaccgcaattaaggttgcaaaagagttaggagatactattaattttataggtatcagattagattctggtgatattgcgtacctatctaaagaagctcgtagaatgttagatgaggctggttttacagaagctaaaattatcgcatcaaatgatttggatgagcagactattacaagtttaaaagcacaaggcgctaaagttgacggatggggagtaggtacaaaactgattacaggatatgatcaaccagccttaggcgcagtttataaattggtttctattgaaacagatgatggcacaatgagtgatcgcattaaattatcaaataatgctgagaaagttactacaccaggcaaaaaaaatgtttatcgtattattaataataaaacaggcaaggctgagggcgactatattacgctagaaggtgaaaatcctaatgacgaatctccattgaaaatgttccatcctgttcacacttacaaaatgaagtttattaaatcatttaaagcggttaatctacatcaatctatatttgaaaatggcaaacttgtataccatcttccagatgaatatgaagctcaggactatcttaaaaataatttaagtattttatgggaagaaaataaacgatatcttaacccgcaagattatccagtagatttaagcactaaatgttgggaaaataagcataagcgtatttttgaagttgctgaacacgttaaagagatggaggatgaaaatgagtag

SEQ ID NO: 2352 - DNA, 759 bp, Staphylococcus epidermidis
agaagcattccactttatatatcatatgagtgctgtagcatagaaaggtggcgaaatatgacacgcaaatatatatcaactgaaatgttgattatttttactgctttaatgattattgctaatttttactatatattttttgaaaaaattggctttttactagtactcctattaggatgtgtacttgtatatgtagggtatgtgtattttcataaagtaagaggactactatctttttggataggaaccttattaattgcttttacacttttgtctaataagtacacgattattattctatttatatttttaattgtagtcatcatacgttatttggtttataagtttaaaccattaaaagtgattgctacagatgaagacatcacatcacccatttttattaagcaaaaatggtttggtgaacaacatacaccagtgtatgtatataaatgggaagacgtacagattcaacacggtataggagacatacacattgatatgacaaaagcggcaaatattaaggaaacaaataccatagttgtgcgtcatattttaggtaaagtacaagtagttgtacctcttaattataatataaatttacatgcgactctcttctacggcactgcttatgtgaacgataaatcttataagattgagaataaccatgttcaaattgaagaaaaaacgaaagatgataattatactgttaatgtttacgtttcatcattcattggagacgtagaggtgatttacagatga

SEQ ID NO: 2353 - DNA, 1377 bp, Staphylococcus epidermidis
aaacgaacttttcttataaaaaatgtgataatgtacagtttttgtaggagctataatacatacgataggagtttacaaagaatgatagaacgttattcaagagatgaaatgtctagtatttggacggatcaaaatcgctatgaagcatggttagaagtagagattctagcgtgtgaagcatggagtgagttaggttatattcctaaagaagatgtaaaaaaaattcgtgaaaatgccaaagtaaatgttgaacgcgctaaagaaattgaacaagaaacacgacacgatgtagttgcatttacacgccaagtttctgaaactttaggtgatgaacgtaagtgggtacattatggattaacttccactgatgtagttgacactgccttaagttatgtaattaaacaggcaaacgaaatccttgaaaaagatttagaaagatttatagatgtattagctgccaaagctaaaaaatatcaatatacattgatgatggggcgtacacatggagttcatgctgagcctacaacttttggcgtaaaaatggctctttggtatactgaaatgaaacgtaatcttaagcgttttaaagaagtgcgtaaagaaatagaagtagggaaaatgagtggagcagtaggaacatttgccaatattccacccgaaattgaggcttacgtatgtgaacatttaggaatagacactgcagctgtttctactcaaacattacaaagagatcgtcatgcttattacattgctacattagcactaattgctacatcaatggaaaaatttgcagtagaaattcgtaatttacaaaaaactgaaactagagaagtcgaagaggcatttgcaaaaggacaaaaaggatcatcagcaatgccacataaaagaaatccaatcggttctgaaaatattacaggtatatctcgtgtgattcgaggatatattactactgcatacgagaatatacctttatggcatgaaagagatatctctcattcttctgcagaacgtatcatgttaccagatgttacaattgctctagattatgcacttaatcgatttacgaatattgttgatcgactaacagtttatgaagataatatgagaaataatattgataaaacgtatggtttaatcttctcacaacgcgtactactagcattaattaataaaggcatggtacgtgaagaagcttatgataaagttcaacctaaagcaatggaatcttgggaaacaaaaacaccatttagagagctaattgaacaagattcatctataactgacgttctatcaagtgaagaattagatgattgcttcgatcctaagcatcatcttaatcaggtcgacactatattcgcgcgtgctggtttatcttaa

SEQ ID NO: 2354 - DNA, 135 bp, Staphylococcus epidermidis
gaattatgtcctggcctcttattttatgaaattgtaaaaaatattgtattcacaagaatttttacaattcatgtaaagttagtttttcttattaaaagcgccgataattttaacttgaaaatccaaagtctctaa

SEQ ID NO: 2355 - DNA, 507 bp, Staphylococcus epidermidis
ttgaagatgttaagtaaagaactattagcagctttaaatgaacagatgaatcaagaatattttgcagcgcatgcatatatggcaatggcagcatactgtgacaaagaatcttatgacggatttgcaaatttttatatagaacaagctaaagaggaacgtttccacggtaaaaaaatctatgactatatcaatgatcgtggcgaacatgccatctttgatacaattaaagctcctaaagtagaattttcttctattttagaaacatttaaagatagtttagctcaagaacgtgatgttactcaacgtttctataatctatcagaattagctcggaatgataaagattatgctacaatttcatttttaaattggttcttagatgaacaagttgaagaagaatctacatttgaaactcatatagattaccttactcgtattggcgatgattgtaatacactttacctatatgaaaaagaattagcagcgcgttcattcaacgaacaataa

SEQ ID NO: 2356 - DNA, 300 bp, Staphylococcus epidermidis; identical to SEQ ID NO: 8

SEQ ID NO: 2357 - DNA, 180 bp, Staphylococcus epidermidis
cattactacccatctttttccctaaggaggatattaatcatggaaaacatttttaatttatttataaaatttttcactacaatcttggaatttattggtactgtagcaggagatagtgtatgtgcttcttactttgacgaaccagaagtgccagaagaactgactaaactatacgagtaa

SEQ ID NO: 2358 - DNA, 351 bp, Staphylococcus epidermidis
gcaattataccacatatgactccattaattgtcaatggtatggctataattaaatgctttaagtacacaggaatcatcattttagcagcacctatgagtaataccacgttaactccaagagaattaactcttaaagatccaaataaaaaggttacacaagctgcaactattcccatatttgcagcaccacttcctaaaccagtaaggttaattgctgttgctatagcaactaacgagattggagttaccattaataaagaaaatgttacacaaattaatatagacattaataatggatttaattctgtaaacctgtttactaattttcctagtgactgcgtaataacttga

SEQ ID NO: 2359 - DNA, 303 bp, Staphylococcus epidermidis
cgcttgccacctacgtattaccgcggctgctggcacgtagttagccgtggctttctgattaggtaccgtcaagacgtgcatagttacttacacatttgttcttccctaataacagagttttacgatccgaagaccttcatcactcacgcggcgttgctccgtcaggctttcgcccattgcggaagattccctactgctgcctcccgtaggagtctggaccgtgtctcagttccagtgtggccgatcaccctctcaggtcggctacgcatcgttgccttggtaagccgttaccttaccaactag

SEQ ID NO: 2360 - DNA, 213 bp, Staphylococcus epidermidis
acattaacgtttcctaaatgtatatctaaaggtgctacgtataaatatagaagacattgttttttcatctcaacacatcccactttccacattttctttagcgttttagaaggaaatgctcatcactttgttcatgaccttttgttaattaaccatcggcataagttatttacaattcagtcattaactgctaatacgttaaaatgcccctag

SEQ ID NO: 2361 - DNA, 840 bp, Staphylococcus epidermidis
cctttatttacgataaaatacataatatacatatatagatggagggaaaagtttttctttttaaatttggcacaaaaaacgcgttttgttaaattgcggtatcccctattaacccgtttctattctcacggtttagctcaaatactacctgggttggttttaggtagccatttacttggagatatgtataaaatgcaaactgcccaaacaatgagtatcatgcaagtatctatctttatcatcgctgcattgttaatcattttcatgcaagcaaccattaaaaatcctactcaattagaacaaggacataaggaacctaaaagatatattttcgcctgggttctattaggattttgtattgtgatgatttaccaaatcatcatcagtataattttatttgccatcaatggcagtccgcaaagaagtccaaacactgaaaggttaatggctattgctaagcaaatgccgatatttatcgttttaatatccatagtaggtcccattttagaggaatacgtttttcgtaaagttatcttcggagaattgtataactttataaagggatcacgtgtggtaagctttatcattgcttctatagtaagttctctaatattcgctttagcacataatgacttcaaatttataccggtatattttggaatgggagtcattttctcacttgcttatgtttacacaaaacgaattgctgtacctataggcatacacatgcttatgaatggttcggttgtattaactcaagttgtgggtggagattctattaaaaaattgcaagaactaaaggcccccaacatttatattccatcttatattttaaaataa

SEQ ID NO: 2362 - DNA, 840 bp, Staphylococcus epidermidis
aagggtgagtttgagaaaaggagaaaacccatgaaaagaagcgataaatatacggatgattatattgaacaacgttatgagtctcaacgacctcattacaatacatattatcaaccaatagggaaaccaccgaaaaagaaaaaaagtaaaagaattttcttaaaagcaattatcactatattaattttattgattatattttttggtgtcatgtactttatttcttcaagagcaaatgtagatgatttaaaatcaattgaaaataaaagcgattttgttgctaccgaaaatatgcctaactatgtaaaaggcgcatttatttcaatggaggatgagcgtttctataaacatcatggctttgatataaaaggaacgacaagggcattgttttcaactattagcgatagagatgtgcaaggtggaagtacaattacgcaacaagttgtaaagaattattattacgataatgaacgatcctttacaagaaaaatcaaagaattgtttgtagcgcgtaaagttgaaaagcaatacagtaaaaatcagattttaagtttctatatgaataatatttattatggtgataatcaatatactgtagaaggtgctgcaaatcattattttggtgtaacggtcgataaaaacaattcaaatatgagtcagattagtgtgttacaaagtgctatattagcaagcaaagtaaatgcaccaagtgtgtatgatgtaaatgatatgtcgaataattacatcaatagagttaaaaccaatttagagaaaatgaaacaacaaaattttattagtgaatcacaatatcaagaagctatgtctcaacttggaaattaa

SEQ ID NO: 2363 - DNA, 1155 bp, Staphylococcus epidermidis
atagtgtatacttatactattaaaattagaaatgagattattatgaaaatagtagaagtaaaatctaagaatggtaccaattttatgattttagatggtaataatgaacctatagtagatgcagtaagatatttgaagtatctggatagtgttaagaaaagtttaaataccaagaaaacctatgcctatgcactaaaaaatttttttgtttacttagaaagtaaaaagatatgctataaagaagttagttttgataactttgttgattttataagatggatgaaaacaccttttgaatatgagaatgtcctctcttatcaccgaaaagaaaaaagcattagtcctaagacaattaatctgactatgactgtagtatctaatttttatgattatctctataggagtaaaaaattagatgttaatttctatgattttatgcatatggaaagtaaatactctaaaaaatataaaagtttcatgcatcacataaataaggactatagaacgttgaaaaatattttgaaagttaaagaaccaaagaaaaaaatagaagtgttaactaatgcggaggttaagaaattattagaggaagctaataatattagagataaattcttaatacaattactatatgaaaccggattacgtataggtgaggtattatcattacgtattgatgatattaaatttgactttagaaaaggccatcaaatagttttgaaaaatagatttaatgataatggtacttatttgaaaactggggaaagaaaaatatttatttcccaatcgttaattgatttatacgatgattatgtctacgaaataattgacgaactttcaatatgttctgattatctttttgtaaaaataaaggggagaaatgtaggagaagctatgaattatagtgatatatattcattatttaaaaggctaaaacataaaacatctataaatgttcatcctcatttatttcgccatacacatgcaactgttttttataatgaaactaaggatataaaacaagttcaagaaagacttggtcatagtaatatacaaacgactattaatttatatgttcatcccactgaagaagatatacgtgaagattggaataaagtaaagcatcaatttcaagtttttaataaaggggaatga

SEQ ID NO: 2364 - DNA, 1089 bp, Staphylococcus epidermidis
gaggcacatacaactatgaaagacaacaaacctaataattcgaaattaattcaaacatatttaagtaagaaaactttaagatatggtacagcaagtgcattaacattggcactctatttatttaacagtaacgtaactgtgtatgcggatgaaaatactgcaaaccaaaatcaaggaacatcaccaaaaatttcacagacagcacctacaaataatactgaaaatacagatgccacagccataacaacagatcaaaataataatgatgaagaagaatacgatgcgtcatatgaacttccaattctttatgtaactgtctggctagatgatcaaggaaatattattaaagatgctgtggaagatgctaaaacccctgcttcagaaaggcaaccggtgaaaattcctgggtaccaacattatagaacttctgtgagtgacggaattactaagtttatttatcgtaaaattagcactgcacaatcacctatagttgaaaataatcaacaagataataatacaaataaagttgttgaaacaaccaatcaaaataaagatgaagtgaatggaaaagaacaaaatcaagcaaatacttcagtaacaaatacacaaattaccaaaaacgagaaagacgaagacacaaaaacactaaagaaagataaagatgagaaagaatctaaagacacaaaaacaccaaagaaagacaaagaaaagaaagacataaaaactccgaagaaagatagagaagagaaaaaaccagtaataccaagtaacggtaaagtcgagaaagacgaagacacaaaaacaccaaaaaaagacaaagaaaagaaaatcacaaaaactttgaagaaagatagagaggagaaaagcccagtaataccaaaaagcggcaaagacgagaaagacacaaaaataactaagaaagacaaagaagacgaaattacaacaacttccaagaaagataataacaatgatgtacaagataaattaccggaaacaggtaaaacaaaagatattcaaaatcctgctttaataatgttacttactggattaggtttattaggattatttagaaataaaataagagaatag

SEQ ID NO: 2365 - DNA, 711 bp, Staphylococcus epidermidis
ataaaggagtttcataaaatgtacgacataaccaagtggaaacatatgtttaaattagatccggctaaatcaatttcggatgaaaatttagaggcactgtgtatgtctaacactgatgcaataattattggtgggacagatgatgtaacagaagataatgttattcatttaatgagtagagtaagacgttatccgttaccacttgtcttagaagtttcgaatgtagaaagtgtgatgcctggttttgatttctattttattccaacagtcatgaatagtaaggatacaaaatatcataacgaaattttactagaagcccttaaaaaatatggacatgtgattaattttgatgaagtttttttcgagggatatgtcgttctaaacgcaaatagtaaagttgcaaaaattaccaaagcttatactcaattaggtatagaagatgtcgaagcatatgcacaaatggcagaagaattatatcgatttccaatcatgtacgtagaatatagtggcacatatggagatgttgataaggttaaagcgattgcaaatatgcttcaacatactcaattattttatggcggtggtataacaaacattgacaaagctaacgaaatgtctaacattgcggataccattgttgtcggcgatattatatataacgacattaaaaaagcattaaaaactgtaaagataaaggagtctaataaatga

SEQ ID NO: 2366 - DNA, 153 bp, Staphylococcus epidermidis
atcacctggtttcgggtctacgaccaaatactcaacgcgctattcagactcgctttcgctgcggctccacatttgctgcttaaccttgcatcagatcgtaactcgccggttcattctacaaaaggcacgccatcacccattaacgggctctga

SEQ ID NO: 2367 - DNA, 579 bp, Staphylococcus epidermidis
tctaaatggttaaatacgataaaggtggtgtggagtatggtaaaggaatccatacctaaagaaggagaaaacattaagattcaaagttataaacatgatggtaatattcatcgtgtctggtcagaaaccacaattttaaagggaacggaacatgtgattattggtggtaatgatcacactttagtaactgaaagtgatgggcgtacatggattactcgagaaccagcaattgtgtactttcattctgaatattggtttaatgttatttgtatgtttagagaagatggtatttattattattgtaatttatcttcgccttttgcatgtgacgaagaagcgttaaaatatattgattatgatttagatatcaaagtttatccgaacggaaaatatcatttacttgatgaagatgagtacgagcaacatatgaaccaaatgaattatccacacgatatcgatattattttaagaagaaatgttgatattttacaacaatggatagaacaaaaaaaggggccttttgctcctgactttataaaggtatggaaagaacgttataaaaaaattagagattattaa

SEQ ID NO: 2368 - DNA, 240 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattcccgatactgaattcgatgaattcagacatcatcgaggtgcaacatcataccatccaaaaatgatgttaaaagtagttttatatgcctacacccaatctgtgtttatatga

SEQ ID NO: 2369 - DNA, 126 bp, Staphylococcus epidermidis
actaaattaacaaggtgccctaagtataaaaattatgacatgactcaacttactctaccaatggaaacttcagtaatcattttacctattaacgattgtactcttatgcttttactatatgattaa

SEQ ID NO: 2370 - DNA, 303 bp, Staphylococcus epidermidis
ccattcgcaactttaccagaacagtttgaaacaatttatcaatatatgatagatcaaaataaagtgagcagaccagtgctttcagacgaccaactttcgcaactaaatatacatttacatgaagcactacaacaatcacgcccagtcaatatcaaatattacgaagaaggatatattaactttatagagctcattgtacatcggattgattcaataaattatgagattgaaggtactgctcctcattcaagagaacgtcataaagtttcatttttagatattatagatatttcttttatataa

SEQ ID NO: 2371 - DNA, 168 bp, Staphylococcus epidermidis
aataataaaacaaatggtgcaaagataaaacaaatagaaataaggaaacagaatagaataagtaatgcaatgataacaaccggtattaaaataataaataacgacaaaataccaagacttaacgatgctagtattgctcttactatgtttgctaaggttggtttgtaa

SEQ ID NO: 2372 - DNA, 1209 bp, Staphylococcus epidermidis
atgaagcgaacaatatttttactcatgtcgatactgttattattaacggcttgcggagatggacataaacaaacttcatcagataaagaacaaagtgaacataaggataaccataataaaaatcaagtgaaacaaatagcgactgataaaaaagttcaaggtgataactataggactatattacccttcaaagaaagccaggctcgtggattattacaagataatatggcaaatggttataatggagaagattttgaaagtggtttactagaattaagtaaagaaatctttccaacaaataagtatttatatcaagatggacaatatttagataaaaaaacgattaatgcatacttagatccgaagtatacgaaaaaagaaattgacaagatgagcgaaaaagaaaagaaaagcaaaaatgctaatgagaatcttggactcaatccatctcacaatggtgaaacagatgaagagaaaatagctgaaaattctccagcctatctttcaaatatactcgagcaggatttttatggaaatagtgattctaaaggtaaaaatataaaagggatgacaattggtttagccatgaatagtgtttattattacaaaaaagagaaagatggcgaaacatttagtaaagatttatctgataaagagattgaaaagcaaggtaaacagatggctagtgaaatgctttctcgtttacgtgagaatagtgatttgaaagatattcctattcattttgctatctataaacaatcaagtcaagattccattacaccaggtgaatttatagttggtactacggttgaagagggtaaaactaaaattaactcttgggataatattaatgaaaaagcagccttaattccttcgtcaactgcagctgattatgatgaaacgctgaataataactttaaacagtttaatgataatttgcaatcgtatttttcaaacttcacacaagcagttggtaaggttaaattcgtaaataaaaaagctaaacaacttacagttgatttgcctatagattattacggacaggcagaaacgataggtattacacaatatgttacagagcaagccgaaaaatattttgataaactagatgagtatgaaattagaatcaaagatggaaatactccacgtgctctcattagtaaaactaaagacgataaagaaccacaagttcatatctatcataattag

SEQ ID NO: 2373 - DNA, 147 bp, Staphylococcus epidermidis
cagaatttgacaaaaagcgatataatcataataatattcattgtacattttgcacataatcaaaacaaagtagatggaaattttttaattttaggagtaataaattatgataatatcaaacaaatcccctatttctatcaacaatga

SEQ ID NO: 2374 - DNA, 294 bp, Staphylococcus epidermidis
gggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgtgggcgtag

SEQ ID NO: 2375 - DNA, 2076 bp, Staphylococcus epidermidis
aggggaatgactatgtcaataccaattaatttacctacaaacagtactatgattaatgaattatgtacattacaaagtagaaccatcaatataaaaggagaggttttaataactgaaatatatgatgattacttttttaaaaatgatgagtggcacattacagcttttaacaaattcaagcaatttcaagatagtatcaagaactatagagacaaaagaaaaaatgttttctttaggattaaaagtaaaaatttgaatttagaatttaaatacctttttttgaaactgatagttaaagaggattggtccttatctaatttatttaatactggagcagtaaagcttaataagattgctaagttctttaatgaagtttatccaaatttaaattctttacttgattgtgatataaatacattagaaaagcactggtttaattggctgactgaaaataatataccaataaaaagaagatcatcaacaatagtttttggtgattatgaatacaaaagcggactggcttcttttttaaagaatatgtacattaatctaattaagttcattgataagcgagaagaatgggaaaaagataaatgggatattagaaatttagaaaaatatggattgagttataataaaacactaactggcaattatttaaactttgaaaaaattgagtcaattaaaatgcgagaattagcaaaaaaatatttaaaaaatcgtttgataactggtgatatagcatttgctacagcaaggttttatataagagttttaactaggttttttcaaaatatatctaaaaataaagaaacaaggaatagtttaaatgaactagatagatgtcatatcgaagcatatatagaatttttgtttgaatatgcagctaataaacatttgcaaagtactaagaattttgtgagagaagaattaaaaacaattagaaggttcttaaacgatattataactcaaaactatgctatagcaccgtaccaagatatacgatttttaatttatcctcaagacttacctaaacacgaaaagaaaaatagtagccaaattgattatatcccagattttgtattggaacagctttttgagcatataaatgatttgcataaagatttaatacctgtagtttggatagcttttaaaacaggattaagaatttctgatgtattgacattacaaaataattgccttgcaaaagttaatggaaagtattcaataatcacagatattgctaaaacttttgttaaaggacatagaataccaattgataataaattagctgatataatagcagttttaatagccgattctaaaagtaaaagtacaaaagataataatcctaataattatatttttgctatttataaaggaaaaagaaagggaatgccctttacacaacatatggtcagagcacacttaaatcatttatcaaagactaaaaatattattgatgaacaaggagaaatcttccatttcaaaactcatcaatttagacatacctatgcagtaaaattgttaaatggtggagcagatatattaacgatacaagaattattagcacactcctcaccagaaatgactctaagatatgctaagttacttgatgatacaaagagaaaggcttttgaatcagttattgatcaaggagcttttagttttgatgttgacggtaaaattaaaaatatacagcatagtagtgaactatctgaaaaagcattgaattctttatggcaagaacataaattaaacgcaatggacaatccttatggcacttgtcatgctagattgagtggtgattgtccatacatggaagctccgccatgcctgacttgtaattctgggaaaccatgtaaggatttagctattggattttctgatttagatgttgaaaaatatgaattacatatcaaatcaacggtcaaatctatagaattagctaaaaataataatagacaagatatggttgaaaagcatataaatatattaaataaatatgaagaaatactaggtaatataaaagatggaaacattatattcgggagaagtaatagaataaaagtatag

SEQ ID NO: 2376 - DNA, 351 bp, Staphylococcus epidermidis
ctgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtag

SEQ ID NO: 2377 - DNA, 126 bp, Staphylococcus epidermidis
agctgtaagacccacacccataacgatatgtgtggctgtgtccataaatgctcactcttttcatctttatttaatatatattataatctaaaagttgaaataacaaaattaacttactttaaataa

SEQ ID NO: 2378 - DNA, 249 bp, Staphylococcus epidermidis
tcaccgaagacatatgtaaagacaacagcaaataacgcaccaataactgttgctggcaaccttttataccccttttttaatgatgctttagcagtaggttcaattgtaacaattgcagtaagtatggcaaaaattggagtgaggtttaacaacatacaaaataaagacgtaaaaaaagtagccaaaccagttttaatagttcgcgctccaattatatgtctataccatttatcattcatatcatactga

SEQ ID NO: 2379 - DNA, 1476 bp, Staphylococcus epidermidis
atggggaggacgcttaagatgagtattcgttttgaatctatcgaaaaattaactgaattaatcaaaaataaagaaattaaaccttctgatgtagtaaaagatatatacgcagctattgaagaaactgatccaacaatcaagtcattcttagctttagataaagaaaatgcaataaaaaaagccgaagaattagatgaattacaagctaaagatcaaatggatggtaaactatttggaattcctatgggaatcaaagataatatcatcacaaaagatgtagaaactacatgtgcaagtaaaatgttagagggatttgtacctatttatgaatcaactgtaatgaacaaactacatgatgaaaacgcggttttaattggtaaattaaacatggatgagtttgcaatgggtggctctacagagacttcatattttaagaaaacattaaatcctttcgatcacacagcagtaccaggaggatcttcaggtggttctgcagcagcggttgcagcaggtttagttccttttagtttagggtcagacactggtggttctattagacaacctgcatcttattgtggtgttgttggtatgaaaccaacttatggccgtgtatcacgtttcggtttagttgcatttgcttcttctttagatcaaattggaccaatcacgcgtaatgttaaagataacgcattagtacttgaggcaatttccggtgtagatgcgaatgattctacaagcgcacctgttgatgatgtagattttacttctgatattggtaaagatattaaaggtcttaaaattgcattacctaaagaatatttaggtgagggtgtaagtgaagaagttaagacttctgtaaaagaagcggttgaaacgttaaaatcacttggtgctgaagttgacgaagtctcattaccaaatacaaaatatggtattccatcatattatgttattgcgtcatcagaggcttcagcaaatttagcgcgatttgatggtattagatatggatatcattctaaagaagcacaatcgttagaagaattatataaaatgtctagatcggaaggctttggtgaagaagtcaaaagacgtatcttcttaggtacttttgctttaagctcaggttattacgatgcatactataaaaaatctcaaaaagttagaacgttaattaaaaatgattttgacaaagtatttgaatcttatgatgttgtggttggaccgacagcacctacaacagcatttaatattggcgaagaaattgatgatcctttaacaatgtatgcgaatgacttattaactacaccagttaatcttgccggtttacctggtatttcagttccttgtggacaatcaaacggacgcccaattggtttacaattaattggtaaaccttttgacgaaaaaacgttatatcgtgtcgcttatcaatttgaaacacaatacaacttacatgacgcatacgaaaatttataa

SEQ ID NO: 2380 - DNA, 126 bp, Staphylococcus epidermidis
actactcccgcatatttaaaattggagcggaagataggatttgcacctatatctcattccgggaaggaatgtgttctgagagttgaactactcccgcataatattaaaatttggagcggaagatag

SEQ ID NO: 2381 - DNA, 159 bp, Staphylococcus epidermidis
ttaataaacgcggtgcttatgagcatctttatagtattcaaaatttataaagcacttataacattgaaaatgcctgagactgttattgtctcaggcatttttgtactgttggcagttattaaaaataagaactattttacctataatcaaaactgctaa

SEQ ID NO: 2382 - DNA, 921 bp, Staphylococcus epidermidis
actattgacgcgaatattacaattgtaatattattgatttatagaaattacaactgtaatattggagggtatattttgaaaaagttaatacttttaattgcaattgctttagttttaagtgcatgtaattcaaccagttcacatgctaaagagttaaataatttagaaaagaaatataatgctaatattggtgtctatgcattagatactaaaagtggtaaggaagtaaaatttaatgccgataagagatttgcctatgcttcaacttcaaaagcgataaatagtgctattttgttagaacaagtaccttataataagttaaataaaaaagtacatattaacaaagatgatatagttgcttattctcctattttagaaaaatatgtaggaaaagatatcactttaaaagaacttattgaggcttcaatgaagtatagtgataatacagcaaacaataaaattataaacgaaatcggtggaatcaaaaaaattaaaaaacgtttaaaaaaattgggagataaagtaacaaatccagttagatatgaaatagaattaaattactattcaccaaagagcaaaaaagatacttcaacgcctgctgctttcggcaagactttaaataaacttatcgcaaatggaaaattaagcaaaaaaaataaaaatttcttacttgatttaatgttaaataataaaaacggagacactttaattaaagatggtgttccaaaagactataaggttgctgataaaagtggtcaagcaataacatatgcttctagaaatgatgtagcttttgtttatcctaagaaccaatctgaacctattattttagtcatttttacgaataaagacaataaaagtgataaacctaatgataaattgataagtgaaaccgccaagaatgtaataaacaaattttaa

SEQ ID NO: 2383 - DNA, 447 bp, Staphylococcus epidermidis
gggggcagagcattggcaagtattagagaagatgtccaatttagtaatccaaccatatcggaaagtagttttaaaataaatgaaaactttgactcagaaaatttcgaaggatttggtgatattaagttgaatctgaaaaaatattattatgaagaaaataatgagattgataataataataataataatggttcagcacttttaagtttagaaataataataggcgatattgactggaagtatccttttatgtttaaagtagaaatcgaatctttttttgaatgggaaaatttcaaaggaactgatatagataaatttttagaaattaatggagctgctattttgtattcatacagccgtgcacatataagtcatattactaatacaagcaaatacccttcatttgatttacctttttataatttcacagacaatgattatcaatag

SEQ ID NO: 2384 - DNA, 1113 bp, Staphylococcus epidermidis
ttaaaaggagcatttaatttgagacttggagctcggattttcaaaactggtatagccattatcttagctatgtctatcgcttctttacttcctgataatattggtctaaaaacgttagcaggtgtcagtgcagtagttgccatgcaaccgagtgtttatcgctcaatcaaaactgtttctgaacaagctattggtaatgtgattggtgcattacttgcagtaacaatggtaacgatattcagtaataatttcattatcatgggcgttaccgttattttactcattgcaattttgttccaatttaatcttgcccatgtagcaacacttgcaagcgtaactgcacttataattatggggcaacacactggttctttctatgttgccgcattttttagatttgtactagtgatgattggtgtattgagttcttctgttgtcaatctaatttttttacctcctaagtttgaaacaaaaatttattataattctatgaatatttcttctgatatatttgtttggtttaaacttgtactcaatgacacatcagaatttcataatattaaacaggatggtgatcaactaaactcacgcatcaataaattagaaaagattttcgactattacaatgaagaaagaccattaacaaaaaaacatatttatcaacagaatagaaaaaaaatactatttagagaagtagttagaacgaccagacaagcatatgaagtgctaaaacgaatgtcacgatatcaaaatgatttatatcaactaaataatcaattacttttacaaatcaaattagaacttgattcattagttactttacatgaacaaatatttaagagtctatcaaaaaaagctagatatgatgtcactcaattagattatgaagttgacaatcctcagaagaaaaacttgatggatgcttttcagcaagaattaattaaaaacccacatcagacgcaatattcttatagcaatatgatgcaaattattgctgaaattgaagaatacagatatcaacttgaacacttagatagaatccgtttaagtttctttacctatcaccgttctgatactgatatagacatttcagatgaggactttgacttataa

SEQ ID NO: 2385 - DNA, 318 bp, Staphylococcus epidermidis
ggaggcttttatttaatgactaaagtaacacgtgaagaagttgaacatattgctaatttagctagacttcaaatttctcctgaagaaacagaagaaatggctaatactttagaaagtattttagattttgcgaaacaaaatgatagtgccgatacagaaggtattgagccaacttatcacgtattagatttacaaaacgtattacgtgacgataaagcaatcgagggcattcctcaagaattagcattgaaaaatgcgaaagaaacagaagatggtcaatttaaagtgccatccatcatgaatggggaggacgcttaa

SEQ ID NO: 2386 - DNA, 213 bp, Staphylococcus epidermidis
gttaaaatttacttaatgagtgaatatatatctacatatagtacattatatttatatagtgtaaatactttcgttttgtacatctgcaaaacgaagtcatatgtaaaaagaaagaggctgtacaaattattacagcccctactacttatatacgattatttatatgaaattgctaaacagtcatactatttcatcattactttatctcaataa

SEQ ID NO: 2387 - DNA, 648 bp, Staphylococcus epidermidis
gcatgctttctaaaaaatgttgcgcaaaattgtataatgacacctgaggagagtagtaaacaagtgaaaatcatcgataaaaaaattgagcaatttgctcaatatttacaacgtaaaaataacttagatcacatacagtttttaaaaattcgtctaggaatgcaggtactagcgataaatattgaaaagtctatagttgtgtatgggctagcaataatctttcatactttcttttacacacttttaactcatttaagttattttttaattaggagacatgcacacggtacacatgcaaattcgtcattgttatgtcatattcagaacataattttctttattatttttccatacttaataataaagttagatattaactattttgttcttttatctatggcattagtcggattaattattacgattttatacgcacctgcagcaactaagaaacaacctatacctagacgtcttgtaaagcgaaaaaaaatactctccatatttttatattgtactatcgtagttatttcattagtaactaaagaaccggtaaataaacttattttattcggtgtaattttagaatctttaacattactacccatctttttccctaaggaggatattaatcatggaaaacatttttaa

SEQ ID NO: 2388 - DNA, 300 bp, Staphylococcus epidermidis
gtcgtccttctggaagaagggttacaaaaattaatagataggcatcatattacagcaacaataaatcgaatctatggctcactgacattgtatttcacaaatgaaaaagttacacattatgaacaagttgaaaactctgatggagatgctttcgctcaattctttaaattaatgttgaaccaaggcattaatctcgcgccttctaaatttgaagcatggttcttaactacagaacatactgaagaagatatcgatcgcacactagaagcagctgattatgcatttagtaaaatgaaataa

SEQ ID NO: 2389 - DNA, 1083 bp, Staphylococcus epidermidis
caatacattcttatgaagctaatagagaggaaaggttttatgtatctagaaaattcttttaaaaaagatattgaagattggtttcataaaaatcaaagagatatgccttggagagaaacgactaatccttattatatatggctaagtgaagtgatgttacaacagacgcaagtaaacactgttatcgattactactatagatttatacataggttccctacaatacagtcgttgagcgaagctaatgaagatgaagtgctgaagtattgggaagggttgggctattatagcagagcgcgtaatttccatactgccgtaaaagaagttaataataattatgatggtgaggtaccatacgatcctgaatcatttaaaaagttaaaaggtgtgggtccatatactcaggcggcggtcatgagtatagctttcaatcatcctttagcaactgtcgatggtaatgtttttagagtatggtcacgattaaacaatgactatcgtgatataaagttacagtccactcgaaaagcattcgaacaagaattacacccgtatgtgttgaaggatgcgggaacatttaatcaagcaatgatggagctaggggcgttagtatgtacgccaaaatcaccattgtgtttgttttgtcctattcaagaacactgtgaggcatttcatatggggactacacaagaattaccagtaaaaaccaaaagtttaaataagaaaaccattgagcaaaaagtttttcttattcgtaatgataatggtcaatatttacttgaaaagcgtaaagaaaaacttcttaatggtatgtggcaatttccaatgagagaacaaacaaatgcaaacgatgtgatatctgatgatttaggaaaaagtatcgaaacaattaacgaaccagtatttaaattaaagcatcaatttacccatcttacatgggaaattaaagtatacaatgttacagcacctcttaatataaaggaaaatgatttacctaaacaaatgacgtggtttaatttagatgatagggagcagtatacatttcccgtaccaatggataaaatatataagtttattgaaggttaa

SEQ ID NO: 2390 - DNA, 165 bp, Staphylococcus epidermidis
ccgctacactacgggaccattaaaacggaggaagagggattcgaacccccgcgagccgttaagctcctgtcggttttcaagaccgatcccttcagccggacttgggtattcctccaaaattatatggaccttgcaggactcgaacctgcgaccgaacggttatga

SEQ ID NO: 2391 - DNA, 336 bp, Staphylococcus epidermidis
cactctatatatcaaagtgctaaatcacatgtaaatgaaggaggaacaatcatgcttaaaccattaggaaatcgtgtgattattgagaagaaagagcaagaacaaacaactaaaagtggcatcgttttaacagatagcgctaaagaaaaatcaaatgaaggtgtgatcattgcagttggacaaggtcgtttattagacaatggcacacaagttgctcctcaagtcagtgaaggtgacacaatcgtcttccaacaatatgcaggtactgaagtaaaacgtggcgacaaaacatatttaattttaaatgaagaagatatattagctattatagaataa

SEQ ID NO: 2392 - DNA, 126 bp, Staphylococcus epidermidis
ataaacatatacaaagtaatgtattatagagtcatgttaaagttgaacttaagaatgcttttaacaatacattcttatgaagctaatagagaggaaaggttttatgtatctagaaaattcttttaa

SEQ ID NO: 2393 - DNA, 249 bp, Staphylococcus epidermidis
gagatatctctttcatgccataaaggtatattctcgtatgcagtagtaatatatcctcgaatcacacgagatatacctgtaatattttcagaaccgattggatttcttttatgtggcattgctgatgatcctttttgtccttttgcaaatgcctcttcgacttctctagtttcagttttttgtaaattacgaatttctactgcaaatttttccattgatgtagcaattagtgctaatgtagcaatgtaa

SEQ ID NO: 2394 - DNA, 129 bp, Staphylococcus epidermidis
ataaaaccatatttgttttactataccgcaaatacgggaatatcaattttaaaagtaaaacataaaaagcaaaggagattgttatgtcaaaaaaagagaaaacaacttctaaatatcttaattcaatag

SEQ ID NO: 2395 - DNA, 957 bp, Staphylococcus epidermidis
caatatatgtataaggagatattgaaaatgacaaaaacttttattttcgggcacaaaaatccagatactgatgctatttcttcagctttaattatggctgattttgagcaacaaactggtaatactgaagcaaaagcttatcgtttaggtgaaataagtgcggaaactcaatttgcactagattattttaacgtagaagctccagaattattaaacgaagatttaaaaggacaagatgttattttagtcgaccataacgagtttcaacaaagtgcagatactatttcaaacgctacaattaaacatgtgatagatcatcacagaatttctaactttgaaacagctggccctttatactatagagcagaaccagttggttgtagtgcaacaattttatataaaatgtataaagaacgtggatttgaaattaaaccagaaatcgctggacttatgatttcagctataatttctgatagtttattatttaaatcacctacctgcacaaaagaagatgtagatgctgctcaagcacttaaagatattgcaaatgttgatttagaagcatatggtttagaaatgttaaaagcaggtgcttcaactacagataaatctgctgaaacacttgtcaatatggatgctaaatcattcaatatgggagattatgtaacacgtattgctcaagtcaatactgtagatattgatgaagttttagatcgtaaagaggaatttgaaaaagttatgttagaaatgagtgccaatgaaaaatacgatttattcgttcttgtagttactgatattattaacagcgattctaaaatccttgtagttggtgctgaaaaagataaagttggagaagcatttaaagtacaactagatgatggtatggctttcttatctggcgttgtatcacgaaaaaaacaagttgttcctcaaatcactgaagttttaactcaataa

SEQ ID NO: 2396 - DNA, 492 bp, Staphylococcus epidermidis
tatatacagtatattcctgatgaaatagagatttctactaatttttcgaaatcactttacaaaagtgtgtatattgtatatattatgtatatacagaagaaaagggggacatcaatgaaaataattttgaagaacaatagtgaaagtcctatatatgaacagattaagcaacaaattaaagaaaatgttttgaaaggttatgtttcccctggtgaacatcttccatcaatgcgtgagttagctaaagatttaaaagtgagtttaataacgacaaaacgagcatatgaagatttggaaaaagatggatttgtaacaactattagaggtaaaggaacctttgtaaaggaacaagataattctattctaaaggaaaagcaattttttgttattgaaaatttagctcactctatgtcaaaagaagccaaaacaattggaatgcctttagaggaattaatagaaatattgactatgatttatgaggaggacgactaa

SEQ ID NO: 2397 - DNA, 150 bp, Staphylococcus epidermidis; identical to SEQ ID NO: 39

SEQ ID NO: 2398 - DNA, 132 bp, Staphylococcus epidermidis
cacccgtttcattgtatagaaaagaatagaatagaattcgaattaagtttaatggtcaatccattaccaaaggaatatatttgcaatttgatgttattgatgattttgactcatttttcaagccgtcaataa

SEQ ID NO: 2399 - DNA, 135 bp, Staphylococcus epidermidis
aactctattcactcggttttgcttggtaaaatcttacttacttatccagttttcaatgtacaaaatataatggtggagactagcgggatcgaaccgctgacctcctgcgtgcaaagcaggcgctctcccagctga

SEQ ID NO: 2400 - DNA, 192 bp, Staphylococcus epidermidis
gtggtagctcaaatgagcaaaaagtttagagttgaagataaagaaacaattgcagattgtctcgacagaatgaaaaaagaagggtttatgccaatacgtcgtattgagaaaccagtttataaagagaacaaagatggcagtatagagattttaaaacaggatattatatttgtaggtgctttaatccaataa

SEQ ID NO: 2401 - DNA, 1137 bp, Staphylococcus epidermidis
gcacacaatcattatttaaaatatatgaggagttataacatgtttatcaatgcaaaagatttcggattaaaaggaaaaagtaaatataaggatacaagagcgattcaaaaagcattaaattacgcaaaaaaaggcagacacactgtttatatacctaaaggaacttattatatcagaaaagctttagttatttatgattctacaacattgttattggaagaaggtgcaacacttttaagaaaagggaaagatgcattattaaaaaatggtagacgcttaaagctatatcatggctataatggaaatagtcacatttatattaaaggaggaacttttgatatgaatggaggcgaatatccatataataatacagccatgtgcatgggacatgcagaagacattcaaattttaggtgtaacattcaaaaatattgttggagggcatgcactcgacgcatgcggaatcaatggtttacacatatcagaatgtgaatttaaaggatttcttgatattgatggagatcgttctttttctgaagcagtacaattggacatacaagtacctggtgcttttcctaaatttggaactacagatggaacgattacgaaaaatgttgtcattgaaaaatgttattttggctgttcagatcatcctaaaatgaaagcgtggaatagagctattggctctcatgccagtagatataactgctattatgaaaacattcatatcaatcaaaacatctttgataatttaaatgagtatgctttaactcctctaaagtcaaaagacacatttattacaaaaaataaatttataaattgtaatggtggaataagatttcttggagtgaaggatggtaaaaatgctgccgatcctattacaggacaagtgatggaaactcaagctggtgagaatttcaatgtgataggtaatacttttattggtaagatgaaaagagatgcgattcatattagaagttatcatcacgtccaacatcaaaacgtttttatagcggcaaatcaatttgaagatgcttcacaatcaatacatttagaaaatattaatggacttactttaaatcaggaacaaacaaaaatcaaaatcaagagtattgatgtgaaaaacatcagtaattaa

SEQ ID NO: 2402 - DNA, 546 bp, Staphylococcus epidermidis
atgaaactacattgtgcatatgctatattaattagaacaagagtgaaagtggtgactcaggtgcgaattcaaagtagatggttaatattcgctatttttttaactggagctatttctttattgataggtttgacttattacaaaagtataaaatctgtggatttatctggttacagtgtgaatcaaattagtttaaatcatggttttaatcaaaaaggatttgtggttaataagaaaattaaattagatagatataccttttacaatgataaaaatcataaagattttacagtaaaagtaaaaaataaaacgcataaggttaaaggcatggttttagtcaaagatgataaagttgaaacaaattttggtattaaaatgggtgacccaattgataaagtcatcaataaattgggagaaaactacaagattaataaagtagggaaaaattatcactcaatgacttatgtagaccgttttaataaattaaaattaaacattttatataaagataacattgttaaaagaattgagttctttagtaaataa

SEQ ID NO: 2403 - DNA, 144 bp, Staphylococcus epidermidis
gtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtga

SEQ ID NO: 2404 - DNA, 687 bp, Staphylococcus epidermidis
cagacttttaaattaacaataattttctggcaaggggtgagcagcaatatgaaagccactagagtatttaatgttgtagtatttttacaattttccacctatttactatttggtatgaatatacaacttctttttgacaagaaagaatctgattaccttttctttattatacctttattttttacatatatatttgataactcatatacagtattaatagatttttgtaaaccaactgaaaaattaaaaaaagttgaaagtaataacataagatttataaatataattatgcttctagctataattatatatgcgtatatatataaaaataaaaaaattagatggttcaaggatttagtagattcagccaatgaaaactggtgtttatcaataattttaataataattatgtcgcttttaatttcatatatttggtctaaatattttattaaatcagattatatagaaaaattaaaagaagaagattttgatattcttggaatagaaaatgttattaattggttaacaaaatcaaatattaaaagtaaagatatttcagaaggtacaaatgttgagattgaaaaaatagaattacttcttaaagatgaaaaaaatattgatgatttttcttatggagaagtaaaatccattttggcttatgttaaatatgttagagaaagtaaataa

SEQ ID NO: 2405 - DNA, 1305 bp, Staphylococcus epidermidis
aaagaggttaagacaatgatgaatccattagcccaaaaattgaatgatgaaataaagcaatcaagtccagaagtattagatatgatgtcacaattaggtaaagatatgttttatccaaaaggaattttatcgcaatctgccgaagcaaaacgcacaacatataatgctactattggtatggcaaccaaaaaagaaggtaaaatgtacgcaaattcacttaaccaaatgtttaatgaccttacaccggatgaaattttcccatatgcacctcctcaaggtgtagaggaattacgtgatttatggcagaaaaaaatgcttaaagaaaatcccgacttaaagtctaaatctatctctcgtcccatcgttacaaatgctctcacgcacggtctttctctagtagctgatttatttgtagatacagatgataccgtcttattaccgacacacaactggggcaattataaacttgtatttagcacacgtcacggtgctcatatcgatacgtattctatttttgataactcaggtcacttcactacatctgaacttgtaaaaacattaaaagaatataaaaaagacaaagtgattattattttaaattatcctaataacccaactggttacacaccaaataaagaagaagttaatactattgtaaatgcaattgaagaactagctaataaaggtactaaagtagtaactgttgtcgatgatgcatactatgggttattttatgaagaagtttaccaacagtcgattttcacggctttaacacaggtgaaatcttcaaaccttttaccagtgcgtttggatggagctactaaagaattcttctcttgggggttccgcgttggctttatgacgtttggaattgatcatgaaacgttaaaaaatgcgctagaagctaaagtaaaaggattaattcgtagcaatatttcaagttctccactaccttctcaaagtgcaatcaaacatgtacttaaacatcatgagcaatttgataaagaaatcgatcaaaatatcaatattttaaaagaacgctacgaagtaactaaacaagtagtgtatgataataaatatgccaaatattggcaagcctatgactttaattcaggatactttatgtcattgaaattaaatcaagtcgatccagaagaattacgtgaacatttaattaataactattcaattggtattattgctttaaatagcacagatattcgtattgcctttagttgtgtagaaaaagaagatattccttatgtctttgagtctattgctaatgcaattgatgatattaaataa

SEQ ID NO: 2406 - DNA, 534 bp, Staphylococcus epidermidis
tttatggctaacacaaatagaaaaagcaaaaaaatgtcagatgctaaatgcatcaaaacaagacaggtatatccacaagataccaatcatcatcacacaatgttcggtggaactttaatggcaaatattgatgaaatagctgctattactgctatgaagcacgctggcaacccagttgttactgcatcaacagattctgttgactttttaagacctattacaactggagatattttatcatatgaagcaatggtttcttatgcaggaacaagttcgatggagatatgtgttcaaattgttattgatgatgtttataaaaacgagcgccacttggccgctttaagttttttaacttttgtagcattggatagtgatggaaaaccaacatcagtacctgatgttgaacctgaaacatctgtagaaaaatggttccatgaaactgcgccacaacgtgttgctagacgtaaagaacgtcgtaaagaaagtatagatacaattgaatatttatctagagttagacatatcgaaaagtaa

SEQ ID NO: 2407 - DNA, 627 bp, Staphylococcus epidermidis
catgattataaaaagatgaaaacttcctatagaaatcaattagaaaaaaattatgactccagaattactggtaaaagattaaacgaagagactttattattcttgggaactggtgcgattgcacaaagggctgcttatttagccaaagcttttggaatgaaagtaataggggttagtaagtcaggaaaaaatgttgaacattttgatgaagtttatacaattgaagagttagatgatgttattgaaaaggcaaatattattgttaatgcattacctgaaacagaagaaacaatttacttattaaaaagaaaagatttcatacaaatggacaataatgccttatttataaatgtaggaagaggaacaattgttgatgaggaagtgctcatcaatgtactcaaagatcgattaatcagacatgcttatttagatgtttttgaaaaagaaccacttagtaaggacaatcctttatatgatttagataatgtgaccataactgctcatattacaggtaatgattctaataataatagagaagctacggacattttcaaaaagaatcttgagcattttctcaataattatgatgtaattgagaataaagtagacttagattatggttactaa

SEQ ID NO: 2408 - DNA, 123 bp, Staphylococcus epidermidis
ttactatataacattacagcaaactattcttataataacacagtattagatcattccccactgcaacacagagcttttctcagcatcaaaaaaacgccacatttaagtgacgtcataaattga

SEQ ID NO: 2409 - DNA, 381 bp, Staphylococcus epidermidis
atggccaataagcaagttgaaatatctatggctgaatgggatgttatgaatataatatggaataaaaaatcagtatcagctaatgaaattgtagttgagattcaaaaaaataaagaagttagcgataagacgattagaacattaattacaagactatataaaaaagagattataaaacgctataaatataataatatttatttttactcatcaattattaaagaagatgatattaaaatgaaaactgctaaaacctttcttaataaattgtatggaggggatatgaaaagtttagtgcttaattttgcgaaaaatgaagaattaaataacaaagaaattgaagaattgcgagacattttaaatgatattagtaaaaaataa

SEQ ID NO: 2410 - DNA, 156 bp, Staphylococcus epidermidis
atagtttgtaacgtttcgttactgtttattggaattaacgttgacatattgtcattcagttttcaatgttctttaacacttacaatacattattgtaacaaacagaatttattaagtcaagaattaatttgtatttcatttcttgtcatttcttaa

SEQ ID NO: 2411 - DNA, 297 bp, Staphylococcus epidermidis
aaatcttgtaaagaggtgattgaaatgaatttagaaaaaatatatgaagaaatttcaaacgaaattaaggcaatgacagatgatgaaataaaagaagtcagtgatattttgtatgaatctaaactcttgaatgtagattattcaaatctaaaaagtttcaaagcagatacaaagcatagttataaagttaaggaaaatgagtataatgtgattgaaaaaaatatcaatgagaagccgaatttagaaaatcatgaagttaaccaagttaaaaataataatataattattgcagcatag

SEQ ID NO: 2412 - DNA, 303 bp, Staphylococcus epidermidis
aagagaggtaattcaactatggaaaataaattagtacctggtattttaattggtgccgtaattggtggcgcggctgctcttgctgataaatctacacgtcattctttaaaacaatcattcaaagacatcaaagaaggaaatcgtacacgtaaaccttcaaaaataagtagcatcaaagatgaagtaatgtattggaaagatacattagatgaaatacgtcgtaataatcctgaattagaacgttctattaaagatgccaaagaaacttttgtaaatcgtaaaaatcaacgcttaggtaaataa

SEQ ID NO: 2413 - DNA, 1395 bp, Staphylococcus epidermidis
tttggaggtaattttatgacaataattagagataaatttaacaatagtaaagctttttttaatacgcataaaacaaaaaaccttaaatttcgaaaacaacaacttaaattactaagtaaaaatatcaaaaatcatgaaaatgaattattagatgccttatataaagatttaggtaaaagtaaggttgaagcatacgcaactgaaattggtatgcttttgaaaagcataaagctaatgcgcaaagagttaaaaaattggtcgaaaaccaaacaaacggatacaccactctacttattccctacaaagagttatattaaaaaagaaccttacggtacggtgcttattataggaccatttaattatccggttcaattagttttcgagcctctcatcggagcaatagctgccggaaatactgctatagttaaaccttcagagttaacacctcatgttgccattgtgatcaaggacatcattgaagatacatttgatgaagcatacgtttctgttgttgaaggtggtattgaagaaacccaaacgttattaagtctaccatttgattatatgttctttactggcagtgaaaaagtcggaaaaattgtctatgaagctgcagcaagaaaattaattccagttactcttgaacttggcggtaaatcacctgtcattgtcgatgatacagccaatatcaaagtagcgagtgaacgtattagttttggtaaatttactaatgctggtcaaacatgtgtcgctccagattatatattagttcagcggaaagttaaaaatgatttaataaaagctcttaaaaaaacaattactgaattttacggagaaaatattgaaaaaagccctgatttcggacggattgttaatcaaaaacactttaatcggttgaatgacttgattcaaattcataaagataatgttgtttttggaggtaatagttctaaagaagatttatatattgaacctactttattggataacataaccaatgacaataaaatcatgaaagaagaaatattcggtcccattttgcctattattacttatgataatttcgatgaagtacttgaaatcatccaaagtaaatcaaaaccactaagtttgtatctttttagcgaagatgaaaacatgacacatagagtggttgaagaattatcatttgggggcggtgcaattaacgatacgttaatgcatttagctaatcctaacttacctttcggtggtgtaggttcttcaggcataggtcaatatcatggtaagtattcttttgatacatttagtcatatgaaatcatacacatttaaatctacacgtctagaatcgagtttatttttccctccatataaaggtaaatttaaatatattaaaaccttcttcaagaactag

SEQ ID NO: 2414 - DNA, 225 bp, Staphylococcus epidermidis
gccaacatcctagttgtctgggcaacgccacatccttttccacttaacatatattttgggaccttagctggtggtctgggctgtttccctttcgaacacggaccttatcacccatgttctgactcccaagttaaattaattggcattcggagtttgtctgaattcggtaacccgagaggggcccctcgtccaaacagtgctctacctccaataatcatcacttga

SEQ ID NO: 2415 - DNA, 201 bp, Staphylococcus epidermidis
accacactcaatagcatcactttatataatattgtttgcggtctatttagtacaatgttacaatttaattgtatccacgtattatactacacaaccccaagtctggtaccagcagacttggggttttttggtcatctatttgcctttccattttatttccaaccaaatacgaaagacaatgagtatgccaccggtaattaa

SEQ ID NO: 2416 - DNA, 150 bp, Staphylococcus epidermidis
ttaaataacaattacaagtataatttaaatatttctctaatatacagtgtcaatttattttattcacataagaaaatagctatgaagaaatctatcaatttaaatttcttcatagctaatttttttcatttaaatttattgacggcttga

SEQ ID NO: 2417 - DNA, 588 bp, Staphylococcus epidermidis
cgctttttaaacacatattgggaggctgttctaatgagtaacaaagcattaatcattgtagattactcttttgattttattgacgataatggtaaattaacatgtggcaaacctggacaagaaattgaaacttttattactcagcgtataaaaaattatcataataatcaacaggaaatatttttcctaatggacttgcattatgaaaatgataaatttcatcctgaaagtaaattattccccaatcataatattcatcaaacaccaggtcgtgagttatatggcgaggtaggtagattatacaactcaattaaagaccaaatgaatgtacattatttagataaaacgagatacgattcattctacggtacaccattagatagtttattacgtgaaagacaaatcaatgatattgaaattgtgggtgtttgcacggatatttgtattttgcataccgctgtttcagcatacaatttaggttataacatcactatcccaattagaggcgtagcatcttttaatcaagatggtcatcaatgggcactctcccattttaaaaattctcttggtgcaaaagtagaagaataa

SEQ ID NO: 2418 - DNA, 171 bp, Staphylococcus epidermidis
acttcattaaagaacttagcaatcttattaagctttactgctccagtattaaataaattagataaggaccaatcctctttaactatcagtttcaaaaaaaggtatttaaattctaaattcaaatttttacttttaatcctaaagaaaacattttttcttttgtctctatag

SEQ ID NO: 2419 - DNA, 387 bp, Staphylococcus epidermidis
  modified_base (110)..(110): a, c, g, t, unknown or other
atgaaaataaaacagttttcttttcaacacatattatttctgatttggaaaaaattgcagattatatcgttttttctcagtgagggtgaaatcatattcaatgagtctanggataaactatcgcaaaaataccaaatccttaatggttctaatgaacacggacatgaagagttggacgaacttttgatttacaaagaaagtaagcaaacaggctatattggtttaacagaatattatcaaacatttaatgaattgtttggtagtggtgttgaaataaaagatgcatctatagaacaattgatgatttatttagaaaaaagtaaacataaacgaaatacaaattcaaaatacaaagtgagatttaactatgaagcaattaatgattag

SEQ ID NO: 2420 - DNA, 144 bp, Staphylococcus epidermidis
ctatttgtaaacaacaaaattcaagaatatttttattttaattattacttgataattaaatgtaagctaaagctttaccctaagcctaacaaaatttcaaaatttatgttagttcaatatagttgtatgtatagattaacatga

SEQ ID NO: 2421 - DNA, 132 bp, Staphylococcus epidermidis; identical to SEQ ID NO: 66

SEQ ID NO: 2422 - DNA, 1623 bp, Staphylococcus epidermidis
actatggcaaaagatcttaaattctctgaagatgcgcgtcaagcaatgttacgtggtgttgataaattagcaaacgctgtaaaggttacaattggacctaaagggcgaaatgtggttctagataaggattacacaacacctttaattaccaacgatggtgtaacaattgctaaggaaatagagttagaagatccatatgagaatatgggtgcaaaattagtgcaggaagttgcgaataaaacaaatgaaatcgctggggacggtacaactacagcaacagttttagcacaatcaatgattcaggaaggtcttaagaatgttacaagtggtgcaaatcctgtaggcttaagacaaggtattgacaaagcagtgcaagtggctatagaagcgcttcatgagatttctcaaaaggttgaaaataagaacgagatagcgcaagttggagctatttcagcagcagatgaagaaatcggtcgctacatttctgaagcaatggataaagtaggtaacgatggcgttatcactattgaagaatcaaatgggtttaatacagaattagaagtagttgaaggaatgcaatttgatcgcggttatcaatcaccatatatggtaactgactcagataaaatgatagctgaattagaacgtccatatatattagtaacggataagaaaatttcatcattccaagatattcttccattattagaacaagttgtgcaggctagtcgaccaattttaattgttgcggatgaagtagaaggcgatgcacttactaatattgttttaaaccgtatgcgtggaacatttactgctgtagcagttaaagccccaggatttggtgatcgacgtaaagcaatgttagaagacctagcaatattaactggtgctcaagtcattactgatgatttaggtttagaacttaaagatgcatctcttgatatgctaggtactgctaataaagttgaagtgactaaagatcatacaacagtcgtagatggtaatggtgatgaaaataatattgatgctcgtgtaggtcaaattaaagcacaaattgaagaaactgattcagagtttgataaagaaaaaattacggaaagtttgggaaaactacctgggggggtagctgttaatcaagtatggggtggcagtgaaacagagcttaaagaacgtaaattaagaattgaagacgcattaaattcaacacgtgcggcggtggaagaaggtatcgttgctggtggtggtactgcgttagtcaatatatatcaaaaagtaagtgaaattaaagcagaaggtgatgttgaaacgggtgttaatatcgtattaaaagcattacaagcacctgttagacaaattgctgaaaatgcaggattagagggttcaattattgttgaacgtttaaaacatgctgaagcgggcgttggtttcaatgcagcaacaaatgaatgggttaatatgttagaagaaggtatagtagatccaactaaagtaactcgttcagcgttacaacatgcagcaagtgtagctgctatgttcttaacaactgaagcagtcgttgctagtattccagagccagaaaataatgaacaacctggaatgggtggcatgccaggtatgatgtaa

SEQ ID NO: 2423 - DNA, 354 bp, Staphylococcus epidermidis
aacaataaaaaatattctggagggttaattttgaaaattgttagcttaaatagattaaatgaaatagaaaatgaattaagaaaacaatttccaaacgaagaatttaaattttatgacaaagctataaatatccctattaatgatagaaaaactatggacattttaataggttatgatggcaaaatagatcgtacctttattgaacattgtatcaaccttaaatggattggatggtttgcaacaggtgtaaataatttaccgttaaattatattaaagagcgagatatcattctaagaaatggtaaaggtatacaagctaaacaagtgtctgaatatataaagacattcatttag

SEQ ID NO: 2424 - DNA, 840 bp, Staphylococcus epidermidis
agaatgaaaaagctttttattagtggtttaatcatatttattattttctttgctagtggtgctatgacgtggtttactatagataaaaataaatacgataatcgacattataccaaaacaataaatagcaaaattgaacatttatctataagtacagtaacaaccaatgttaatataatttctggaaaaaaattagctgtttattttactggagataataaaataaatgttacaaaaaataataaaaggttaagtattaaagaaaaacgtgcagtagatagaggatatggattaaattttaatccatttcactcaaacaatagaaagctaacaattgttgtaccagaaaaagaccttaaatctcttaatattcaatcgttattgggagaaattgatttaaatcaagtgaatttgaaacatgtttcattggaaacagatagaattatacaacttaaacgatctgaactcaatcaggtaaacatcgaatcttctaaagcaaatttttatattacagactgtttaatcagggaaggtcgtatgaagcttgataagggtataactcatgttaaaaatagtacattaagtgatactgttttcttggttaatagaggagatatttctatgacggacatgaaatctaacaatgatataaaagcttctacacaaagaggtaatattaattatcattttggcgaaaaacctaaaaacactttgcttaaacttcatcctggtcatggaaataaagaaattaaaaatcgatatttcgataaaggaaaagtgggaaatagcgataatatattggaattttacactgtagatggcgatattaaaattgaataa

SEQ ID NO: 2425 - DNA, 162 bp, Staphylococcus epidermidis
attatacgaaagtgccttatttttttagagtatttcaatgtaaaattacatataagagcaaagtattttggcgagactcatgagggaacaggacaagctgaagacttatataggctgaagctgtctcataagaaagcgagccaacaatacaaagtattgtaa

SEQ ID NO: 2426 - DNA, 159 bp, Staphylococcus epidermidis; identical to SEQ ID NO: 1997

SEQ ID NO: 2427 - DNA, 642 bp, Staphylococcus epidermidis
gaaaagaggaataatatgtcagcaattgctcaaaatccatggttaatggtcttagcaatttttataattaatgtatgttatgtcacatttttaacaatgagaacgatattgactttgaaaggttatcgttatgttgcagcagtagttagttttatggaagtcttagtttatgttgttggtttagggttagtaatgtctagcctagaccaaatccaaaatatttttgcttatgcattaggattctcagtcggtattatagtaggaatgaaaatcgaggaaaaacttgcgttgggttatacagttgtcaatgttacttcatcggaatatgagttagatttaccaaatgaattaagaaatttagggtatggtgtaacccactacgaagcatttggtagagatggaagtcgaatggtaatgcaaatattaacaccaagaaaatatgaattaaagttaatggatactgtcaaaaacttagatcccaaggcatttattatagcgtatgaaccaagaaatattcacggaggattctgggttaagggtgtacgtaaacgtaaactgaaagcttatgaaccagaacaactggaagttgtagtagatcacgaagaaatagtaggtggtagctcaaatgagcaaaaagtttag

SEQ ID NO: 2428 - DNA, 576 bp, Staphylococcus epidermidis
actgtaattgaaccatacaataaatataggagtgaaaatatgaagatttttaaattgacgtcattgacactagctgctttaacgttagcctttccgttttcacatgtcgcacaagcacatacttacttagaaaagcatcaccaaacaaacgaaaccaaacaatctcatagcttttctttagaaggtgaggctggtgaaaatccaacatttttaactcaacctcaatttattaattccctagataatggtcatttaaatattaatggttatcagattcagcaagatgatactaatgatattgaatacaaaaaggtttatgatcaagaaattagagctacaagcaatcatacagcgataagtgtacgtttcagtattaataatcaatcactatcacttgaaagtatgaaagatgcatacccaaatgagagattgaatcatattccacatacaagcaatgattcacaatatccagaagacggtatatatgtctatcacggtaaaatgattaaattacaatacaaagtgacacatggatttgttacgagcgtgacgataggtgaaggtgtagacgaatag

SEQ ID NO: 2429 - DNA, 432 bp, Staphylococcus epidermidis
aatgatgatgaggtggtaaacatgattccaaatcctaatgcgccagatgaatataaatatgaaactgattatagaaaaataccaagaaaatatttaaaccctaaaatccctcaagggcgtggaaaaatcaaatggcaagcttttgcgactctcccgcaacagtttgaaattttagaacaaattataaaggatcaaaataaaatagaaaaaccattgctaacacatgattcattagataatttagatcagatttttcaaataaaaattcaaaatgatgagttatgtacaatctcatattgggaagacggtaacatttcaaaatatacaggaaaaattttaaaaaaggatgaaattagtaatacattttccttttctgatactaacaataatatatataatttaaataatgctaacgtttgtagtatcacttaa

SEQ ID NO: 2430 - DNA, 1293 bp, Staphylococcus epidermidis
gatatggatgatattaatttatttccgtttgcaggcctacaaatctttttaatgatttgggttactaaagttatcattaatatgaaatttaattttagggattacataatcgtttttacgattgtaatcccttctgctataatgtattacttttggcaaagtaaagcattaatagttttggttataataatcataattttcttttatacaaaaataaaactttattcaatattagttgtattattcacgactatgatcttatatataactaatttcataactgtatacatacatttaactataaaagattatattccgtttaaatttgttttacagttaatacattttaccttttttgtaatcataactctaatcattgcttatttaactcaactattgttcaataaattaaaagtatcctatctgtcactcaataaaagatacttattcataataacaattgtactttttatatcatttattttactttatatggtgtcacaaactgatatgcgaggaaatgatacacttaaattatatgccatcttgttgatgggtattatggtttttttaagtgtagtgattttagtgatgtccaattttacacttcgtgaaatgaggtataaacgtaatgtaaaagaaatcgaagcatattatgaatacacgttacgtatagaaagcattaacaatgaaatgcgtaagttccggcatgattatgtgaatatcctcaccactctttcagattacattagagaagatgatatgcctggattacgtaaatattttaatgaaaatatcgttccaatgaaagataaattaaaaactcgctctattaaaatgaatggtattgaaaagttgaaagtgagagaaattaaagggttgattactactaaaattattcaagctcaagaaaaacgtattccaattagtattgaggttcctgatgaaattgatcgtatcgatatgaatactgttgagcttagtcgtattatcggtattatagttgataatgctattgaagcttcagaaaatcttgaggaaccactcataaatatcgcattcatcgataatgaggaagctgtcacttttattgttatgaataaatgtagtgatgatattcctaaaattcatgagttgtttgaacaaggtttttctactaaaggtgataatcgcggtttaggtttatcaactttaaaagaactgacagactcaaacgagaatgttttattagatactgtcatcgaaaatggttactttgtacaaaaagtagaaataaataataaggaatcataa

SEQ ID NO: 2431 - DNA, 1092 bp, Staphylococcus epidermidis
tgtttacgtttcatcattcattggagacgtagaggtgatttacagatgaatcactacataagagctataggctcaatgcttatattagtatatagtatgcttattgcttttttatttattgataaagtgtttgtaaatattatcttttttcaggggatgttttatacacaaatatttggaatacctgtttttctatttttaaatttattaattgttcttttatgtattatagttggatctgttttagcttataaaattaatcaacaaaatgattggattatttcacaaatagaaagatcaatagaaggacaaacagtaggtatcaatgatcaaaatatcgaattatatacagaaacgatagatatttatcatacactagttccattaaatcaagaattacatcgacttagaatgaagactcaaaatttaactaatgaaaactacaatattaatgatgtaaaagtcaaaaagattatcgaagatgagcgacaacgacttgccagggaattacatgattctgttagtcaacaattatttgctgcgagcatgatgctatcggcgataaaagagtcgaaattagaaccacctttaaatcaacagataccaattcttgaaaaaatggttcaagactcacaacttgaaatgagagctttgttattacatttaagaccgataggtttaaaagataagtctttaggtgaaggaattaaagatttagtcatcgatttacaaaagaaagtaccaatgaaagttgtgcatgaaattcaagattttgaagtgccaaaaggcattgaagatcacttgttcagaattacacaagaagctatttcaaatacattgagacattcaaatggtacaaaagtaactgtggaattatttaatcaagaggattatcttttactaagaattcaagataatggaaaagggtttaatgtagatgaaaaatttgaacaaagttatggtttgaaaaatatgcgagaacgagcgttagaaattggtgcgacgtttcatattgtatctttacctgattcaggtacacgaattgaagttaaggcaccattgaataaggaggagaattcaagtggcgattaa

SEQ ID NO: 2432 - DNA, 474 bp, Staphylococcus epidermidis
gaaataggtgagtatatgattagtaaaggtgaacaatttccctctttttctttagaaaatcaagatggcaattttatttcaaatgaaacaattaaaggtcgtaaaacgattctttatttttatccaagagataatacaccaacgtgtactactgaagcttgtgaatttagagatcacattgaagattttaatcaacttgatgtagatatatatggcataagcgcagattctaaaaagaaacatcaaaattttataaaaaaacaccaattgaattttgacttactcgtagataaagattatcaacttgctaataaagttggggtttaccaattgaaaaaatcatttggcaaggagaatatggggattgtaagaacaacatttattctcgatgaaaatggtaacattattgatgtgattgaaaaggtaaaggtaaaaacacaaattgaaacaataaaaaatattctggagggttaa

SEQ ID NO: 2433 - DNA, 1029 bp, Staphylococcus epidermidis
agtcttttcgaatttccttttcttaagaggagtcagtatgatatgaatgataaatggtatagacatataattggagcgcgaactattaaaactggtttggctactttttttacgtctttattttgtatgttgttaaacctcactccaatttttgccatacttactgcaattgttacaattgaacctactgctaaagcatcattaaaaaaggggtataaaaggttgccagcaacagttattggtgcgttatttgctgttgtctttacatatgtcttcggtgatcaatcaccgttaagttatgctttaagtgctacatttaccattctgatatgcactaaacttaatttacaggtaggaacaactgtcgcagtattaacttccgttgcaatgattccaggtatacatgaagcatatgtgttcaatttcttttcacggttacttacagctcttataggacttgttacagctggattagtcaattttatcatcttaccacctaagtattatcatcaacttgaagagcaattagcccttagtgagaaaaaaatgtatcgtttattttatgaacgctgtaatgagttattattaggaaaattcagctcggaaaagactagtaaagaattatcaaaattaaatattattgctcaaaaagttgaaacattaatgagttatcaaagggatgaacttcattatcataaaaatgaagataattggaaattattaaatcgccttacaaatcgcgcttataacaaccgtttatttatttcacatttatctaacattatttatttacccaaacatacgtctattgcttttgatgctaatgagaagatagcattgattaatattagtaatagtattaatggcatcattcaaaaaggaagctttgcacgtcaaaaaaaatctattgcaacactaaagtcttctgttaaacagatggatgagtttgaccaaaatcaaatgaaaagtacactcatatatgaaattctactcatatacaaaattttagattcacgttatgcaaaataa

SEQ ID NO: 2434 - DNA, 315 bp, Staphylococcus epidermidis
gggttgttcgagatgcaaattgaaaaattaagaggtcagtcattagatgaattatttgatgcgatcttagcactagaaaacagagaagaatgttatcagtttttcgatgatttatgtactgtaaatgaaatacagtcattatctcagagacttcaagttgctaaaatgattaagcaaggttatacttatgcaactattgaagaagagtctggtgcatcgactgcaacgatttctagagtaaagcgttcgttacaatggggtaatgatgcttatacaatgattttggatagactaaatattgaaacaaaggcataa

SEQ ID NO: 2435 - DNA, 1272 bp, Staphylococcus epidermidis
gacagcttagacaagatatggaggattaatatgacgaattatcataataagttaaaacaatatgcagaattattagtaagagtgggaatgaatgtacaaccacagcaacctgtttttatacgttcatctgttgaagcgttagaattaactcatttaatcgtcgaggaagcatataaagcaggggcagaagatgttcgagtgagctacacagacccgaaattaaaaagattaaaatttgaaaacgaatcagttgaacactttgaaaaacaagaactcaaacaatatgatattgaagagcgtctggattatgttaatcgtggcgcagcgaacttggcgctcattgctgaagatccagagctattaaatggaatagatgcgcaaaagttaaaagcgtatcaaactgtatactcaaaaggatttaaaccatatatggaagcaagtcaaaaaaaccaatttccatgggtagtggctgcgttccctactagggattgggcacgtcgtgtctatccagagttggatgttgaatcagcatatattaaattcattgatgaagtatttgatattgttcgtgtagatggacaaaatccaattgaaaattgggaaaaacacattaaagatttaagtgttcatgctaaacgattacaagagaaaaactatcaagctttacattacatatcagaaggcacggatttaatagtagggttacctaaaggacacatatgggaagatgcaacaagttatgtaaatggggacggtcaacctttcattgctaatatccctacagaagaagtttttacagctccagatagaaacaatgttaatggatatgtaaccaataaattacctttaaatcttaatggtaacattatagacgggtttacattgacttttaaagatggtgtgataattgatgtcaaagcagaaaaaggtgagaaattacttaaagatttaattgcaactgatgaaggtgcttgtagattaggtgaagtagcactagtgcccgatgattcaccaatatcaaatcgacgcacaatattctataacactctttttgatgaaaatgcatcatgccacctagctatagggtcagcttatagttttaatatcaaaggtggtactgaaatgactacagaagaaaaaattgcaaatggactcaatgattccaatattcatgaagatttcatgattggtagtcctgatttaacaatttatgggatattgcaagatgaaacaaaagaattagtttttaaaaatggaaattgggctaaatag

SEQ ID NO: 2436 - DNA, 156 bp, Staphylococcus epidermidis
ctccgtatagagtgtcctacaaccccaacaagcaagcttgttggtttgggctcttcccgtttcgctcgccgctactcagggaatcgatttttctttctcttcctccgggtactaagatgtttcagttctccgggtctgccttctgacatgctatga

SEQ ID NO: 2437 - DNA, 165 bp, Staphylococcus epidermidis
tatctaatagagtgtcttcgtgtattagaggttgagacattaacatttgtatcttttatttttaaagtgtatacaaatgcaatgtgccaacctctcttcattttcaaattattaggagggaaggcgcatgataaaacgatatttaaagtttgtaaaaccttatag

SEQ ID NO: 2438 - DNA, 1068 bp, Staphylococcus epidermidis
atgctaatagataaagcaagatcatttattcagaccatgtatagcgaattaaaatataatactaatgaagttgaaaatagaatgaaagagattgagcaagaaattaacttgactggtagttacacacatacttatgaagaattatcttacggtgcaaaaatggcatggagaaactcaaatcgttgtattggtagactgttttggggttctttaaatgttaaagatgcccgagatgtatgtgacgaaaaagaatttataaaatttatacatacacatattaaagaagctactaacggtggaaaaatcaaaccatatattacaatttttagtcctgaagatacacctaaaatttataataatcagttgattcgttatgctggttatgaaaatgttggcgatccatctgaaaaaaaggttactcgtttagctgaacatctaggttggaaaggtaaaggttcaaattttgatattttacctctgatttatcaattgcctaacgacactataaaaatacacgaacttccaagtgatattgtaaaagaagtttctatacatcatgaacactatcccaagctttcaaaattaggtttaaaatggtatgcggtacctattatttcaaatatggatttaaaaatcggtggtattacttaccctacagcaccttttaatggatggtatatggtaaccgaaattgctgtacgtaatttcacagacacctatcgttataatcttttagaaaaagttgcagaagcttttgaatttgatacacttaaaaataattcatttaataaagatcgagcactcgtagagttaaatcatgctgtgtatcattcatttaaagctgatggtgtttctattgttgatcacttaactgcagcgaagcaatttgaaatgtttgaacgaaatgaacatcaacaaaacagagatgttactggtaagtggtcttggctggcacctccactttcaccaactttaacttctaactatcatcatggatatgataatacaatgcatcatacgaatttcttctataaaaaagaagaacctatgaagtgccctttccattaa

SEQ ID NO: 2439 - DNA, 318 bp, Staphylococcus epidermidis
tttgtgatagagcagtatttccttagagatggtaagttcgttcaagatgtagatatgaaagatgggggaccagaggatagtactattcttactttacaaaaagatgactttaataaagctttagattctctttctgaaaactttaaagtacagcagtctcaaaaagaatcgggagaaattatcattaaagctcaaaatgattatagagagttacttaaatcgttatcccaactagatatttatccaaaatatattgaaacacgtaaaagttcactacgtgatacttactttaatattaatcaaagaggtgataaataa

SEQ ID NO: 2440 - DNA, 744 bp, Staphylococcus epidermidis
aacgagcaagacaagaaaaacttttacaagcaaattaaaaagaaagaggtatgtattatgacaacaactacttatcaaggtacatcacaagacgtatggaatgtattattcgataacagaaaatataaaggtctattagatgaagtaaataaattaattgaagatactaaacgtttatacaagcaaggctatcgtttagaggctatagacgaacaacaaaagcccaaagttactgaactcgaaaataaattcaaacagtttgctacagatagattaaatgaaatagagcaacgttgtaatgagattgagaaagaaagccaacaagataatgttaaagatccacaaaccgaaattattaaacgtcagaatttagaagctagattatctttctataacgataatgagattgtagactacatcaatagtaaagatgtaacgagcactgacatttatgaattaagcttgttgcaacaaaaatatgacaatcaattaaacgaatcacaacaacgtcaagttgcatttaaactcgaagaattaaaacaaggtgttttatatccatacactacaaatgaagagtacaagaacttaatgtttgaatatagtgtcataaaccaaactggaatggctaaaactggtgtagttattactaagaatgaacagtatggtggcgttgaaatcaaacaacttactgaacgttataaaaatgctattaacgaagtgaaacaaagtaataatagaagataa

SEQ ID NO: 2441 - DNA, 141 bp, Staphylococcus epidermidis
ataatgaaagatatatttaatgaaatggattaccgtaatataccacgagacatgctagataaaaatattcctaccggtcgtggtatggttaaatgggcaccttttgttatatgtactaatctcataaaaaatctaatttaa

SEQ ID NO: 2442 - DNA, 981 bp, Staphylococcus epidermidis
gcatttatggacacagccacacatatcgttatgggtgtgggtcttacagctttagcaacgcaagatccagttatggcagaatcatttgctgctactgcgacgactttaatcgcaggttctttaataccagacggtgatactgtattgaaattaaaggataatgcgacatatatttcacatcacagaggaatcacacattcattaccttttacaatattatggcctatattaattacattttttatatttgtaatatttagccaaacgaatcctttacatgtatggttatgggcacaactagcagtgtttttacatgtctttgtagatatttttaattcttatggtacacaagcattacgtcccataactaacaaatggattcaattaagcgtgattaatacctttgatccgataatattcattattttaagtaccggtgtcttattgtggatattaggtattcacccgtatattgttttctttccaattatattaattctcataggctattatattgtaagatttaagatgcaagcagcaattagaaaacaagcactccaaaaaattgagcaatcgcatacaccagtaaaagtattcgtagctccaacaataaaatttcatgtatggcgggtcgcaatacaaacagataagcatgattatgttggtgtttccaaatggaaaaatgtagatttcactgataaagttaaacgccagtctatgactcctgattcgatattatggaaagttaaaggtaataaagatatatatacatttttaaacttttcttcaatttaccgttggcaaactacaccattagatgatggcacaacagaaattcgacttatggatttacgatacttaaataaaggtcgttattcttttgtagctattgcacatttaacacttgaaaatgaaattgatcactcttatattgggtgggtatttagcgaagataaattacaacgtaaattattttcataa

SEQ ID NO: 2443 - DNA, 453 bp, Staphylococcus epidermidis
gtgagtgcggaacttgaatctattgatcatgaacttgaagagtcaattgcttcattaagaaaagcgggcgttcgcattacaccccaaagacaagcaattatgcgttatcttatatcttcacattcacatccaacagcagatgaaatatatcaagcactttcacctaaatttcctaatataagtgttgctactatctataataatctaagagtttttaaagatattggtatagtcaaagagttaacatatggtgattcatctagtaggtttgattttaatacacataatcactaccatattatatgtgaaaaatgtggtaaaatcgttgacttccattatccacaattagatgaagtagagcaattagctcaacatgtaacagattttgatgttactcatcatcggatggaaatatatggagtatgtaaagaatgtaaagaagaaggaaattga

SEQ ID NO: 2444 - DNA, 777 bp, Staphylococcus epidermidis
tttataaaggaacgggataaaatgattgttaaaactgatgaagaattacaagcgttaaaagaaataggttacatttgtgcaaaagtcagagatactatgaaagaagctactaaacctggagtgactacccgtgaattagatcacattgccaaagatttatttgaagagcatggggcgatatcagcgcctattcacgatgaaaacttcccaggtcaaacttgcattagtgttaacgaagaggtcgcgcatggaatccctggtaaacgagtaattcatgaaggtgacctagttaatattgatgtatcagctttaaaaaatgggtactatgctgacactggaatttcatttgttgtagggaaatcagatcaaccacttaaacaaaaggtttgtgacgtagccacaatggcttttgaaaatgctatgaaaaaggtgaaaccaggtacaaaattgagtaatattggaaaagctgttcatgcaactgcacgccaaaatgacttgactgtgattaaaaatttaactggacatggtgttggacaatcacttcatgaggcacctaatcatgtcatgaattattttgatcctaaagataaaacattattaaaagaagggcaagtcattgcagtagaaccattcatatcaacacatgctacatttgtaactgaaggtaaaaatgaatgggcttttgaaactaaagataaaagttatgtcgctcaaattgaacacacggttatagttacaaaagatggtccgttacttacaactaagattgatgattaa

SEQ ID NO: 2445 - DNA, 1197 bp, Staphylococcus epidermidis
aaagcaaaggagattgttatgtcaaaaaaagagaaaacaacttctaaatatcttaattcaatagaagataaagagcataaaaagaataaaaaaatagaagttgaccgtacatatatagaacctcaagaattccaatctaagaaacctaaaaaaaagaatcaagtattttttgtttcccggctgaataaaccagcaaaatacaccgaaaactctaatttcttttcttacctgatttataggataggtaaagatgacgctgcaggtttagcagcacagatgacatatcattttgtattagcacttttcccaatgctaatttttttacttacgctacttggtcaatttatcacgattgatgctaatcagattaatcaaaaagtaagtcaatatgtccctgatcaagaaacagctagcatcgttggtggaattgttaaagatatctctgacactgccagtggaggtattttgtcagttgggttaattttagctatttggtcagcatcaaatggaatgtccgctattattaactcatttaatgttgcttatgacgttgaggattctcgaaacggtgtagtagttaaattattaagtattctatatacacttgttttaagtgcagtatttgttgttgctgtagtacttataacactaggtccagtcattaataaatttttatttggaccactaggtattgataatcaaattgaatggatttttaatttagtacgaattgttattccattgattattattttcatcatatttactgtactttattcagttgcacctaatgttaaaacaaaattacgttctgttattcctggcgctattttcacttccattatttggttactagggtcctttgcattcggttactatatttcaaactttagtaactattcgaaaacatacggaagtttagctggtattatcattttattcttatggttgtatatcacaagctttattattattatcggtgctgaaatcaatgcaattattcaccaaagaaaagtcatagctggtcacacgcctgaagaagccgctattaaacatgatgataacaatgaaaatcactataacgaaaatacgacttatgaatactatgaagatagcaaagatgtagatatctctaatgaagatgacacgtataatatcaatcatcaatctaaagaagaacatcacacaagcgactga

SEQ ID NO: 2446 - DNA, 225 bp, Staphylococcus epidermidis
gcacacggtttcaagttctctttcactccccttccggggtacttttcacctttccctcacggtactggttcactatcggtcactagagagtatttagccttaggagatggtcctcccagattccgacggaatttcacgtgctccgtcgtactcaggatccactcaagagagaatatgtttccgactacaggattattaccttctttgattcatctttccagatga

SEQ ID NO: 2447 - DNA, 165 bp, Staphylococcus epidermidis
aaaacgttttgcgacgcaaaatcttacttactatctagttttgaatgtataatcattcatttgtctggtgacaatggcaaggaggtcacacctgttcccatgccgaacacagaagttaagctccttagcgccgatggtagtcggactgacgttacgctagagtag

SEQ ID NO: 2448 - DNA, 171 bp, Staphylococcus epidermidis
atcattgattgtgctaaaactgttgctgtagttgtaccgtccccagcgatttcatttgttttattcgcaacttcctgcactaattttgcacccatattctcatatggatcttctaactctatttccttagcaattgttacaccatcgttggtaattaaaggtgttgtgtaa

SEQ ID NO: 2449 - DNA, 624 bp, Staphylococcus epidermidis
ggaggacgactaatgaacgcgatagaacttaaagatgttaattatcgatctaacgcatttcaattgcaagatgtctccttcaatgttcctaaaggatatgttacaggttttataggtggaaatggtgcggggaaaactacaataatacgattaattatggatttaattcaatctgaaagtggtacaatctctgtttttgagaaagatataaaaattcatcctcgtgaaataaaaaataaaattggatttgtgtattctgagatttattttaatcaaaaatggacagtaaaaaaattagaaaatatcattgcccctttttatgatcgttgggatcatgaaatatttataaagtatttaaaattttttcagctgccatataaaaataaaataaaaactttctcaaccggtatgaaaatgaaactatcgttagcaattgcattcagtcatcatgcagaattatttatcttagatgaaccaacttcagggttagacccattaataagaaatgaattacttgaaattattcaacaagaattgatagatgaaaataaaacagttttcttttcaacacatattatttctgatttggaaaaaattgcagattatatcgttttttctcagtga

SEQ ID NO: 2450 - DNA, 1080 bp, Staphylococcus epidermidis
tgttttaaatggaggtttaacatgagtcattcgcaaataaatggaaagcgattttttaacaacattttgaatgcagtaggagcaggggtagttattgcactgttacctaatgccttattaggtgaattattaaaattcttcaaagaaggtaatcatgtactagaaacgatttttcagctagtaacaatcatacaatcttttatggcttttattataggggttcttgctgcgcaccaatttaaatttaaaggtacaggtgctgcaattattggtatttcagcaatgctaggttctggagctgtacactataatggacaaacaattgaattaaaaggaattggagatattataaatgtaattttagtagttatattagcgtgtttcatttatatgtttttagaggggaaattaggttccttagaaatgattattttacccgttttagttcctgtaattagtggattaatagggttattaacattaccttacgttcaagttattacgcagtcactaggaaaattagtaaacaggtttacagaattaaatccattattaatgtctatattaatttgtgtaacattttctttattaatggtaactccaatctcgttagttgctatagcaacagcaattaaccttactggtttaggaagtggtgctgcaaatatgggaatagttgcagcttgtgtaacctttttatttggatctttaagagttaattctcttggagttaacgtggtattactcataggtgctgctaaaatgatgattcctgtgtacttaaagcatttaattatagccataccattgacaattaatggagtcatatgtggtataattgcttatattttaaaaattaaagggactgcactatctgctggctttggttatactggattggttggtcccatcaatgcattaaaccgtatgtcgggaaatccatctatgaatattattttattaattattggatatttcgtgataccatttgcaggtgcctttattgtacacaaaatttgtaaaaaagtattaagtacatacagtgatgaaatatataaatttgaaatctcaaaagattaa

SEQ ID NO: 2451 - DNA, 177 bp, Staphylococcus epidermidis
aaactaatgtggaactttattaaaggattattcaaatttgtctttagtttattagctattactacagtagtagtaggcatcggtgtagttgcctttgcttatatttttaaaaaagactttgaagatatcgaaagaaaaacgaaagaaatcgtttctgatatcgaaaacaacaattaa

SEQ ID NO: 2452 - DNA, 171 bp, Staphylococcus epidermidis
ggtggcgagtgtagttatttgataaataatcattgtagaaaaatcacagatactcaacttcgagataatggagatagaaatcaaaagtcaaaaactaatgtactgagtatcaatttattcgttttagcttttgtacttaaatcacacaaaaagaaaacaataaattattaa

SEQ ID NO: 2453 - DNA, 171 bp, Staphylococcus epidermidis
attaaacttcgatatcaaatgcttatgatactgatttacagtgtgagcataatcgataaaatatacacaatacgttatttaatttataatatatcatgtattttaatttttcacaatttaatttcccctaataatactaaagactttttattactttcaacattgaaataa

SEQ ID NO: 2454 - DNA, 132 bp, Staphylococcus epidermidis
atgatcttgctttatctattagcatttaaaacacctcaatcgtcattatacgtgagcatatactgtttcttgaataatataggtaattgtcataaatttgtcgacactatattagaatttattaagaaataa

SEQ ID NO: 2455 - DNA, 123 bp, Staphylococcus epidermidis
aatagaattcgaattaagtttaatggtcaatccattaccaaaggaatatatttgcaatttgatgttattgatgattttgactcatttttcaagccgtcaataaatttaaatgaaaaaaattag

SEQ ID NO: 2456 - DNA, 156 bp, Staphylococcus epidermidis
ccgttcggtcgcaggttcgagtcctgcaaggtccatataattttggaggaatacccaagtccggctgaagggatcggtcttgaaaaccgacaggagcttaacggctcgcgggggttcgaatccctcttcctccgttttaatggtcccgtagtgtag

SEQ ID NO: 2457 - DNA, 1476 bp, Staphylococcus epidermidis
ctgatattacgcctgataagcaataaaattattacgacatcaaatttaaggttaggaatgccacacattatattcctaacctttttgtatgtgggagggaaaaaattggaaacaattaagaaaaacgaagttaaaacgggaaaggttattgatttaactcatgagggacacggagttgttaaagttgatcgatatccaatttttattcctaatgctttaattgatgaagaaattaaatttaaattaattaaagtgaaaaagaattttgctataggaaaattgatagaggtcataagtgaaagtgatgatagagtgacaccaccttgtatttattatgcaaagtgtggtggttgtcaattacaacatatgacatatagagcgcaattggatatgaaaagagaacaagtagttaatctttttcatagaaaaggcccttttgagaatacggttataaaggaaactattggcatggtcaatccctggcgataccgtaataaatctcaaattcctgtaggtcaaagtaactcgaatcaagttataatgggattctatagacaacgtagccatgacattatagatatggatagttgtcttatacaagatagacaacatcaagaagtaatgaatcgagtgaagtactggctcaatgaattaaatatatctatatataacgaaaaaacaaaaacaggtttaatacgtcatttagtagtaaggactggttatcataccgatgaaatgatggttatctttgttacaaatggagcaacatttaaacaatcagaactattagtaaacaagctaaaaaaagaatttccaaatataacaagtattaaacagaatataaacaatagccattctaatgttataatggggcgtcaatcaatgactttatatggtaaagataaaattgaagaccaattaagtgaagtaacttatcatatttctgatttatcattttaccaaattaactcatcacaaactgaaaaactttatcagcaagctctgaattatgctcaattaacaggaaaagaaatagtattggatacgtattgtggtataggaacgattggtctatatatggcaccactagcaaaacatgtttatggtgtagaagttgttccgcaagccataaaagatgcggaagacaatgcgactaaaaaccaacttaaaaatacgactttcgaatgtggaaaagcagaagatgttatcttaacatggaaatcacaagggattaaaccaggcgtagtcatggtagatccacctagaaaaggatgcgatgaaactttcttaactactcttttaaaattaaatccgaaaaggattgtttatatatcatgtaacccttcaacgcaacaaagagatgcgcaaatattggctgaacaatacgagttagtagaaattacaccagttgatatgttcccacaaacaactcatattgagactgtagcattatttgtacgtaaagacgaagagtga

SEQ ID NO: 2458 - DNA, 2190 bp, Staphylococcus epidermidis
atgaatgcgctagtaaaaaatatgaattcagagcaaagtgaagcggttagaacaacagaaggcccattgcttattatggcaggtgctggatcaggaaagacacgtgtgttaacacatcgcattgcgtatttattagatgaaaaagatgtatcaccttataatattttagctattacgtttacaaataaagcagctaaagaaatgaaggcgcgtgtcgaacatcttgtgggagaagaagcgcaagtgatttggatgtccacttttcactctatgtgtgtaagaattctgagaagagatgctgatcgtattggcattgaaagaaatttcactatcattgatcctaccgatcaaaaatcagtgattaaagatgtattgaaaagtgaaaatatagacagtaagcgatttgagccacgtatgtttattggtgcaattagcaatttgaaaaatgaattaaaaacacctgaggatgctcaaaaagaggcgaatgattttcactctcaaatggttgcaacggtttacaaaggttatcaaagacagttatcacgtaatgaagcactcgactttgatgatttaattatgacaactattaatttatttgaacgtgtacccgaaactctagaatactatcaaaataaatttcaatatatacatgtagatgagtatcaagataccaataaagcacaatataccttagtaaaactattagcaaacaaatttaaaaatttatgtgttgttggtgattctgaccaatctatttatggttggagaggagctgatatacaaaatattttatcttttgaagaggactatcctgaggcaaagacaattttcctcgaacagaactatcgttcaactaagaatattttaaatgctgcaaatgaagttataaaacataattctgaacgtaaacctaaaggtctatggactgcaaattctggaggagacaaaattcagtattatgaagctatgactgaaagagatgaagcagaatacgttgttaaagaaataatgaagcatcaacgcagtggtaaaaaatatagtgaaatggctatattatatagaacaaatgcccaatcacgtgtacttgaggaaacatttatgaaatcaaatattccttatacaatggttgggggtcaaaagttctatgaccgtaaagaaattaaagatttacttagttatttaagagttattgctaatagcaatgatgatattagtttgcaacgtattattaacgtgcctaaacgtggtattggaccttcatctgttgaaaaaatccaaacctatgcacttcaaaataatataagtatgtttgacgcattggctgaggtagattttataggtctctctaaaaaggtaactcaagaatgtatcagtttttatgaaatgattcaaaatttaatcaaagaacaagaatttctcgaaattagtgaaatcgtagatgaagtactacaaaaatcaggctatagagacatgcttgatcgagaacaaagtattgaatcacgaagtcgattagaaaacttagatgaatttatgtctgtacctaaagattatgaggaaaatactcctttagaggaacaatcacttattaattttctaacagatttatcattagttgctgatattgacgaagcagatacacagaatggtgtaacattgatgacaatgcattcagcaaaaggtcttgaatttcctatagtttttattatgggaatggaggagtcgttgttcccacatatcagagcaataaaaagtgaagatgatcatgaaatggaagaggaacgtcgtatttgttatgtagcaattacacgagcagaagagttgctttatatcacaaatgcaacgaccagaatgttgtttggtcgttctcaatccaatatgccatctcgatttttaaaagaaatcccagaagacctacttgatagtcataccggtcaaaaaagacaaactatatatcccaaatctcaacctaaaagaggttttagtaagcgtactacatcaactaaaaaacaagtttcatcatctgattggaaagtaggagataaagttatgcataaagcatggggtgaagggatggttagtaacgtgaatgaaaaaaatggatctgtagagttggatattatatttaaatcagaaggtccaaaacgattattagctcagttcgcaccaataacaaagaaggaggactcatag

SEQ ID NO: 2459 - DNA, 198 bp, Staphylococcus epidermidis
aatttggagcggaagataggatttacacctatatctcattccgggaaggaatgtgttctaagagttgaactactcccgcataataacctggaggcggcaaccggatttgaaccggtgataaaggttttgcagacctctgccttaccacttggctatgccgccaataactgggctagctggattcgaaccagcgcatga

SEQ ID NO: 2460 - DNA, 936 bp, Staphylococcus epidermidis
tcacatattttatcagtttatatatataatttaattgtaacaactgttattaaaaaaataaattttataatttttggaggttatcatatgaaaaagagatttttatctatatgtacaatgacaattgcagcgttagcaactactacaatggtaaatacttcttatgcaaaaaccgatacagaaagccataatcattcctcacttggcacagaaaacaaaaatgttttagatattaatagttcgagtcataatatcaaaccaagtcaaaataaaagttacccaagtgtaatattacctaataataatagacatcaaatttttaatactacacaaggtcattatgatgctgttagttttatttatataccaatagatggtggatatatgagtggttcaggtgttgttgtaggtgaaaatgaaatattaactaataaacacgttgttaatggagctaagggtaatccaagaaatattagtgtccatccttcagctaaaaatgaaaatgattatcctaatggcaaatttgtgggtcaagaaatcataccgtatcctggtaatagtgatttagcaatcttaagagtgtcaccaaacgaacataatcaacatattggtcaagtagttaaacctgcaactataagtagcaatacagacactagaattaatgaaaacatcactgttactggttaccctggtgacaaaccattagccacaatgtgggaaagtgtaggtaaagttgtctatattggtggcgaggaattaagatatgacctaagtactgtaggtggaaactctggatctccagtatttaatggtaaaaatcaagttattggaatacattatggtggcgtagataataaatacaatagcagtgtttatattaatgatttcgttcaacaattcctaagaaacaatatacctgatataaatattcagtaa

SEQ ID NO: 2461 - DNA, 807 bp, Staphylococcus epidermidis
aacgataggcgggtgaatatattgaaaatccaaatacttcaattcaatgtagaacgtggaaatgttgataaaaatatgcaaaatatcaaaactaagtttaatcaatacttagataaagataccagtgtcgtcgtgcttccagaaatgtggaataacggttatgcattagaagaattagaacaaaaagctgataaaaatcttaaagacagctctctctttataaaagacttagcacatacatttaatgtagatatcattgcaggttcagtatcaaatataagagaaaaccatatatataatactgcttttgcaattaataaaaacaaagaattgattaatgaatatgacaaagtacatctcgtgccaatgttacgtgagccagactttttatgtggtggaaatgtagtccctgaacctttttatttatctgatcaaacacttgtgacgcaaatcatttgttatgacttacgatttccagagatattgcgctatccagctagaaaaggtgctaaaattgctttttatgtagcacagtggcctagctcaagactagatcattggttatcattactaaaagcgagagcaatcgaaaatgatatttttattgtagcttgtaatagttgtggtgatgatggtcacaccaattatgctggaaattcaattgtcattaatcctaatggtgaaattttaggccatttagatgataaagaaggtgtactaacaacacatatcgatgtagacttagtagatcaacaaagagaatatattccagttttcagaaatctaaaaccacatctttataaatag

SEQ ID NO: 2462 - DNA, 1749 bp, Staphylococcus epidermidis
gagggaaggcgcatgataaaacgatatttaaagtttgtaaaaccttatagatatcgtattattgcaacaattatagtagggattattaaattcggtattcccatgctcatacctttattgattaaatatgctatagatggcgtgattaataatcattcgcttacaaatcaagaaaaatttagtcaccttggtgtagcaataggaattgcattatttattttcttaattgttcgcccgccgattgagtttattagacaatatttagctcaatggacaagtaataaaatactatatgatattcgtaaacaattgtataatcacttgcaagcactaagtgttcgcttttatgcaaataatcaagtcggtcaagtcatttcaagagtgattaatgatgtcgaacaaacaaaagactttattcttactggattgatgaatatctggcttgactgtataacgattattatcgcactttctattatgttcttccttgatgtaaaattgacgtttgctgcaatttttatttttccattttatattttaactgtttattttttctttggaagattacgaaaacttacacgtgtgcgctcacaagctctagcagaagtacaaggtttcttacatgagcgggttcaaggaatgtctgttattaaaagttttgctattgaagacaatgaagctaaaaattttgataaccataacaagaattttttacaacgagccttccaacatacaagatggaacgcatattcttttgctgctattaatactgttacagatttaggcccaataattgtgattggcgtgggttcatatttggcaattacaggatcgattactgtcggaactctagcagcatttgtcggttatctagaacaattatttggaccacttagaagactagtatcttcatttactacacttacacaaagttttgcatctatggacagagtatttcagttaatggatgaggattacgacatcaaaaatggcattggagcacagccaattaaaatcagtaagggtcaaattgatttaaaacatgtgagtttcaaatataatgaaaatgaaaaagaagtattacacgatattaatttaacaattaacaaaggcgaaactgtagcatttgtaggtatgagtggtggtggaaaatctactttgattaatcttataccaagattttatgatgttactcaaggtgaaatacttatcgatcatcataatgttaaagatttcctaactggtagtttaaggaatcaaataggcttagtacaacaagataatattcttttttctgatacggttaaggagaatattttgttgggtaggcctgatgcgactgatgatgaagtcgtagaagctgcaaaaatggcgaatgcccatgattttatttcaaatttaccgaatggatatgatactgaagtaggagaacgaggagttaaattatctggtggacaaaaacaaaggttgtcaattgcacgtatctttttaaataatcctcctgttttaatattagatgaagcaacaagtgcattggatttagagagtgaagctattattcaagaagcacttgatgttttaagtaaggatagaacaacattaattgttgcacatcgtctatctaccattactcatgcagatagaatagttgtaatggaaaatggacgaattgttgagactggcacacaccaacaattaattaataaacgcggtgcttatgagcatctttatagtattcaaaatttataa

SEQ ID NO: 2463 - DNA, 132 bp, Staphylococcus epidermidis
cacatcattagatgtttcataaaagactttgaattttatatccctactttatgcactaaaaaaggagtaaaacagatttcatcctgtcctactcctttaaatttatttagctatcgactcaatatgttttaa

SEQ ID NO: 2464 - DNA, 132 bp, Staphylococcus epidermidis
agccgtgagcttgggagagactcacggcttgataacttattattaagggaatgtttttacagttattttttcaatctattttttggggatgttattaattatgaaaaaattttagtgaatttatctatttaa

SEQ ID NO: 2465 - DNA, 138 bp, Staphylococcus epidermidis
tggtcccgtagtgtagcggttaacacgcctgcctgtcacgcaggagatcgcgggttcgattcccgtcgggaccgccatttattaaattttaatagttatttacctataatttgtggaggaatacccaagtccggctga

SEQ ID NO: 2466 - DNA, 180 bp, Staphylococcus epidermidis
agcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactga

SEQ ID NO: 2467 - DNA, 207 bp, Staphylococcus epidermidis; identical to SEQ ID NO: 94

SEQ ID NO: 2468 - DNA, 414 bp, Staphylococcus epidermidis
agcttaatcagtgacgaggtgatatcattgaatattttagatttatatttacaacaatttataaaacgaattactaaaaaaagtatcaatgactataaaatgtcattagataagcaaattaaaaatattgatacttatattaattatttaagagaaaaaagattacaattaaagaagttaattgacaccctcacgctctcattagaaaataaatatatagatttagtaaacaatcaagcaatctattgtgctgaggaaatacatgataatgatattgatatgattaaatcacaattaaatgatgctgagtcttattatgcgagaattgaagcggatataaatttacaatctagaatgaaaataactactgaagaagcattccactttatatatcatatgagtgctgtagcatag

SEQ ID NO: 2469 - DNA, 132 bp, Staphylococcus epidermidis
cttgtaatcagtaggttgggggttcaagtcctctggccggcaccatcttttgagccattagctcagttggtagagcatctgacttttaatcagagggtcagaggttcgaatcctctatggctcaccatttaa

SEQ ID NO: 2470 - DNA, 591 bp, Staphylococcus epidermidis
atgggtaggctcattctagttataaggagtgatgatatggacaaattaacgccaaaacaagaacgttttgcgaatgagtatataaagacactcaacgttactcaaagcgctataaaggcaggatatagcccgaatagtgcacatgtaactggtagtcgattactacgcaaagagaaagtggataaatatattaaaagtaagaaagacgagattatggacgatactattttatcagccaaagagttactgtatctattaactcaagcagcagttggcgacgaaactgaaacaaaggaagctgtagtaaagaaaggtacatttgaacgtaatccagacagtggaagaatgaacctcgtatataatgagcatgtggaaactgttgaaatacctattaagccaagtgatcgattaaaagcacgtgatttgcttggcagataccatagcttatttacagaaaaggtagacttaaatgtagcaacaccagtatttattgatagtattgatgaagatgatgagaagaatgagagagatattgaaaatttaagtaaacaatatccgaatgcagagtttcatattgatgatattaggtag

SEQ ID NO: 2471 - DNA, 123 bp, Staphylococcus epidermidis
ataaaaataagattcttttatattataacaaaacttttctcaatagcaaataataattattctaatttagatatagtgattgtcgttcttattaataattattctaatttgattaatgaataa

SEQ ID NO: 2472 - DNA, 138 bp, Staphylococcus epidermidis
agagaacaaagatggcagtatagagattttaaaacaggatattatatttgtaggtgctttaatccaataaatatgattaactatagaatgttaaagcctaggacactcactattgtcctaggtatttttatgcattga

SEQ ID NO: 2473 - DNA, 1521 bp, Staphylococcus epidermidis
ttgatgggaagctcaatagttttaaaattactcaaggtaacacattactatagaaatcataattcaaaaaaatggtatcgaccattaggttatgatgctgaggacatcaacctaaataatatttctttgcatatatatcaaggtgaagcattaggtataatcggagaacctggatcttctaaaactttgattggtagaattttaagtggttcagtgaaacctgataaaggtaaggtcgtccgaactaaaaacttatatttcggtgatattgatgatcgaaagattaataatttaactgtgagccaatatgtgagcgaactcgtacaactttttccttatgaagtaactgagcataaagttgaacaaattattcaatgggcacatttaggtgattacatagaagaaaaggtttctaatttaagcgaaaaatcatacgcacaacttttacttagtattgcacgttcttcaaaaaacgatattatcattttaaatcatgttttatcacatttagatgaaacatttatagaaagagctacagttttatcaaaagattatattgaggctaataaaacactagtcttaattgataatgatgtagaaaagataagcaaaacaagtaactacataacatgggtatcacacggccagatacgcaaggaaggttctctaaatcaggtattaccaacttttagagaacatgaaaaagatcgtactagtttaaaatcagaaatggaaattgagaactttgattatgattggaagcagaatcgctctcgtattcctgaaatgacttataattttaaaagaatagaacgttataatcatgctaagccaccaagatttctagtgagattttggaccttatttgtcagctttttgattgggcttgttttaatgagcgtacttttctttaacaacttaggtatggtcaaactagggaacattaatacccaagcatccatacagaatcagaataaagatacttacgaagaaaaacttgcatatggattagcattagatggatcagttactttaaacgggtctaaagatttaaaagtacctaagtatagtttaattacaattactggagaaaataacaaaagatatcgggtcgaaatgaatcaaaggagatatagtgttagtaaaaatcaagtgttttatttcaatccagctgggttatacgaatctcatacttttaagaaattgtcaccttatataaaatcaaattatagtacttacgtagagtactttaacagtcacttacatcaaaaacatgataaagtaacagaaacgcttagacctgataaagataaaaagtatgttgtaccgatcacgcaacaacctataaaaatgatatttggtgataatgataaactgtctggatttgttattccaatgacaaataaaacggaattgaaaaaaacatttaatatcacgaaagatgtatggattacaaaaagtggaagcggttattttatcgctgatatgaaagaagaaaaatggatttatattgaattgtag

SEQ ID NO: 2474 - DNA, 582 bp, Staphylococcus epidermidis
ttcagattgagagcgtgcgtaaatatggataaaataaccttcttaaatgaattagaattagctttagatgatttacctagggaagaaaaagatagtattatgcacaagtatgaaaacttgttctatgaagaagaattgaaagggattagtgaatcacaaattataaaaaagttaaatgatccttatcatatttccaaagaagtaaaagctagaagtgctattcattatgctagttacaaaccaaccttagcaaacatagtaagagcaatactagcatcgttaagtcttggtattttgtcgttatttattattttaataccggttgttatcattgcattacttattctattctgtttccttatttctatttgttttatctttgcaccatttgttttattattttattcagtattacatggtttcgaaaatgctataagtaatgtgtttttttcaatttcttttacaggtttaggaattatgtttattgttattactttgaaaattggtgaaataattcataaacttattttgaaatatcttctttggtatataaagactgttaaaggaagcgttaaagaatga

SEQ ID NO: 2475 - DNA, 135 bp, Staphylococcus epidermidis
aatgcgcagagatatggaggaacaccagtggcgaaggcgactttctggtctgtaactgacgctgatgtgcgaaagcgtggggatcaaacaggattagataccctggtagtccacgccgtaaacgatgagtgctaa

SEQ ID NO: 2476 - DNA, 735 bp, Staphylococcus epidermidis
ataatgaagagcttacaattagtcaaatatgatttaattagtatacttaaaagtccgtatacttatttagcatttatacttgtaattggaatgacggtattccaagctagcatgatggcaaattatagttctgcacataaagttaatatagatatggtttttaatttagctaattggcttttcttgtttgctggtcttttattcattataaaaacaataacaagagattactcacaaggtactatacaattgtttatgagcagaataactagcagaatgggctatatcattactaaaacagtatctattgtattaatttcattcttatttacaattattcactacttggtaataattattatacaatctacaactaaaagtgaaaaaatggatggagatagatttttaaataatatttggttttaccttattttctttttattctttggattattcttattactaatcactttaatagtagaaaaacctgctgtcatatttactctaggtatttttttaatactcatcgttccgtttattcagccatttattccaatgattccgaatattggcgatgatattcaggattcatttaaatatataccatttacgtatttaactgaaaaaatgactggtgagattaaattctctaattggcaatggtttatctctattgcatcaatagtggtcttatttattgcaaatatgttatatgcatcaaagagggatatttaa

SEQ ID NO: 2477 - DNA, 648 bp, Staphylococcus epidermidis
ataaggaggagaattcaagtggcgattaaagttttatttgttgatgatcatgaaatggtaagaatcggtatttcaagctatctttcaactcaagaagatatagaagtagtaggtgagggtgcttctggtaaagatgctatcaccaaagcgcatgagctaaaaccagatttaatattaatggatttacttatggacgatatggatggtgtagaagcaactactgaaataaaaaaagatttacctcaaattaaagtagtcatgttaacaagctttatagaggataaagaagtttatcgtgcacttgattctggagtagatagttatattttaaagacaacaagtgcaagtgatatagctgacgctgtgcgtaaaacgtatgaaggtgaatcagtatttgaaccagaagtgttagtaaaaatgcgcaatcgtatgaaaaaacgtgccgagctttatgaaatgttgacagaaagagaaatggagatcctattacttatagctaaaggatactctaaccaagagattgcaagcgcctctcatatcaccatcaaaacagtaaaaactcatgtaagtaacatactaagtaaattagaagtacaagatcgaacacaagcagtaatatatgcgttccagcataatttaattcaataa

SEQ ID NO: 2478 - DNA, 141 bp, Staphylococcus epidermidis
gttttaagtggtctagattcaatccacgataaatttatgttgaataaagtaaaagtatttaaaacactagctaaaagtcctggcttatcatacttaggcgtgataaggaagatagttgtgtttggatgttcaataaaatga

SEQ ID NO: 2479 - DNA, 207 bp, Staphylococcus epidermidis
tacttaggtggtaagatgataaaattgactaatccagctgtaacaagtcctataagagctgtaagtaaccgtgaaaagaaattgaacacatatgcttcatgtatacctggaatcattgcaacggaagttaatactgcgacagttgttcctacctgtaaattaagtttagtgcatatcagaatggtaaatgtagcacttaaagcataa

SEQ ID NO: 2480 - DNA, 504 bp, Staphylococcus epidermidis
tataacattttaaattattcaagggaggggttttatataagaaatttagaaacttattttaataaaagtcaaacactcaatgaattcattaataaaatacaagaaagtaaagacaatttattatccatttataatttcttccacctgccacttaatgatgcacgtttaaatcaattaagagaatcgaattattataaggtgcttataattaaagaggattggtgtggcgatgccatgatgaacattccaatattaaagcatactattgaatttctgaacatcatagcaagagtatttcatagagatgatgatacacatctgattgatcaatatttaacaaatggtaaatcaagggctatccctatctttgtattcatgaacgattcattcgaacaattgacagtttggagaccaagagcaaaaaagtacaaagttttgtcaataaaattagaagtaataaattgccagataaaacccatcctaattttgatttttactcaataa

SEQ ID NO: 2481 - DNA, 2001 bp, Staphylococcus epidermidis
gggatgcaaggtgttaaaaagcgtgtggaaaaattacatgacttattgaatcaatatagttatgaatattatgtacaagataatccctcagtgcctgacagtgagtatgataagttattacatgagctgattgaaattgaagaaaaatatccagaattcaaatcgacagactctccaacagtgcgtgtgggtggcgaagctcagtcttcttttgaaaaagtaaatcacgacacgcctatgttaagtttaggtaatgcttttaatgaagaagatttaagaaaatttgatcaacgtattcgtgatagtattggtaaggtcgaatacatgtgtgaacttaaaatagatggtttggctgtttcgctcaaatatgaaaatggtcgttttgttcaaggacttacacgtggtgatggtacgacaggtgaggatatcactgaaaatctaagaactatacatgctataccactaaaaattaaagaacctctcaattttgaggtccgtggggaagcttatatgccacgtcgttcattcattcatttgaataatgaaaaagaacaaaatggtgaacaaccttttgcaaatccacgaaacgctgctgcaggctctttaagacaacttgactctaaactagctgcgaaaagaaagttaagcgtcttcttatatagtgtgaatgacctaaccgagtttaatgcaacaacacaaagtgaagcgctagaggaattggaccaattaggttttaaaactaaccaagaacgtgaacgagtatcagatattgagggcgtacttaattatatagagaaatggacaagcaaaagaggatctttatcttacgatattgatggtattgttataaaagttaacgatttatctcaacaagaggaaatgggttatacgcaaaaatctccaagatgggcgattgcttataaatttccagctgaagaagttattacaaaattattggatattgagctaagtattgggcgtacgggtgttgtgacaccaactgcaattctagaacctgtaaaagtagctggtactacagtttcaagagcctcacttcataatgaagatttaatacatgaaagagatatacgtatcggagatagtgttgttattaaaaaagccggggacatcatccctgaagttgtaaaaagtattttagatagacgacctaacgaatcggaaatttatcatatgccaacacattgtcctagttgtggacatgaattagttcgtattgaaggagaagttgctttacgttgtattaatccaaaatgtcaggcacagcttattgaaggacttatacatttcgtttcaagacaagcgatgaatatagatggtttaggtactaaaattattcatcagctatacgaaaatcagttaatcaaagatgtcgcagatattttctatttgaaagaagaagatttattaccattagagagaatgggaaagaagaaagttgataatcttttattagcgatagaaaaatctaaagaacagtcattagagcatttattatttggactgggtattagacatttaggtgtaaaagctagtcaagtacttgctgagcgatatgaaacgatggatcaactttttaaagtaactgaaagtgaattaattgaaattcaagatattggagataaacttgcacaatctgttgtaacatatctcgaaaatagtgatattcgttcattaattgaaaaattaagtaataaaaatgttaatatgtcttataaaggaattaaaacaactgaaatcgaaggtcatcctgattttagtgggaaaacaattgtattaacagggaaactcgagcaaatgacgagaaatgaagcatctgaatggttgaaaatgcaaggtgctaaagttacaaacagcgtgactaaaagtactgatattgtcatagctggagcagatgcagggtctaaattagccaaagctgagaagtatggtactgaaatttggactgaagcagcatttattgaaaaacaaaatggaatctaa

SEQ ID NO: 2482 - DNA, 822 bp, Staphylococcus epidermidis
tttaaacgaggtggcataatgcatttatattatctaggacctaaaggaactttttcatatctagccgctaagcaatttgaatcacatgaacagtatgacttcattccattatctaacttgcatgaagtcattcaatccgtatctaaagataaacaggctgtcggaattgtccctattgaaaactctattgaaggtactattaacattgtcgctgattcattagcacatcatgatgtatacgcacatggtgaaattcaactagatatagatttttcactttacggtcatcattcaaattcacttgatgatattcataaagtatattcaattgctccagcaatcagtcaaacaataaactacattcatcgtcaacagtttgactatgattatgtagatagcactattcaaagccttaacatgataaaagatggtattggagcaatagctcctcttgggagtggggaaacttatggctaccatactttagatcaacatatacaagattaccctcataatgtaactagatttttagtagtgaaaaatcatactcattttattgaacatccaaacacaactatcttccttatcacgcctaagtatgataagccaggacttttagctagtgttttaaatacttttactttattcaacataaatttatcgtggattgaatctagaccacttaaaactcaattaggtatgtatcatttttatgttcaagccgatactgctataaataatgatgtgaataaaattatttcaattttagagactttggattttcaagttaaaattatcggcgcttttaataagaaaaactaa

SEQ ID NO: 2483 - DNA, 561 bp, Staphylococcus epidermidis
agaactggaggggtgaatgtgcataaaatagatttatcaggcaacaaatttcaaatccaacgatttgttctgttgcaaattgtattggcgctatttacaatactatttacttataaatgggcttatcaaacaacgcatatcattgaacaaaatcttgtcatgaatcttatttttggatttgtaggtttcgcagtactagttattttgcacgagtttattcatcgtattttgttcattatattttctaaaggtgaaaaaccatctttaaaatatgataaaaacaaaattattgtacagttctctcagacttgttttcatcggtggcaatttacaattatcatgatagcaccacttgttatcataagtgcgaccttactagcacttattcaaatatattccttttcatctttaatctttatgtttagtatacatacaagttattgtatgatagatgtgtttttagtagcattggcattacaaagcaaattcaaatatatacaaacctatggagaaggtttgtatctttatcatcaaaagcctactcaaacctattatgaataa

SEQ ID NO: 2484 - DNA, 1047 bp, Staphylococcus epidermidis
ttttatggaggttttggtatgacattaggttatataggttcttatactaaaaagagtggtaaaggtatatatcgcttcaaactaaatgacgaaacaggagttattgaagcgttagaaactggttatgaaattgaagcgtcaacttatcttactcgtaatgaatcgtttttatatgcgattactaaagaaggtgaagaatgtggtgtagctagttttagtattaaagaagatggacaactggaattaattaataaatgtctagcatcaaaacagggaactggttgttacattcaagtgtctagtaatggtaaatatttatttgaagcggtttatggtgcaggacttgcaaggatttataaattaaatccaattacgggagcaatagagaaattaatagaagaacttgagcatgaatttccaactggctcacatgaaagacaagattcatcacatgttcattttttaaatgaaacacctgatcataagtatgttgtagctactgatttaggtacagatagagttgtaacatacaaatttggtgaggatggtttaaaacaatatgcagtttctcaattcaaaaattcagacgggcctcgccacatcgcttttagtaatgatggacgacacgcgtatatcgttcacgagctatcaaatgaggtgagtgttacagaataccaagacggtaagttcattgagctagagagacattcaactattccaagtgactttaacggggaatcgaaattagcagcagtgagactatcacatgatgggaagcacttatatataagtaatagagggcatgatagtattgctatatttgaagttttagaagatggcagatcactgagaagtattgaaatacaaccaagttacgatgcctttccaagagactttaatataactgaatcagataactatttaatttgcgcacatcaagaaggagaatcaaaagtttcaatttttgagcgtgataacataactggtaaactttcattaaaagataaaaaagctatagcaaatgaaggtgtttgtgtactactataa

SEQ ID NO: 2485 - DNA, 171 bp, Staphylococcus epidermidis
gatggtggaggggggcagattcgaactgccgaacccgaaggagcggatttacagtccgccgcgtttagccacttcgctacccctccaaaatggtgccggccagaggacttgaacccccaacctactgattacaagtcagttgctctaccaattgagctaggccggctatag

SEQ ID NO: 2486 - DNA, 165 bp, Staphylococcus epidermidis
aatgaattgggagtttgtttaaatattataaattggggagattatgatttatggctaacacaaatagaaaaagcaaaaaaatgtcagatgctaaatgcatcaaaacaagacaggtatatccacaagataccaatcatcatcacacaatgttcggtggaactttaa

SEQ ID NO: 2487 - DNA, 564 bp, Staphylococcus epidermidis
atagaaatggggaaattgggacaacaaattattggttatcattgtaatgatgaggttaaaatagataaattcaaaaatagagaagtatctttgcttataagttatgaagatgatatctggctaggtaatggaatgtatttttgggaaaataaaagcaacctggattattggaaaagaaacagggaaaggaattacccagacaaaaatttctccagtgtagaagtaatgttgtctttagactttttgttagatttaagtgataaagagcatagaaaattttgcaagaaagttttgagcgatttaattgaaagagggaaagataacggtatagatgaaagcattttcaataatgatttaggtgaggtaattaatgtattattttctaaaactgatattttagcatcacattttaatgtgttaagaacacatggtttatacaattggtcagaggacaaatttttggtaggaaatgataacaaataccaaagtgtaaacagaccaacttcaaatgttaaaactatctattgtgtaaaaaatgaaagggcgattttagaaatcttgtaa

SEQ ID NO: 2488 - DNA, 135 bp, Staphylococcus epidermidis
cgggccgcgggggttcgaatccctcttcctccgccattaattattagcgcgggatggagcagttcggtagctcgtcgggctcataacccgaaggtcggtggttcaaatccgcctcccgcaatattattgatatag

SEQ ID NO: 2489 - DNA, 1557 bp, Staphylococcus epidermidis
ttaataaagggagtgttaattatgttaacattaggtacagctctcagtaatcaaattgatgcaaattggcagacttacgttatgattattgtctatttcataatccttctaattattggcttctatggttatcgacaagctactggaaacttaagtgaatttatgttgggaggacgtagtatcggaccatatatcacagctttatcagctggtgcctctgacatgtctggatggatgattatgggacttccaggttcagtatacagtacaggtttatccgccatttggataaccattggattaaccttaggtgcatacattaattattttgttgttgctccaagactacgtgtttatactgagattgcgggagatgctattacactcccagacttttttaaaaatagactagatgataagaaaaatattattaaaattatttcaggattgattattgtcgtatttttcactctatatacgcattcaggtttcgtttctggcggaaaactctttgaaagtgcatttggattgaattatcatgctggactcttgatagtggctattatagttattttttacactttctttggtggctatttagctgtatcaattactgatttttttcaaggtgtgattatgcttattgctatggtaatggtacctatcgttgcattgcttaaactcaacggttgggatacatttcatgatattgctcaaatgaaacctacaaacttagatttatttagaggaaccactgttttaggcattgtttcattattctcatggggactcggatattttggtcaaccacatattatagtaagatttatgtctatcaaatcacataaattactaccaaaagccagacgtctgggaataagttggatggcagtcggtctattaggagcgattggtgtgggattaacaggaatttcatttatatctgaaagacatattaaattagaagatcctgaaacactatttattgtgatgagtcaaatattatttcatccgcttgtaggtggatttttattagcagccatccttgctgcaataatgagtactatctcttcacaattactagtaacatcaagttctttaactgaagatttctataaactaatcagaggttcagataaagcatcatcacaccaaaaagagtttgttttgattggacgcttatcagttctacttgttgcgatagttgctattacgattgcttggcatccaaacgatacaatactaaatttagttggtaatgcttgggctggttttggagctgcatttagtcctttagtactctactctttatattggaaagatttaacacgtgcaggagctattagcggaatggtagctggtgctgtagttgttattgtttggatttcttggataaaacccttggctacaatcaatgcattctttggtatgtatgaaatcattccaggtttcatagttagcgtattgattacgtacatcgtaagtaaattaacaaaaaaacctgatgattatgttattgaaaatcttaataaagttaaacacgtcgttaaagaataa

SEQ ID NO: 2490 - DNA, 717 bp, Staphylococcus epidermidis
atgaaaatttttgtttgtgaagatgaccaaagacaaagagaacatatggtatcaatcattaaaaactacataatgattgaagaaaagccaatggagttagccttagcaacaaatgatccttatgaggtcttagagcaatcaaaagaacttaatgacattggttgttacttccttgatattcaattagaagctgatatgaacggtattaaattagccagtgaaattcgtaaacatgatcctgttggtaatattatatttgtaaccagtcacagtgaactgacttatttgacgtttgtttataaagtggctgctatggattttatttttaaggatgatccatctgaattaaaaatgagaatcatagattgtcttgaaacagcacatacacgactcaaattattatcaaaagaaagtaatgtagatacgattgagttaaagcggggaagtaattcagtatacgttcaatatgatgacattatgttttttgaatcatctacgaaatctcatagactcatcgcacatcttgataatcgacaaattgaattttatggaaatttaaaggaattagcacagcttgatgaacgtttctttagatgtcataacagttttgtgataaacaggcataatattgaatctattgattcaaaagaacgtattgtttactttaagaatggcgaaaattgtttcgcttcagtacgtaatgttaaaaaaatataa

SEQ ID NO: 2491 - DNA, 210 bp, Staphylococcus epidermidis
gataatattatcgtagtaaatacaagtaaaaaggagttccaatatttaatgagtgaacagcaaacgattgatcaaattaaaacacgattaaacaaatttattgaagacattgatcatgtaaatccggatgaggtacgtgtagaagatattgatgagtggattggtttacttgatcagttggaagaaaaagtgaaacaagtttcaaaataa

SEQ ID NO: 2492 - DNA, 528 bp, Staphylococcus epidermidis
tgtcacattatggcaaaaaaagtagcaattattctagcagatgaatttgaagatatagaattaacaagtcctaaagaagcattagaaaatgctggatttgaaacagaagtgattggtgatacagctaaccatgaagttgttggtaaacacggtgagaaagtcactgtagatgttagcattgctgatgctaaaccagaaaattatgatgcattattaattcctggtggattttcacctgaccacttacgtggtgatgaagaaggtcgctatggtacttttgctaagtatttcactaaaaatgatgttccaacatttgcaatttgtcacggaccattagtattagttgatactgacgatttaaaaggacgtacaatcacgggtgttattaacgtacgcaaagatttatcaaatgctggtgcgaatgttgtagatgaatcagtagtggtagacaacaacattgtaacaagtcgtgtacctgatgatttagatgacttcaatagagaaattgttaaaaaattagaagcataa

SEQ ID NO: 2493 - DNA, 669 bp, Staphylococcus epidermidis
gatttaactatgaagcaattaatgattagaaacttaaaattacgtacttggacactaattatttacgcattattgcttttattctttcccatttatcatttgttaaataaagatacaccactatattcaattatctcaggaccaatcggattaatactgacgatgatatgtttgatagatataggtcatttattcagagttaatcgtagattacgtggttcatcttcatattatttcttttatagtttgcctgtatcaaagagagatttgcttaacgctaattacatgacatgcattttattaacttttataggtgagcttatcattagtttatatggatactacacaagcacaataaaaacagattcgatttatttttcgacgactttttcattcatagtagggaatttcttttctatacctatagcgtttagtaagagtactgaacgtaaagatcgagatattccatatatagcttatattgtaggaattatggtggttctgccatttactttatcggtcatttttatcttaatcaattatcttacacacaatgatagccatatcccaatgatatactcatatttcttaaattatggtctattagttgtaagtagcattttcttagtcattaattatttgattcaaattaaaaaaataaagtattaa

SEQ ID NO: 2494 - DNA, 1401 bp, Staphylococcus epidermidis
tttttttatatacttgaactaacaaaagattgtaatggggaggtggttgaatttatgaaaaagtttaacattaaacattcatttatgcttacgggctttgctttcatggtaactacatcattattcagtcaccaagcacatgctgaaggtaatcatcctattgacattaatttttttaaagatcagattgatagaaatacagctaagagcaatattatcaatcgagtgaatgacactagtcgcacaggaattagtatgaattcggataatgatttagatacagatatcgtttcaaatagtgactcagaaaatgacacatatttagatagtgattcagactcagatagtgacttagattcagatagtgattcagattcagatagtgattcagattcagacagtgactcagattcagatagtgactcagattcagatagtgactcagattcagacagtgattcagactcagatagtgactcagattcagacagtgattcagactcagatagtgattcagattcagatagtgattcagattcagacagtgattcagattcagatagtgattcagactctggtacaagttcaggtaagggttcacataccggaaaaaaacctggtaaccctaaaggaaatacaaatagaccttctcaaagacatacgaatcaaccccaaaggcctaaatacaatcaaacaaatcaaaacaatataaaccataatattaatcatacacgtactagtggagatagtgcgccttttaaacgtcaacaaaatattattaattctaacttaggtcatagaaatcaaaataatataaatcaatttatatggaacaaaaatggcttttttaaatctcaaaataataccgaacatagattgaatagtagtgataataccaattcattaattagcagattcagacaattagccacgggtgcttataagtacaatccgtttttgattaatcaagtaaaaaatttgaatcaattagatggaaaggtgacagatagtgacatttatagcttgtttaggaagcaatcatttagaggaaatgaatatttaaattcattacaaaaagggacaagctatttcagatttcaatattttaatccacttaattctagtaaatactatgaaaatttagatgatcaggttttagctttaattacaggagaaatcggctcaatgccagaacttaaaaaacctacggataaagaagataaaaatcatagcgccttcaaaaaccatagtgcagatgagataacaacaaataatgatggacactccaaagattatgataagaaaaagaaaatacatcgaagtcttttatcgttaagtattgcaataattggaatttttctaggagtcactggactatatatctttagaagaaaaaagtaa

SEQ ID NO: 2495 - DNA, 153 bp, Staphylococcus epidermidis
caagcgtatatatcaaagttgataattgatttaaaaatttcatttcttatttttcatctcgtttcaattgtaataaaaaatctcattaaaatatgcaactacattcacataactacttatgtagaaaaggataggactatgaatttattttaa

SEQ ID NO: 2496 - DNA, 126 bp, Staphylococcus epidermidis
gtttttaatatagaaaaagtgtggattgtacatccacactctatgactaactattctcttattttatttctaaataatcctaataaacctaatccagtaagtaacattattaaagcaggattttga

SEQ ID NO: 2497 - DNA, 1827 bp, Staphylococcus epidermidis
atcaataatattacaattgtaatattcgcgtcaatagtttattataaatatttgaaagaaggtgttgaaatggctaagttattaataatgagcatagtaagcttttgttttatatttctattgttattattttttaggtacatattaaaacgctattttaattatatgttaaattataaagtttggtatctaactcttcttgcaggattaattcctttcatccctattaaattctctttttttaaatttaataatttgaataatcaagagcccacagttgaaagtaattcacacaatttgaatcctaacataaataccactaaacctgttcatgagtttacaacagacatccataagtttaattgggattcaatagataatatctgcacagttatttggatagttttagttattattttaagttttaaatttttaaattctttattatatcttaagtatttaaagaaacagtcactttatctaaatgaaaaagaaaaagataaaataaacaagatacttttcaatcatcaatataaaagaaatattgtgattcgaaaagcagaatctattcattctccaataactttttggtatggaaaatatattattttgattcccagtttatattttaaaagtataaatgacaaaaaactaaaatatataatattgcacgagtatgctcatgctaaaaacagagatactttgcatttaattatctttcatattttttctattgctatgagttataatccactaatacaaattgtaaaaagaaagatgattcatgacaatgaagtagaagccgatagatttgtccttaataatattaacaaaaatgaatttaagtcttatgcggaagctattatggattccgtattaaaaacctcatttttcaacaaaaatatattaagccattcatttaatggtaaaaaatcattactcaaaagaagattaattaatataaaagaaggcaatctgaagaagcagtcaaaattaattctaatttttatttgtatttttactttttttatcatgataattcaaagccagtttttaatggggcaatccttaactgattataattataaaaagcccttacaaagcgattaccaaattttagatgaaagtaaaaattttggttcaaatagtggatctttcgttatgtacagcatgaagaaagacaaatactatatttataatgaaaaagaaagtagaaaaagatattctcctgattcaacttacaaaatttatttagcactgtttggacttgaccgtcatattataagtgataaaaattcacgtatgtcatggaatcataatcattatcctttcgattcttggaataaggatcaagatttaaatacggcaatacaaaactcagttaattggtacttcgaacgtattagtaatcaattatcaaagaactatacttctgatcaactcaagcaattaaattatggtaataaaaatttgggaagttataaagcctattggttggaagatagtttgaaaatatctaatcttgaacaagtaatagttttaaaaaatatgatggaacaaaataaccattttagtaaaaatgaaaagaaacaattatcttcttcgttattgattagaaaaaatgaaaattatgaattgtatgggaaaacaggtacaggtatagtaaacgggaaatataataatgggtggtttgtaggttacgtaattacaaatcatgataagtattatttttctacacatttatcagatgaaaaagcctctggtgaaaatgctaaattcataaatgaaaaaatattaaaagaaatgggtgttttaaatggccaataa

SEQ ID NO: 2498 - DNA, 135 bp, Staphylococcus epidermidis; identical to SEQ ID NO: 117

SEQ ID NO: 2499 - DNA, 1068 bp, Staphylococcus epidermidis
agtaaaaatataaggagagattataaaatgcaaaaagtacgttctgatataatgactcatcgtggttctcactatgatttaggagtaaagactgctctttggttacaaaccactcctttattaaaaaatcgaaataaagaatggcgaaagagaattccacgttttgatattgatgtcaaggaaacctatgatatatttcaaatctattcgccacagatttgggaagaaataattggtatgcaagatgtattgaatctacctacaaaacaaatgattttaaattttggccattatcgatttactgatttaaaggacagtggttgcacagtatataaaggtcgtgattttttagtccgaaattatgattatcatcctgcaacatatgatggtagatacttattatttcaacctaatgacgggggattatctcaaataggaccgacttcaagagtgactggtagaatggatggtatgaacgagtatggtttagttatggcatataattttatgcatcgtaaaaagcctgcaaatggatttgtatgttacatggttggtcggctaatacttgaaaattgcaaaaatgtaactgaagcaatcaaatttttaaaggaagtaccgcatcgtagttcattcagttatatactaatggatagacattcgaattatgccattgtcgaagttacacctcgatcaatagatgtaaggtatgaacatatatgcacaaatcattttgaattgcttacccatgaaaatagaaactatacaagagaatctaaagaacgcttaaatcgtgtaataaataaaacaactccttctacaaacaaagatatcgcattcaaattatttaacgacccgcaatacgaaatctatagcaacctatttaaaagttggtctggtacaattcatacttcactatatgaacctaattcattaatagcatggatggcattaggtcaaaacagtcatccaacctcaatcaatttttctaattggttaaaaggaaagaaattgaatataaattactttgaaggcgaaatagatacaccattaacttttgccacatactaa

SEQ ID NO: 2500 - DNA, 387 bp, Staphylococcus epidermidis
aataaaagtatagaggttaagatggaaaaatttaatagacaagaacaattaaaacagttgcatgcagaacgaaaagttaaaaccgagaaaaaagttgataaagcaataaatgatttagttcaaaaaaataaagaaattaactttaacatcgtttctaaacattcaaaagtttcgaaagctacattatataaaaataataaaattcgaaagaaaatagagaagttacgtgaacaaaacagagaaatatttgttcataaaaataaaaatgacggtaaagatgcgttaatctcctctttaaaaagaaaagtaaattctttagaaaaagagaaaaaaatgttgaaagaagaaattagcgttttatattctaggctgtatgaggatatttaa

SEQ ID NO: 2501 - DNA, 1383 bp, Staphylococcus epidermidis
ttgagaatcttttttgttataccatttacgtgttataattactcgagtgcaaattggaggaggaaacgcatgagacaatggactgcaacccacatggctaagttagcaaggaaagcaagtatagctgtaggtaaaaagggtacagacttgccgggacagattgcaagacgtgtggatcataatattttaagaaaattagctaaacaagtagatgacattgtttttataagtgggactaatggtaaaacgactacatctaacttaattggacatacattaaagaaaaatcaaataaacattattcacaataatgaaggagcaaatatggcagcagggataacttctgcttttattatgcaaagctctaagaatactaatattgcgataattgaaatagacgaaggatctattccacgtgttttaaacgaagtcacaccttctatgatggtgtttacaaatttctttagagatcaaatggatcgatttggtgaaatcgatattatggttgataatattgcaaaatcaataagtaacaaagggataaaattattattaaatgcagatgatccgtttgtgagtcgcttgaaaattgcaagtcattccattgtgtattacggaatgaaaaaatttgcgcatgactttgaacaaagtacaatgaatgaaagtaaatattgtcctaattgtggacgattattgcaatatgactatatacattataatcaaattggacattatcactgtgaatgtggatttaagcgagaagaacctacatatgaagtgtcatcatttgatgcttcaccattcttaaaaatgataataaaccaaagtgagtttaatatgaaaattgcaggagattttaattcttataatgcaatagcagcctataccgtattaagagaattaggattaaatgatgatgcaatacgcaaaggatttgaaacatatacgtctgataatggtcgcatgcagtatttttcaaaaaataagaaggaagctatgattaatctagcaaaaaatccagctggaatgaatgcaagtctatcagtaggcgagcaaattgatgataaaaaaatttatgttattagtcttaatgacaacgcggcagatggtcgagatatttcatggatatacgatgcagactttgaaaagctagctacccaagatatcgaagctatcattgtaagtggtacacgtgctgaggaactacaattacgtctcaaacttgctgaagttgaagtgcctattaaggttgaaaaggatatctacaaagcgactgcattaactatgaaatacagttcatttacggtagcaattccaaactatacatcattaacaccaatgcttgaacaacttaatcgctcatttgaaggagggcaatcgtaa

SEQ ID NO: 2502 - DNA, 126 bp, Staphylococcus epidermidis
tataatatcatacataaatggttaataaaatattgcttctataaactaatcccattatattcattccatttttatttgtttagtcgtttaatttccaagttgagacatagcttcttgatattgtga

SEQ ID NO: 2503 - DNA, 306 bp, Staphylococcus epidermidis
tctgatttaataaaatatttagaccaaatatatgaaattaaaagcgacataattattattaaaattattgataaacaccagttttcattggctgaatctactaaatccttgaaccatctaatttttttatttttatatatatacgcatatataattatagctagaagcataattatatttataaatcttatgttattactttcaactttttttaatttttcagttggtttacaaaaatctattaatactgtatatgagttatcaaatatatatgtaaaaaataaaggtataataaagaaaaggtaa

SEQ ID NO: 2504 - DNA, 858 bp, Staphylococcus epidermidis
tgtgtcataatatatgtaagaaaaacgtttgaatatagaagtagggatagtaaaatgccaaaggtaactaaaatagaagtacaaaaaaagaataaagaacgctttaatctctttttagatggagaatttgaaatggggatagatattgatacattagttaaatttaacttaaaaaaagatcaaatacttgaaccgtcagatatgcagaatattcaagaatatgatcactaccgtcgaggtgttaatcttgcaattcaatacttgtcttataagaaacgtactgaaagagaagttatacagtatttagaaaaaaacgatattcaaagtaatgctattcaagatgtcattgactattgctataaggaaaaatttattgatcatgaagactacgcagaaagtttaaaaaacaccatgatacacactacagataaaggaccagaaatatatagacaaaaactctatcaattaggtattgaagttacgattattgaaaaatatgtcgaagcatatgaacaacaacaaccattagatgacgtcatcaaagttgctgaaaaagtgatgaagtctaaaaagggtcctgaagcaaaggtaaagcaaaaagtaacacagtcacttctccaaaaaggatataagtttgaaacaattcaactagttatgaatgaaatagatttttctcaagacgaagaaacattagaccatttattgcaacgtgatttagagaaagtctataataaaaattgtagaaaatatgacagtgataaaagtgttattaaaaccatagaggcactcatgagaaaaggctataattatgataaaattaaatctaaattagaagaaagcggtatatctaatgaataa

SEQ ID NO: 2505 - DNA, 582 bp, Staphylococcus epidermidis
cgaaaaataattgaaaggaatgaaataatggtacaaaatgcatttgttgcactggactttgaaactgctaacagtaaacgaacaagtatttgctctgtaggtatggttaaagttattgataatcaaataacagagtcatttcatacccttgtgaatccttttgactactttactgaaacaaatattactgtacatggcatccatcccgaagatgtgcaagatgctcctggattcaagcatgtctatccatatatgctaaaatttattgatcaacttcctgttgttgcccataatgctgcttttgatatgaatgtgttacatcaaagtttaaaaagtcataatatagatacaccttctttgacatacttttgttcatatcaattagctaaacgaacaattaatgcatatcgatatgggctaaaacatttaatgaatcattaccatttagattttcacggtcatcatgatgcgttaaatgatgctaaagcttgtgcaatgattacctaccgcttattgaaacattatgatgatcttcaaagcatgttgagtatatatggaaaaaatctcaaagataaaggctga

SEQ ID NO: 2506 - DNA, 1146 bp, Staphylococcus epidermidis
attatgataatatcaaacaaatcccctatttctatcaacaatgatccatgggaagcatataatgatattttagaacataaccaattaacattaagtaatatagaatttacaactacaaatttatgtaatatgcgttgcagtcattgtgcagttggttacactttacaaactaaagatcctgatcctcttccgatggatatcatctatcgacgtttggacgagatacctaacttaagaacattgtctattacaggtggagaaccaatgttttccaaaaaatcaatcaaaaacgtcgttaagcctctacttaagtatgccaaacatcgtggtatttatgttcaaatgaattcaaatttaactttacctcaagaccggtatttagatattgcagaatacatagatgttatgcatatttcacataattggggaaccattcaagagtttactgatgttggctttggtgcaatgagaaaacaacctcctctaaaagccaagttgaaattatatgagcaaatgcttgaaaattccagcactttatcagaccaaggcatgttcgtatcggcagaaacaatgcttaatcaaagcacagtcccttatctaagtaaaatacataacgaagtggtaaatgacatgaaatgtagccgtcatgagattcacccaatgtatccatctgattttgctagccaattaaatgtattatctcttaaagaaatgaaagaagctattcatcatttgttagatatacgtgatgaaaacacatggatgttgtttggtactctacctatctatccatgtttaaatgatgaatatgatcaacatttattgcaacgtttaagaaaatcgaagaatgttacaatgagaaatgaccctgatggtcgtagccgtttgaatgttaatgtatttactggcgatgttattgtgactgattttggtgatgaaaatggtacaatatctaatatacaaaaggataaattgacagatgtattcaaccagtggttaaatactgaccttgcacaatctttaaattgtcattgtgcagaatatcaatgtctaggtccgaatgttttagttaaaaatatgtattacccaaatactgatttcaagaaaaaagaacaaatcatgcatcaacatcaaatattttcataa

SEQ ID NO: 2507 - DNA, 180 bp, Staphylococcus epidermidis
aatcataaaattggtaccattcttagattttacttctactattttcataataatctcatttctaattttaatagtataagtatacactattcaaattctttttacatcatacatattaaacttattacacgtaataaaaaaagactatttaatatttttactttgttcattttttcttaa

SEQ ID NO: 2508 - DNA, 159 bp, Staphylococcus epidermidis
gaattaaaaatatctacaaagacatgtaaaaacactgctagttgtgcccataaccatacatgtaaaggattcgtttggctaaatattacaaatataaaaaatgtaattaatataggccataatattgtaaaaggtaatgaatgtgtgattcctctgtga

SEQ ID NO: 2509 - DNA, 1440 bp, Staphylococcus epidermidis
ggagtggaaatcatgcattttgaaacagtaatcggacttgaagttcatgttgagttaaaaacggactcaaaaatgttctctccatcacccgcacattttggagctgaaccaaattcaaatacaaatgttatcgacttagcttatccaggtgtattaccagtagttaatagacgtgcagtagattgggcaatgagagcttcaatggcattaaatatggatattgctacaaattcaaaatttgatcgtaaaaactatttctatccagataatccaaaagcatatcaaatttctcagtttgatcaacctattggagaaaatggctatattgatattgaagttgatggagaaacaaaacgtatcggtattacacgtcttcatatggaagaagatgcaggtaaatcaacacataaagatggttattctctagtagacttaaaccgtcaaggtacgccattaattgaaattgtatctgaacccgatattcgttcacctaaagaagcatatgcttatctagaaaaactacgttcaatcattcaatatacaggtgtatctgattgtaaaatggaagagggatccctacgttgtgatgctaatatttcacttcgtccatatggtcaaaaggaatttggtacaaaaactgaattgaaaaaccttaactcatttaactacgttaaaaaaggtttagaatatgaagagaaacgtcaagaagaagaattattaaatggtggagagattggtcaagaaacacgtcgatttgatgaatctactggtaaaacaattttaatgcgtgtgaaagaaggttcagatgattatagatatttccctgaaccagatattgtaccattatatgtagatgaagattggaaagcacgtgtaagagaaacaattccagaattgccagatgaacgtaaagctaaatacgtaaatgatcttggactaccagaatatgatgcgcatgtattaacattaactaaagaaatgtctgatttctttgaaggcgcaattgaccatggtgcagatgttaaacttacttccaactggttaatgggaggtgttaacgagtatcttaataaaaatcaagttgaattaaaagatacgcaactaacacctgaaaatttagctggtatgattaaattaatagaagacggaacaatgagtagtaaaatcgctaaaaaagtttttccagaactagcagaaaatggtggagatgctaaacaaattatggaagataaaggtttagtacaaatttctgatgaagcaacactacttaaatttgtaacagatgcattagataataatccacaatcaatagaagattataaaaatggtaaaggtaaagctatgggattcttagtgggccaaattatgaaagcttctaaaggtcaagctaacccacaaaaagttaatagcctattaaaacaagaattagataaccgttaa

SEQ ID NO: 2510 - DNA, 480 bp, Staphylococcus epidermidis
tttggagtgatactaatgatacatgtagcatttgtatgtctcggtaatatatgtcgttctccaatggctgaggctatcatgagacaaagactacaagaaagaggtatttcagatataaaagttcattctagaggaacaggacgttggaatttaggcgaacctccacataacggaacacaaaaaattctacagaagtaccatattccttatgatggtatggtgagtgaacttttcgaacctgatgatgattttgactatattattgctatggaccaaagtaacgtagacaatatcaaacaaatcaatccaaatttacaaggacaattgttcaaattgctagaatttagtaacatggaagagagtgatgtaccagatccatactacacaaataattttgaaggtgttttcgagatggtgcaatcatcttgtgataatttaatagactacatcgtaaaagatgcaaatttgaaagagaggtaa

SEQ ID NO: 2511 - DNA, 1080 bp, Staphylococcus epidermidis
ggtgagtcgatgactgaaagaagaattattcatatagatatggattatttttttgctcaagttgaaatgagagataatcctaaactaaaaggaaaacctgtcatcgttggcggtaaagcgagtcatcgaggcgtagtttctacggcatcatacgaagcaagagcttatggtgttcactctgctatgcctatgactcaagcacataagctatgccccaatggatattatgtaacaagccgttttgatacttatagagaggtatctggtcaaatcatgaaaatattcagaagttatacagaattagtagaacccatgtctttagatgaagcttatttagatattacacatttagtgagaccggatttaccagcatcaaccattgcaaattatattcgcagagatatatacgaagtaacaagtttaactgcgtcagctggcgtgtcttataataagtttttagcaaagttagcgagtggtatgaacaagccgaatggtttgacagtaattgattacaataatgtacatgaaatattaatgcaattagatattggagattttccaggggtaggcaaagcttcgaagaaaaaaatgcatcaacatcatatatatacaggtcaagatttatataataaagatgaatttgaattaatacgtttattcggtaaaagaggacgaggtttgtataataaagctcgaggtatagaccataatgaagtaaaggcgagtagagttcgtaaatctgttgggactgaaaggacattttctacagatgttaacgatgatgatgttattttaagaaaaataagagagctttcaggaaaaacagcagaacgtttaaataaaattcaaaaatcaggtaaaacagtcactgtaaaaataaagacctatcaatatgaaacaatctcaaagcaaaaaagtttgagagatcctattcgtactgaaactgatatctataatattgcctatactttatataacgacttaaaagatccagagattccgattcgattaataggtgtaacggtcgggagtttagagcaatctgattttaaaaatttaacaatatatgattttatttaa

SEQ ID NO: 2512 - DNA, 138 bp, Staphylococcus epidermidis
ttctccaagatattttgcctggcaacgtcctactctagcgtaacgtcagtccgactaccatcggcgctaaggagcttaacttctgtgttcggcatgggaacaggtgtgacctccttgccattgtcaccagacaaatga

SEQ ID NO: 2513 - DNA, 171 bp, Staphylococcus epidermidis
atgaaacacttgactaaaatatttgttggattagctattgtactatttatagtagggtattatttacaagcgacagatcacgattcacaaggtataaaattattgttagcagcaattatgtttatgatttgtgcttttattaatagacataatgagcgtaaaaaaaaatag

SEQ ID NO: 2514 - DNA, 435 bp, Staphylococcus epidermidis
atatcttttgttttacctgtttccggtaatttatcttgtacatcattgttattatctttcttggaagttgttgtaatttcgtcttctttgtctttcttagttatttttgtgtctttctcgtctttgccgctttttggtattactgggcttttctcctctctatctttcttcaaagtttttgtgattttcttttctttgtctttttttggtgtttttgtgtcttcgtctttctcgactttaccgttacttggtattactggttttttctcttctctatctttcttcggagtttttatgtctttcttttctttgtctttctttggtgtttttgtgtctttagattctttctcatctttatctttctttagtgtttttgtgtcttcgtctttctcgtttttggtaatttgtgtatttgttactgaagtatttgcttga

SEQ ID NO: 2515 - DNA, 123 bp, Staphylococcus epidermidis
actcaagttgtcatttccaagatatcatttacctatcaaaattcagttttttatcatttatttaatgccataaaaaagactgttgaaaaagtcaaaaactttaacaacagtcttaatcaataa

SEQ ID NO: 2516 - DNA, 903 bp, Staphylococcus epidermidis
gcactaaatgttgggaaaataagcataagcgtatttttgaagttgctgaacacgttaaagagatggaggatgaaaatgagtagattgcaagatgttgtggttaatgaaatgaaagtaaaaaaacaaattgacagtgtagaggaaatccaggaaattaagcaatttattaaagcgtatgtaaaatcacattcatttatacaaactcttgttcttggaatatcaggtggtcaagactctactctaacaggtaagttagcacaattagcagtaaatgaattgaaagaagagggacgtaactgtaaatttatagcagtgaaattaccttatggtgtgcaacaagacgctcatgaagtagaagatgcacttgagtttattaatcctgacacaacatatacagttaatattaaaccagcagttgatcagagtgttcaatcacttagtgaagcaggcatcaaacttactgattttcaaaagggtaatgaaaaagcacgtgaacgaatgaaagttcaattttcaattgcttctaatactcaaggtatagttttaggaactgatcactctgccgaaaatattacaggattttacactaaatatggagatggtgctgcggatattgcgcctatctttgggttaaataaaagacaaggtaaacaattactagcttatctaggagcacctaaacacctttatgaaaaagtgccaacagctgatttagaagatgataaacctcagttaccagacgaggaagcactaggcgtatcttatcatgatattgatgattatttagaaggtaaagaaattcctggaactgctcgtgaaacaatcgaaaaacattatgttagaaatgcacataagcgtgaacttgcttatacacgatattcatggcctaaatataacaaatga

SEQ ID NO: 2517 - DNA, 846 bp, Staphylococcus epidermidis
attgtaggtgtgaaaatgatagataatttaattgtatatattaaaaacttaccacatctttttagtttttgtactcaaaggcttaagcaaacatggaagtggtttgcaattagcctaattataggactagtaattattctagcattagagggattttttaatttcaaccatactaccgatattgttcaagtgcgttggttattcagaatttcatcattcatcatattcagcattattatacaatctatttatatagcttataagtactatatcagagatttcgttgtcatgaagtcatttcatatatctgcagttacacctactatagttatagcgatgttaggtttaataacaatacttattctggggatagttattattattcttaagcctgtgaattttgaagcatcaatactttcatttttatattatttagtaattttagcaatttttatcagtgtgacttcgataatattgggcttgctgagttatgcaattaaacatgtaaaactgatatttattatagtaagtgctatcagcttctttatggttccaattacatacatccctaatacaaatttaaatgtggttaatcatattatgatgttaaatcctctgtattatttcgtaaatggtagttcgcaagctatagtatttggtacaatcagcatgagcaatttaccttatcatttatatattattattttaattggaatcatctgtgtgattaattatgcgcttgtgcgtcacatagcatttgataaatatcaaaaccaatctaaccaaaagaattattcaaaaaagaataaagaaaaggaatgtttaaacgtaaaattagataagtaa

SEQ ID NO: 2518 - DNA, 777 bp, Staphylococcus epidermidis
caccaatgcttgaacaacttaatcgctcatttgaaggagggcaatcgtaagatgaatgaactaacggtttatcatttcatgtcagataagcttaatttatacagtgatattggtaatatcatggcattaaaacaaagagctaaaaaaagaaatattaagataaatgttaaagaaatcaatgagactgagggagtcacatttgatgattgtgatattttcttcattggtggtgggagtgatagggaacaagcgcttgccacgaaagaattaagtaaaattaaaacttctttaaaaaatgcaattgaagatggtatgcctgggttaactatatgcggtggttatcaatttttaggtcataagtatattactcctgatggtaccgagttagaaggattgggtgttcttgacttctataccgagtctaaaaaagaacgcttaactggagatatcattatagagagtgatacttttggcacgattgttggatttgaaaatcatggtggtagaacatatcatccgtatggaacattaggccgagtaacgtatggttatggtaataatgataacgatcgaaaagaaggtatacactataaaaatctattaggttcttatcttcacggcccaattttaccaaaaaatcatgaaataactgattatctacttgagaaagcatgtgaaagaaaagggatactatttgagcctaagaagatcgataacacagaggaagaagctgctaagcaagttcttattaaacgtgcaaaagaaaataaaaaataa

SEQ ID NO: 2519 - DNA, 357 bp, Staphylococcus epidermidis
attcagatagtgattcagattcagatagtgattcagattcagacagtgactcagattcagatagtgactcagattcagatagtgactcagattcagacagtgattcagactcagatagtgactcagattcagacagtgattcagactcagatagtgattcagattcagatagtgattcagattcagacagtgattcagattcagatagtgattcagactctggtacaagttcaggtaagggttcacataccggaaaaaaacctggtaaccctaaaggaaatacaaatagaccttctcaaagacatacgaatcaaccccaaaggcctaaatacaatcaaacaaatcaaaacaatataa

SEQ ID NO: 2520 - DNA, 618 bp, Staphylococcus epidermidis
aaaaataaagtattaacatttttaaggaggtctatgatgaaattacaacatattaccaaaaaatatggtcaaaatactgttttagacgatatagattttgatttcggcgagagtcaaatcgttggtcttatcggtaaaaatggagttggtaaaacaactttgatgaaggtcatgaataataacatcattaactatcaagggaaagtcgacatgcctaaaagtgagaatgttggttatttaattgagcatcctaagttatatggaaacaagacaggtttatttaatttaaaattatttgcacaagtattaggcgatggtttcgataaggaatatgcaaatcatattattgaagcttttggaatgaaaccatatatcaagaaaaaagttaacaaatattcaatgggaatgaaacaaaaattatcaattgcagtttcattaatgaataaacctaaatacttaattttagatgaacctacaaatggtatggatccagatggttcgatagatgtattaaagacaattcaatcacttgttcaacaattagaaatgaaaatattaatctcaagtcataaattagaagacattgaattgatttgtgatagagcagtatttccttag

SEQ ID NO: 2521 - DNA, 537 bp, Staphylococcus epidermidis
catttgggagtagaacaaagatatgctgttattcaactcaaaacaaagtacaatgctacattcttaaaaagtgagtttgataaatgggaacaacacattgaagatatgtacgctttacattatccaagaatgtttattgatccatacactatgcagttgtcctatgaatcaaatcacattgaagatttggcattaagtattattgaagaacgtgagaagctagaaaaatttaagcataaatctaatcatgatttaaagaagtttaacattatactatctaactatagtgatagtgaacaacgtcagataaaaagatatcaaagagatgacatattagctgatgagagccttatattacgcatatgtgaggacataagcaacatagatagtaaggacaagaataatagaaatactgctatacaagaagaaattaaagctgataaagagcgacgtagggcagaaggtaaggcaagaaaagaaagaattaaagctcgtatgaaacgagcaagacaagaaaaacttttacaagcaaattaa

SEQ ID NO: 2522 - DNA, 333 bp, Staphylococcus epidermidis
aagaaagcggtatatctaatgaataaaaagaaaatgagtgaaatgtccgagcaagaactaagacatgaaatacaattatttaaagaaaaaatgcgtaaagcagagatgaatggcattatgaatgaatatgatgtttatcaaagcaaagtgattatagcagaaagctatcttgtggatcgcaataaaattgaacctggaaaaatctataaactcaatgatggtagtaaacagtactttaaagtagaacgactcaagggtgtatttgcatggggatttagaataaacagtagtgaacctgaggaaggtctaccattagcattattaaaattttag

SEQ ID NO: 2523 - DNA, 375 bp, Staphylococcus epidermidis
ggttaccaggtttttttccggtatgtgaacccttacctgaacttgtaccagagtctgaatcactatctgaatctgaatcactgtctgaatctgaatcactatctgaatctgaatcactatctgagtctgaatcactgtctgaatctgagtcactatctgagtctgaatcactgtctgaatctgagtcactatctgaatctgagtcactatctgaatctgagtcactgtctgaatctgaatcactatctgaatctgaatcactatctgaatctaagtcactatctgagtctgaatcactatctaaatatgtgtcattttctgagtcactatttgaaacgatatctgtatctaaatcattatccgaattcatactaa

SEQ ID NO: 2524 - DNA, 132 bp, Staphylococcus epidermidis
tataaattattcgaccctttgatttatcaagatagggtcgaatttttaattagtatgtggcaaaagttaatggtgtatctatttcgccttcaaagtaatttatattcaatttctttccttttaaccaattag

SEQ ID NO: 2525 - DNA, 468 bp, Staphylococcus epidermidis
gaaggtctatttgtatttcctttagggttaccaggtttttttccggtatgtgaacccttacctgaacttgtaccagagtctgaatcactatctgaatctgaatcactgtctgaatctgaatcactatctgaatctgaatcactatctgagtctgaatcactgtctgaatctgagtcactatctgagtctgaatcactgtctgaatctgagtcactatctgaatctgagtcactatctgaatctgagtcactgtctgaatctgaatcactatctgaatctgaatcactatctgaatctaagtcactatctgagtctgaatcactatctaaatatgtgtcattttctgagtcactatttgaaacgatatctgtatctaaatcattatccgaattcatactaattcctgtgcgactagtgtcattcactcgattgataatattgctcttagctgtatttctatcaatctga

SEQ ID NO: 2526 - DNA, 141 bp, Staphylococcus epidermidis
gtcatcatattatatgacactcatctttttgggaggtgtagtataatgacgtggtggcaagatggaatcattacattaattaccggtggcatactcattgtctttcgtatttggttggaaataaaatggaaaggcaaatag

SEQ ID NO: 2527 - DNA, 948 bp, Staphylococcus epidermidis
ttgaaaatattaaataaaaagaggttgatagatatgaaatttactgaaagcgaacgtcttcagcaactttctaatgaatatattttgggaggtgtgaattcaccttcaaggtcgtataaagcagtaggtggtggggcaccagtagtaatgaaagaaggtcatggcgcttacttatatgatgtagatggtaataaatatatcgactatctacaagcttatggtccaataataactggtcatgcacacccacatatcaccgaagctatccaagatcaagcagcaaaaggcgtactttatggtacccctactgaattagaaataaatttctcaaaaaaacttagagaagcagttccttctttagaaaagattcgtttcgtgaactctggtactgaagcagttatgacaacaattagagttgctcgtgcttatactaaaagaaacaaaatcattaagtttgcaggctcttatcatggtcattctgatttagttttagtggcagctggaagtggaccttctcaacttggttctccagattctgctggtgtcccccaaagtgttgcacaagaggttattacagtaccgtttaatgatatagaatcatatagagaagctattgattattggaaagacgacattgctgcagtattagtagagccgattgtgggtaattttgggatggtcatgccacaaccaggtttcttagaagaagtatataaaatttctcatgataatggaacattagttatctatgatgaagttatcactgctttttcgttccattatggtgcagctcaagatttattaggtgttaaaccatacctcactgcttttggtaagattgttggcggtggtttaccaattggaggctatggtggtcgacaagatattatggagcacgttgcaccatttacgtccagccttatccagcaaggaacaatgggcgggtaa

SEQ ID NO: 2528 - DNA, 177 bp, Staphylococcus epidermidis
atatattcattaagttattcaaatttcaacttttaccttaaaaaaagtaaagagtttgttacatatcatatactgattcctaatataataattaaaattaatcttttgagatttcaaatttatatatttcatcactgtatgtacttaatacttttttacaaattttgtgtacaataa

SEQ ID NO: 2529 - DNA, 180 bp, Staphylococcus epidermidis
cctcagccattggagaacgacatatattaccgagacatacaaatgctacatgtatcattagtatcactccaaactatgtatttatatgcccattttatatactatctaaacaataagaaagtacttaacctcacattctatcaaagtttaacaaactatgataatttgatagaatattga

SEQ ID NO: 2530 - DNA, 1422 bp, Staphylococcus epidermidis
aagaagaaattagcgttttatattctaggctgtatgaggatatttaaaataatggacaataaaattgaaaagattctagaagatattaataaattacaaggctataaagtaacatatcaatatgctactgctataaatataaaagataataacatgaacccttggtttgaaaaaattgaggaaattctattgaatgtaaaaggagttatacgcattttatctcctgacaaccccccggtaaattatgattattggattttacctggaagatataaaagacatacaaaagaatatcacgaaaaactagaaaaatttttagaaaaatttgctactaatgcaaatattaatgatggattgtttgatcaaaataatatacatggatacaaatataaaaaatatatattcactccacatattgaaattactcatgagaacactttgaatttattttttttaaccttaactatatttaacaatggtacatttgttatagaaatcattgaagacttagagagtataaactttggaagcgacttgtatagtactttctcatgtgtaaaagataagatatatcctctaattaatcaagaaaaaaataatagacaaagacagtatcaattttatggtaatagacattgtaaaaatattagagatgtttctagacaaattaatagaattataaaaattaatagtaaggatatttttgaatataaagtatctaaaaatatgggttttgaagtttattatttagctaatgaaaatgaatttactgatgatcctttctatgaggacgtgaagattcaagagtggttagtaaatgcgcctattttttcatttgaaggaaaaagtaaacattttaggcaagatggttatagcgataattatataaacttcttgaataaagcatctgtttttgtagtttggatggatgagcaagaagaagatgttttagaaaaatgttctcaaatggcactttatttcaatagttctgctaatttctttttcttagaaactatgttaaatgaattacaattgtatgggtatcaacaatataatttaaatggaaaaaaagaagccctatattttagacaatggatactaaatttcaagagatctattgcaattatttatagaacagagcttttacctagtttatatttatatttgtatctaaagaataataatgattttaaatctccacaatatattgaagaattaaacaaagaagaattatcactaattgaattggagcagtcatataaggaagaagaaagaagcgaaaaattaaataaacttttgttaataataagtcttttatcaattttccaagtagtagaaatttttttcagtgataaaaataatatatttaatatcagtatgatacttataatgattttgctagaagtatttcgaaaaaggtaa

SEQ ID NO: 2531 - DNA, 975 bp, Staphylococcus epidermidis
gtatatgaatttgagggattaactatgagaaaacgtgcaagaattatatataatccaacatcaggaaaagaactttttaaacgtgtattaccagatgcactgattaaacttgagaaggcaggttatgaaacgagtgcatatgcaactgaaaaaattggtgatgctacttttgaagctgaaagagcactagaaagtgaatatgatttactcattgcagctggaggtgacggtacgttaaatgaggtggtcaacggaatcgccgaacaacccaatcggcctaaattaggtgtaataccaatgggcaccgttaatgactttggaagagcacttcatttaccaagcgatataatgggggcgattgatgtaatcattgatggtcacacaaccaaggtagatattggaaagatgaataatcgttatttcattaacctagctgcaggggggaaactaacacaagtatcttatgaaacaccaagtaagttgaaatcaattgtaggaccgttcgcgtattacattaaaggattcgaaatgttacctcaaatgaaagcagtagatgtacgtatcgaatatgatgataacatcttccaaggagaagctttactattccttttaggtttaacgaattcaatggctggctttgaaaaattagttccagatgcgaagcttgacgacggttatttcacgttaattattgtagaaaaagcaaatcttgctgaattgggtcatattatgacactagcgtctcgaggtgagcatacaaaacatcctaaagtcatttatgctaaagcgaagtctattaatatttcatcatttactgatatgcaacttaatgttgatggtgaatacggtgggaaattacctgcaaatttccttaatttagaacagcacatagaaatttttacacctaaagatgtatttaacgaagaactattagaaaatgatacgataactgatattacgcctgataagcaataa

SEQ ID NO: 2532 - DNA, 126 bp, Staphylococcus epidermidis
gcatttccttctaaaacgctaaagaaaatgtggaaagtgggatgtgttgagatgaaaaaacaatgtcttctatatttatacgtagcacctttagatatacatttaggaaacgttaatgttcattaa

SEQ ID NO: 2533 - DNA, 237 bp, Staphylococcus epidermidis
ggaggtatatcaatggtacacgaattaggaacagtaggaatggtttgtccatttcctttaatagaagcacaaaagaaaatgaatcaattaaatcaaggggatgaattgaaaatcgattttgattgcacccaggctactgaagcattgcctaattgggctgcagaaaatggatatccagttacaaactatgagcaacttgatgatgcatcatggacgattactattcaaaaagcataa

SEQ ID NO: 2534 - DNA, 300 bp, Staphylococcus epidermidis; identical to SEQ ID NO: 8

SEQ ID NO: 2535 - DNA, 144 bp, Staphylococcus epidermidis
cgatattgtacatcaccatgtttgttagtaaatttctcatgccacattttatctctcctaaataaaaagggtagaagtgctacccattacattattcgttatttaattcattatattcgtctactaatttgttataatcactga

SEQ ID NO: 2536 - DNA, 465 bp, Staphylococcus epidermidis
aaattgataactattcacaatttaaatgaaatggataaatttgctcaaatacttgtaaaacatttaagtgctaaggacttgattttattaaatggtgacctaggagcagggaaaactacattaacgcaatttataggaaaagcgttaggtgttaaaagaacgataaactcaccaacatttaatataatcaaatcttataaaggttctagcatacgattacatcatatggactgttatcgactagaaggtgaggaagatgatttaggtttcgatgaatattttgaagacaatgctatcatagttatagagtggagtaaatttatcaaagatttccttcctcctaatcacttaacgattaatataagtgtcaaaaatgcgaatgagagacaagtatccattgaaacacatgggcaacattatgcattagtaaaggaggcaattttgaatgaactatcttctaattga

SEQ ID NO: 2537 - DNA, 249 bp, Staphylococcus epidermidis
aatggagggttactaatggaacgaacaattcattttacattagttgatcaagtgagtactttgaacagaattactagcgccttcgttcgcttacaatgtaatattgatgaacttcatgttaaacattcagacaaagaaggaatttctaatatgaaacttaaagtcaatattaaagatgatgatacttttaaaattgttcttaaaaaactatcacaacaagtaaatgtactaagtgttaaaagtgaataa

SEQ ID NO: 2538 - DNA, 294 bp, Staphylococcus epidermidis; identical to SEQ ID NO: 2374

SEQ ID NO: 2539 - DNA, 1275 bp, Staphylococcus epidermidis
aagacagtgacagtaagaactaaagtttcgacaaaagatatagatgaagcatatttacgtctgaaaaatatagtaaaagaaactcccttacaattcgaccattacttatctcaaaaatataattgtaatgtttatttaaaaagagaagatttacagtgggtacgatcctttaaattaagaggagcttataatgctatttcagtattatccaatgaagaaaaaaataaaggtattacttgcgcaagtgctggaaatcatgctcaaggtgttgcttatactgcaaaaaaactcaatttaaaagctgttattttcatgccagtaactacaccacgacaaaaaatcaatcaagtcaaattcttcggggatagtaacgtagaaatagtattaattggcgatacatttgatcactgcttagcacaagctttaaactatacgaagcaacataaaatgaattttattgacccatttaataatgtatatactattgcaggacaaggtactttagctaaggaaatattaaatcaagctgaaaaagaggataaaacatttgattatgtatttgctgctataggtggtggcggtcttatttcaggagtgagcacatattttaaagcacattccccccacactaaaattattggtgttgaaccaaccggtgccagtagtatgtatcaatcagtcgttatcaaccatagtatagttactttagaaaatattgataagtttgttgatggagcttcagtagcaagagttggtgatattacctttgatattgcgaaagataaagtggacgattatgttcaagttgacgaaggagctgtttgctccacaattctggatatgtactctaaacaagcgattgttgctgaaccagctggtgctttaagtgtaagtgccttagaacaatataaaaagcagattgaaaataaaactattgtatgcatagtaagtggaggcaacaatgatattaatcgaatgaaagaaattgaggagcgttcccttctatttgaagaaatgaaacattactttattttaaatttcccacaaagacctggtgctttaagagaatttgttaatgatgtcctcggacctcaagacgatattacaaaatttgaatatttaaagaaaacatcacaaaacactggaactgttattataggtatacagctgaaacatcatgatgatctcattcagttaaaagatcgtgtatgtcaatttgatccttctaatatttatatcaatgaaaataaaatgttatattcattacttatttaa

SEQ ID NO: 2540 - DNA, 141 bp, Staphylococcus epidermidis
ataaattatttcataaatgaatatcgtaaacaattgaaaatagaaaataagttgtcaatagggaacgtgcgtacttatcaacaaaatgtgagtaagttgtgggtaagtagtgaagttgtttgtggatatgtaaataaataa

SEQ ID NO: 2541 - DNA, 522 bp, Staphylococcus epidermidis; identical to SEQ ID NO: 1486

SEQ ID NO: 2542 - DNA, 315 bp, Staphylococcus epidermidis
gttgatatttattgtaatgggagattgaaacaaatgactcaagaaataaattgtaatttcaaatcacatatccccagaataatgacagttcccggtatattgttaatacatgaaaataagttggagtttaaggcatatagtcaaaacaataatccattcaatatacaattcgaactctctagcattgtgcggtatagaacatctaaagggttattaggaaataaattgtttatttattattctgatcaggagtggtataaatttagtaacttatctaagagtgacttaaacaaactcacaaaatatttatattaa

SEQ ID NO: 2543 - DNA, 417 bp, Staphylococcus epidermidis
ggagttacatataaaatgaaaaagatttttatattattattgagcagtttattagttctagctgcatgtgggaagaactatgaaatcagtgatattacaaacaaatttaaaaaagaaggtttaagtgtcgaaaacttacgaaaaatgaaacgtgaagattttggtatggcaccaatgaaaactgaaaatgctaaaatatttactgtttcagatgataagaatgcacgaatcttaaaatttaaaaatgaagatgacctaaaagaaatgaaaaagtattatgaagaattaggtaaatcaagtgcagcgttctattctcatgtatacactaaagatagattcttaattcaaatgaatggcgatattgacgatcatttatttgaaaaatataaaaaggctatgaatgaggcattagattaa

SEQ ID NO: 2544 - DNA, 156 bp, Staphylococcus epidermidis
atgaactatcttctaattgatacgtcaaaccaacctttatcagttgctattatgaaagataatgaagtgattgctgaaaaaacaactgatatcaaaaagaatcattcagtgcaactcatgcctgaaatagcagaattcttacagaaagtaaaataa

SEQ ID NO: 2545 - DNA, 150 bp, Staphylococcus epidermidis; identical to SEQ ID NO: 39

SEQ ID NO: 2546 - DNA, 1869 bp, Staphylococcus epidermidis
acctaccaacaactcaacaagctattatcattttattatactcgtaaggactcgaactttagaaaagttttaacttctaaatgtttaagtcctatttctagttggatgggacttaacaacgtcccaatattcattgggacgtttttttattttctaaataattatatgggggaacgatatatgcgaagtgatatgatcaaaaaaggagatcaccaagctcctgcaagaagtcttttacatgcgactggcgcttttaaacaacctacagatatgaataaacctttcgtagcaatttgtaactcttatattgatattgttcctgggcacgttcatttaagagaattagcagatatcgcaaaggaagctattagagaagcaggtgctatcccattcgaatttaatactattggtgttgacgatggaatagctatgggacatattggcatgagatattccttaccttcaagagaaattatcgcagatgcagctgaaacagttattaacgcacattggtttgatggtgtattttacattcctaattgcgataaaattacgccaggaatgttactcgcagctgttagaacaaatgtaccagctatcttttgctcaggaggcccaatgaaagcaggtctttccgctcaaggtaaggctttgacattatcttcaatgtttgaagcggttggagcttttaaagaaggaacaatctcaaaagaagcatttttagacatggagcaaaacgcttgtcctacatgtggttcatgcgccggtatgtttaccgcaaactcaatgaactgtttaatggaagttttaggtttagccctaccatataatggtacagctctagctgtgagtgaccaacgtcgtgaaatgattagacaagctgcattcaggttggttgaaaatattaaaaatgatattaaacctcgcgatattatcacacaagatgcgattgatgatgcttttgctcttgatatggccatgggaggttctactaatactgttcttcatactcttgcaattgcaaatgaagcaggtattgactacgatttagaacgtattaatgaaattgctaaaaaaacaccttacctttctaaaattgcacctagttcttcttattctatgcacgatgttcatgaagcaggtggcgtcccagctattataaatgaattgatgaaaaaggatggtactttacatccggatagattaacagttacgggtaaaaccttgagagaaaataatgaaggtaaaaacatcaaaaattttgaagttattcatcctcttgaaaacccttatgataagcaaggtggattatctgttttattcggaaacctcgcacctaaaggagcggtaatcaaggtcggtggagttgatccttcaattaaagtatttacaggaaaggcaatttgtttcaattctcatgatgaagctgttgaagccattgataatcatacagttagagaaggacatgttgttgttattagatatgagggacctaagggaggtcctggaatgccagaaatgctagcccctacgtcttccatagtgggcagaggattaggtaaagatgttgcattaattacggacggtagattttcgggagcaactagaggtattgcagttggacatatttcacctgaagccgcttcaggtggacccattggcttaataagagatggtgataaaattacgattgatttaatcaatagaactctaaacgtagatcaatctgaagaagaactatatcgccgtaaaaatcagcttgaaccattcagagcaaaggttaaaacaggctacttagctagatatactagtttagtcacaagcgctaatactggaggtattatgcaagttccggaaaaccttatttaa

SEQ ID NO: 2547 - DNA, 135 bp, Staphylococcus epidermidis
attactacgcattacgcagtttcctatcgatatttatcagcgtgctcaacaaaatattcgaaacctctagaattaattagtttaatatttataaaaaagttaagcgcctatctaaaagtagttactcttagatag

SEQ ID NO: 2548 - DNA, 1755 bp, Staphylococcus epidermidis
gagatgattaaaatgtcaaatcaaaaatcaatggtttcgcctcacccttctgaacatcaaacaaaggaatcacaacccttaataacacgcagtggttcacaattattagttgaagcacttcagcaggaagatgtagattttatcttcggttatcccggtggagctgtcttacctttatacgatacattttatgacgggaaaatcaaacatattcttgctcgtcatgaacaaggtgctacacatgctgctgaaggatatgcgcgtgtctctggtaaaacaggagtcgttgttgtgacaagtggacccggtgcaacaaatgccattacaggtattactgatgcatatagcgactctttaccattagtcgtttttactggtcaagttgctacacctggtattggtaaagatgctttccaagaagctgatttactctcgatgaccacacctattacaaaacacaattatcaagttaaaaagattgaagacattccaagaattgttcatgaagcctttcatttagcgaacactggaagaaaaggtcctgtagtgattgatttccctaaagatatgggtgtgcttaaaactgatgttgaacttacaaaagatattaatattcctggttatgaagttaatagtagcccaaataaagaggatattaataagttaatatatatgattaaagaagctaagaaacctcttattcttgcaggtgctggtattaatcactctaaatctaatcatttattaacagaatttgtgacaagacatcaaatccctacagtcacaactctcctaggacttggagcagtaccttatcatcaccctttattcttaggtatggggggtatgcatggatcttatgcaagtaatatggctttaacaaattgtgatttacttatcaatttaggtagtcgattcgatgatcgtcttgcaagtaagcctgatgcgttcgcaccaaatgcaaaggttgtacatgtagatatcgacccttctgaaataaataaagttattaatacagatttaggtatagtcgctgattgcaagcatgtgcttgaaaacttatgccatgagcaagttttaacatcctcccacgaagaatggaacgattattgtattaataacaaaagtaactatccatttaaatatgatgaaaatgataaaaccttttgcaaaccacaaaaagcgattgaatatattggtaaagttaccaatggaaatgcaattgttacaactgacgtaggacaacaccaaatgtggacagcacaattctatccatttaaaaattatggacaatgggtaacaagtggtggtttaggtactatgggatttggaattccatcagcaataggagcacaattagctgaaccggagaaaacagttgtatgttttgtaggagatggcggttttcaaatgacgaaccaagaaatggctttacttccagaatatggacttaacgtcaaaatagtacttattaataacggaactttaggtatggtaaaacaatggcaagataaattctttaataaacgattttctcattctgtatttaacgatcaacctgattttatgaaaatggcggaagcatatggcattaagggattcttgatagattctccagataaattagaatcttcaattgatgaagcatttgcatatcatggaccggcactcattgaagttagaatctcacctatagaaccagttaatccaatggtacctagtggcaaatcaaatcatgaaatggagggttactaa

SEQ ID NO: 2549 - DNA, 570 bp, Staphylococcus epidermidis
ttggaaatcaaaccaatcactatatataccggaaaaactgtaccccttttttatgacaatatagatactgaccaaatcattcccaaagtgcatcttaagcgggtctctaaatcaggctttggaccttttgcttttgatgaatggcgttacttacctgatggtagtgataatcctgattttaatcctaataaacccgaatatcatggtgcgtcaattctaattactggagataactttggttgtggttctagccgtgagcatgccgcgtgggccttaaaagattatggttttaacattattattgcaggaagttttagtgacatcttttacatgaattgtactaaaaacgcaatgttacctatatgtttaaatcagaaagaaagagaacatttagctcaatttgatgaaataactgttgatttacctaatcaaacagtgtctacggtgtctcagtcttttcattttgatatagatgaaacctggaaaaataaattaatccatggcttagacgatattgctattactttacaatttgaaaatttaatagaaaaatacgaaaaaactttttaa

SEQ ID NO: 2550 - DNA, 1119 bp, Staphylococcus epidermidis
gaatttgcaaaatatggtcctttttactataataccttagtatttatatcggaaaaaggtgataaaatggtgtggacaattataagcggactagtcgttggcatattgctaggatttgtaatgcagagaacaagattttgtttagctggtggatttagagatatgtacgttcagaagagtaacaaaatgttttatgcattgcttattgctattacagtccaaagtattggtttacttattctaaagcacttaaatattattgaggttccagcagaaacatttccagttataggaactattttgggatctttcatttttggaatagggatagtattagctggaggatgcgcgactggaacttggtatagggctggtgaagggttaattggaagttgggtggcattgattttttatgcattgacttcagccgtaactaaaactggggtacttcttccaataatgaatcaaataaataaaacgacacaagttaatacgagtatgacgagtacaactggtataccacaatggattctcgtcatgttattaattttaattacagtatttttagttgtaaaaacaattcgcaaacctaaaataatggtaccccaacttaaacaaaaatatagtggtattagacactatctatttgaaaaaagatatcatccatttgttgctggcattgcagtaggttttattgctctacttgcgtggcctatgagtgaatctactgggagaatgggtggcttaggtataacaacaccatctgcaaatcttgtgaattatcttatttcaggagatttaaaatttattgattggggtgtatttttagtactaggtatattcttaggttcttatatagctgcaaaagggtctaaagaatttagatggagattgccagatattaagacaatacgcaatagtgcgataggtggcatatttatggggtttggtgcttcagttgcaggtggttgctctatcggtaatggtctagtagagacagctacaatgagttggcaaggatggattgctttagcctctatgattattggtgtttggtttatgagttattttatttttgtacaacctatgaaaaagttacaacaagtaactcaaagctaa

SEQ ID NO: 2551 - DNA, 960 bp, Staphylococcus epidermidis
ttttttatgaaaaatatatcagatatagcaaaattagctggagtatcgaaaagtactgtttcacgctttttaaataatggatctgtgagtccagcaacgaaagaaaaaataactaaaataatagaagaaaataattatcagccaaatcaatttgcacaaagcttaagagctcgacgtaccaatttgattggagcaattattccgcgtatgaattcatacgctgttgacgaaacgattaagggtttggtacaccaatgtaatcaacatcgatatcagttattattaaattacacaggattagaaatagatggtgaaatttcggcactaaaaacactatcacgtagtaaagttgatggaatcgtgctaatggcaacacatattactgaagcgcatattgaagtcattgagaaaattgatgttcctgtcattatagtaggacaaaaacacgaccgattatatagtatttatcacgatgattatgaagctggatataaaattggagtactcattggtgaaaaaggttgtcgaaatgtacatttctttggtgttagtgaagaagatattgcagttggtattcaacgtaaactgggagttattcaagcgctgaaggactatcacataagtccgaaaatttatgaaacaacatttaagcatgaacaagcttttaaagatgtaagtcagcaacttgaaagagtacatcatgctgatgcgatagtcggagcaactgataccattgcttttgcaatccataaatactgctctgatcatcaacaaaggttttacaattgttcaatatatggatttggtggagaccctatgactcaaatagtatcacctgtcattcaaacggttagctataattactttgaagcaggagagcaagcattaaaagaaattaaccaactattaaaaggtgaacaaacagcattaaaaataaaaattcctatccaattgaattaa

SEQ ID NO: 2552 - DNA, 210 bp, Staphylococcus epidermidis
aagttaatgaataaagttttaggttacaggaaaatgttaggcaagacacaacaacagatggctaaagaattaaatatttcggaacaatcttatagaaacagagagaaaggaaaaatcaattttaagaaaaatgaaatgattaaatttaaaattatgttattggaaaaaggtttaaaagatattacattagatgatattttttttagttaa

SEQ ID NO: 2553 - DNA, 1950 bp, Staphylococcus epidermidis
aaaggtgagaatcgaatgatacttttacaacttaatgacatctccaaatcgttcgatggtgaagatatcttcacagatgttaattttgaggtgaaaactggcgaaagaataggcgtagtaggccgtaatggagctggtaaatcgacattaatgaaaatcatagcaggtgtggaaaattacgatagtggtcatatatcaaaaatcaaaaatttaacaatgagttatttaactcaacaaatgacactcaattcagaagctactgtctttgaagaaatgtctaagccttttgaacatataaagaaaattgaaaatttaattaaggatgaaaccgattggcttgcacgaaatggacaagattataaatctgatgaatatcaatcacatattgaaaaatatgaaactttaacgaatcgttatgagcaattagatggttatcaatatgaaagtaaaattaaaacagtcctgcacggacttaactttacagaaagcgattttaacaaaccaattaatgattttagtggtggtcaaaaaacacgtctttctcttgctcaaatgttacttaaagaacccgatttactacttcttgatgaaccaactaaccatctagacatggaaacaaccaagtggttagaggattacttaaagtactttaaaggggcaattgtaattatcagtcatgatagatattttttagataaaattgtcactcaagtatatgatgttgctctaggaaatgtaaaacactatgtaggaaactatgagcaatttataaagcaacgtaatcagtattacgaaaaacgcatgcaagaatttgaaaagcaacaagaagaaatcaagcgtttagaaacctttgtagaaaaaaatattactcgtgcatctacaagtggcatggctaagagtagacgtaaaacattggaaaaaatggaacgtattgataaacctatgatagatgctagaagtgcaaatatacaatttggcttcgaccgtaatactggtaatgatgtgatgcacattcatgatttaaaaattggttacgactcacctattacactacctataaacctcgaagtctttaaaggggatcatatagctatcattggtccaaatggtgttggtaaaacaacattgataaaaacaattgctgaaaaacaaaataaactaggtggtcaaattatctttggtgctaatttacaaattggttactatgatcaaaaacaagctgaatttaaatcaaataaaaccattctcgattatgtttgggatcaatatccacacatgaatgaaaaagatgtacgtgcagtattaggacgtttcttgttcgttcaagaagacgtaaaaaaaattatcaatgacttatccggcggtgaaaaagcacgattacaattagcacttttaatgttgcaacgtgataatgttcttatcttagatgaaccgactaaccatttagatattgattctaaagaaatgcttgaacaagcattgaaagattttgaaggcacaattatttttgtatcacatgatcgttattttattaaccaacttgcaaataaagtttttgatttaaatattaatggtggccaaatgtttttgggagattatcagtattatattgagaaaactgaagaagctgcagctatcaaagcacatgaaacagtaactcaaaataattttgaaaataaagagattaatcaagacgcaaatacttcaacctacatcagtcaaaagcaacaaaaaagacaacaacgtaaattagaaagacaaattgaacattgtgaaagacaaatcgaagaattagaagcacaaatatcacatatcgaagaacagttaacacaacctgaagtatttaacgaccctctaaaagctagtaaatttgccaatcaaaaatccgatatcgaacaaaaattagaacaaataatgttggagtgggaaaaattacaagaaaagctctaa

SEQ ID NO: 2554 - DNA, 1386 bp, Staphylococcus epidermidis
gaggaggagaaaattatgggtcaaacactgtttgataaagtatggaaaaaacatgtgcttcatggaaaagaaggtgaaccacaattattatacattgatttacatctcattcatgaagtcacttctcctcaagcatttgaaggacttagaatacaaaatcgtaaactcagaagacctgatctaacctttgcaactttagatcataacgttcccacaattgatatttttaatataaaagatgaaattgcccataaacaaattacaactttacaacaaaatgctaaggactttggtgtacatatttttgatatgggttctgacgaacaaggtattgtacatatggttggaccagaaactggattaactcaaccaggaaaaactattgtatgtggagattcacatactgctacacatggcgcatttggtgctatcgcatttgggataggaacaagcgaggttgaacatgtatttgctacacaaacattatggcaaacaaaacctaaaaatttgaaaattaatataaatggttctttaccaactggagtttatgctaaagacattattttatatttaatcaatcaatatggtgtagatttcggtactggttatgctcttgaatttacaggggaaactataaaaaatttatccatggaagcacgtatgacgatttgtaatatggctattgaagccggagcaaagtatggtttaatgcaaccagatgaaacaacctttgattacgtaaaaggtcgtccttatgctactgattttgatagttctatggcgtggtggaaaaaactttattctgatgatgatgcctattttgataaagttattgaacttgatgtaacaaatttagaacctcaagtaacttggggaactaacccagaaatgggagttagttttagtaatccattcccagaaattaaaaatgcaaatgaccaacgtgcttatgactatatgggacttcacccaggtcaaaaagccgaagatataaaattaggttatgtttttttaggttcatgcacgaatgcaagattatctgatcttattgaagcaagtcatataattaaaggacaacaagtacatccaaatattactgctattgtggttccgggttcaagaactgttaagaaggaagctgaagctctgggactagataaattatttaaagatgctggatttgagtggcgtgaaccaggatgttctatgtgcttaggtatgaatccagatcaagttcctgaaggagtacattgtgcatccacgagtaatcgcaattttgaaggaagacaaggcaaaggcgctcgtacacatttggtatcccctgctatggctgctgctgctgcgattaatggtaaattcattgatgttagaaaggtggtagtataa

SEQ ID NO: 2555 - DNA, 330 bp, Staphylococcus epidermidis
ttaatgaccgacgcaaaactacgcgaaaggagtgtttgtatgccatatgttaatttacaaaatctaccaactaaagcaaatgtagtgactgaacctaatcaagtagtagtaaagccaatcatggcaaaacctaatgttattgctaaactatttggtatttcatacagttcagttaatcgtatattgaaagaatgggagaaagattctaagggtattgatgatttatattactctctatcatcaacgatgacagttatcagtatttctcgatttgaacagtatatgaaaaaacgtcataaagagtcttcaccacgggcatggccccgctca

SEQ ID NO: 2556 - DNA, 1479 bp, Staphylococcus epidermidis
aacatagtggagtggactcgtgaagagagataccaacgtattgaagatgttgatgaaacatatcttgagcaactgaaacaccaagtggatacatctttatatagacaaacatttcatattcaacctgaaatgggtttattgaatgatccaaacggactcatttattataatggacactactatatttcacatcaatggtttccgttaggtgctgtgcacggtttaaaatattggtttaattataaaagcaaagatttattacattttgaaccacaaggaacacttcttaaacctgatactaagtatgatagtcacggcgtatacagtggaagtgcttttgaatatcaaaatcatctttattatatgtatacaggcaatcatcgtgaccaacattggaatagaatttccagtcaaatgattgccagaatgaacaaagacggaaaaatagagaagtttcctaaacctgtgattcatggacaacctgaagggtatacaagtcatttcagggatccaaaggtatttgaaaaaaatagtcaactgtacgctattctaggtgctcaaaatgaaaatgagatggggcgtttacttttatatcgtagtcaagatgttgttgattggcattttgaaggtgagattaaaaccaatctgacacaatttggttatatgtgggagtgtcctgattattttagactaagcaataaagatgtcatactcatgtgtccacaaggcgttgaagctgaaggagataaatttagaaatatctatcaatcagggtatatgataggagatttaaactttaataatctattttttgaccatgaaagttttcaagaattggataatggttttgatttctacgcgccacaaacgtttgttgatgcagacgggcaacgcattttaattggatggatgggactaccagatacagagtatcctacagataaagaggggtgggcacattgccttactattcctcgagtgcttaccattgaaaatggaaaacttaagcagcgaccttttaagcagttagaagatttaagaacaaataaagaaacagctttgggatatgctaataaatttaaacgtaaattacatccatatgaaggtaaacagtatgagatgattatagatatattagaaaatgatgcttcagaaatatattttgaattgcgtagctctcgatctgaatctacactgattacttataataaacacgaaaataaactcactttagatcgtaccgatagtgggacactaccatcaaatgtcgatggaacaacacgttctaccattttagattcaccattaaaacagttacaaatttttgtggatacatctagcatcgaaatattttgtaatgatggtgagcgtgttttaacctcacgtattttcccaaatgaggatgctactggtataaaagcttcgactgaatctggtcaagtatatttaaaattcactaaatatgaattaaaagggtga

SEQ ID NO: 2557 - DNA, 1254 bp, Staphylococcus epidermidis
tgggtagcacttctaccctttttatttaggagagataaaatgtggcatgagaaatttactaacaaacatggtgatgtacaatatcgctattatgagaagtataaagatccactcacaaacaaatggcgacgtgttagcgtggtacttaataagaatggtaagcaatcacaaaaagaggctcagaaactcttaaataagcgtatagaggcgaagataaacgacaagacgccaattgacttaaaaacacttactttccatcaagcatgtgacgaatggctagatagatacataaaaacatcaggttcaaaacaatctacaattaaaactaaaaaatacaaaatcaagcatatcaaacgcaatataaattcagatattctagtcaaaaatatgaatagcgatgttgttcaaaagtcagtagacaatgctgttaaagataatctaagtcataaagttgttaaagatgctatgagcatcataagaaacattatgaagtacattcagcgcaaatataaacttacagatattagttatttagatgatattgttattcccaaaaaggctactacaagagaagaagtaaaagctaagcgtgaaaattatcttgaaatggatgaagtaaaagcaattgtagacaatttacatgaaatagctaattcaaagcgtgctgattatatgaaacgttctttcatcatgactgcttatattatggaatttcaagcacttaacggtatgcgtataggtgaattactagccatacaacctaataacattgatttcgacaaaaagacactagaaatagatggcactattcattggcgtaatgaaggtaacgcagtaggttttaaagatacaactaaaactgaatcatcttatagaacaatctctttaactacacgtagttgcgatatattaagaaaagttatgttagaaaacaaaaaggctattcaatgggaatctatgtatcaagatagaggcttcatattcactaactatcgtggcaatcctatgtcacttagcaccattaatagaaatatgcaacaatctgcaaacaatgtaggaattacaaagcacataacaagccatactatgcgtcatagccatatatctttattatcacaattaggcatatcacttaaagccattatgcaacgtgtaggacatacagaccataaaacgaccttgcagatatacagtcatgtaactgatcaaatggataaagatatgatgaataaattagaaaaggtaggtaactaa

SEQ ID NO: 2558 - DNA, 165 bp, Staphylococcus epidermidis; identical to SEQ ID NO: 88

SEQ ID NO: 2559 - DNA, 177 bp, Staphylococcus epidermidis
caacttattttctattttcaattgtttacgatattcatttatgaaataatttatttagaaagaaaaaggagaactaaacttcatgacgaacaatcaaaccttagtactaattatattaactttcatcatcctaattacacttgtaaatgtaattatctctattatagagagacgtaa

SEQ ID NO: 2560 - DNA, 546 bp, Staphylococcus epidermidis
aggagaatccgtatgaaaagattattaggaacattatttgcagctacacttgtattaagtgcttgtagccaagatgacactaaagaagatgaacataaaaaatcagaaaacactgctgaaaggaaagctgacgataaaaaagataagaaaactaaagaagataaaaaatctaaaaaagaaaagaaatctcaagaaaatgaagataataagtctacacaagaagataattctactgataatcaagaaacacaagatcctgcaactcaagggcaaaaacaaactcaacaagataatcaacaaaactatgatgaccaacaatcttaccacgaaccaacaaaagatgaggtatatgagtgggataaacaaaatatacctggaggtacagattatggtttgattgatccagaagatgtaaatacagaatcagaagataatgctcgacaaaatagaatagatgaaattaacgaagaaatggaagatcctaatatttccgtcagtgattataacaaattagtagacgaatataatgaattaaataacgaataa

SEQ ID NO: 2561 - DNA, 159 bp, Staphylococcus epidermidis
gatttttttagtttgaaagataatattgcatttaaaatcataaaagtaagacatattaatataccttttgaaggaattaaaaaaatgaatgcgaccccgataaatggtaacaacggacaaaacattaataaaatatttcgcttagtgggtaacatttga

SEQ ID NO: 2562 - DNA, 207 bp, Staphylococcus epidermidis; identical to SEQ ID NO: 94

SEQ ID NO: 2563 - DNA, 1065 bp, Staphylococcus epidermidis
gttgaaagaaggtatacgtacatgagttataaaatagttgccttacctggagatggtataggaccagagattctatctggtacattagaacttttaaaattaataagtgaaaaatatcattttgaataccatttagaaagtcatcattttggaggcgtttcaatagattattatggtacacctttaactaatgaaacattacaatcatgtaaaaatgcagatgctattttattaggtgcgattggagggcctaaatggacagacccaaataatcgtccagaacacggtttgttaaaactgagaaaatccttaaatttatttgctaatattcgacgtacatttgtaactaaaggggctagtcatctttcaccactaaaacaagatattgtagaaggcacagatttagttatagtaagagaattaacgagcgggatttattttggtgaaccaagctatgttaaaaaaaccgaagctttagactcattaaaatattcaagtcaagaaattgaacgtattgtgagaatcgcttttaatcttgcaaatcgtagacgtaaaaaattaacttctgttgataaggaaaacgttctatcctccagtaagttatggcgacagatagtaaatgatgtaaaaaaggattatccagaagtagaagttaatcatatgctagttgatgcttgtagcatgcatctgattacccaacctacgcaatttgatgtgattgtaacagagaatcttttcggagatatcttaagtgatgaagcatctgttataccaggctctctaggtctttctccatcagctagttttggtcaaacaggtacacgtctttatgaaccaattcatggttcagcacctgatatagctaatgaagataaagcgaatccatttggtatggttctatctttagcactttgcttaagagaaagtttaaatcaaaatgatgctgctaacgaacttgagtcaattgtttactcatttattcaatctaataagacaactgcagatttaggtggacaatatcgaacttcagaaatttttaaattgcttaaagaaaaatatctataa

SEQ ID NO: 2564 - DNA, 966 bp, Staphylococcus epidermidis
tttataatgagacgtctatttgctattggagaggcattaattgatttcataccaaacgtaacacattcaaaattaaaagatgttgaacaatttagtcgacaagttggtggcgcaccgtgtaacgtagcggctacagtaagtaaattaggtggaaaatcagaaatgataacacaactaggaaatgatgcgtttggtgatatcattgtagaaacaattgaacaacttggcgtaggtacgcaatatattaagcgaactaataaagcaaatactgcattggcatttgtcagccttcaagatgatggtcaaagagatttctcattttatcgtaaaccttctacagatatgttatatcaacctgaaaatattgatgatattcaaatattccaagacgatattttacatttttgttctgtagatttaattgagagtgacatgaaaaatgcccatgagaaaatgattgaaaaattcgagtcagtaggtggtactattgtttttgaccctaatgtacgcttacctttatgggaagataaactcgaatgtcaacgtacaataaatgcgttcatacctaaagcacatattgttaaaatatctgatgaagaattattgtttattactggtaagaagaatgaagatgaagcgattcaatctttatttaggggtcaagttaatgtagtgatttatacacaaggagcgcaaggtgcaactatttataccaaagatgattatcgtattcatcatgaggggtatcaagtacaagcaattgatacaactggtgctggtgacgcatttataggtgctattatttattgcatactcgagtctcggcattctgaatgtaaagatttatttaaggaaaaggggaaagatatactagcgtttagtaatcgtgtcgcagcacttacaacaacgaaacatggtgctattgaaagtttgccgacaaaagaagatataaaagactattattga

SEQ ID NO: 2565 - DNA, 849 bp, Staphylococcus epidermidis
ttttgcgtcggtttacgtaagttttttgtgcattataatcattttaggaggaaaatgatggatatcgataagttagaagtaggaaaaaggattaaaaatattcgtttaaataaaagtaaaaatctaagagaatttggagaattaatatctaaaaatcttaaagaagataaaaatatatcagatagtatagttagtagatgggaaaaaggtgtatctattcctagtgcaaaacgcttaaaagaaatagctgatataggtaatgtgtctgtaaattatttattatatggagttaaagtaacttataaagatattcataataatattaatactgtaagtatgaaaaatgaaattatggacaacctcgaaaaatttttaaagtattatttactgtattctgaatacaataattactctataaaaaccgctgaattattagatttgttatttgaaaatgctggttacgatatcactactttaacaaaagatttatgcgccttagtgtctgataaaagattttcattttatcaacatggagtgtatttgttacttaatgaagatttttctaagttacatgttcaactttatctttctgagtttatttataatttattagtacaaatcactttagattatcctaatatttatattaagaatttggtattacaaattacagaaactaaagaaagaattaaagatatatcccataaaaaagacgcatatactgaatttgaaatagagacccatttagcagattttataaatcataaagaatacaaaaaactcctagataacttaagtcaattagagaaaaaaattacaaatgataattcattgatcgataataattag

SEQ ID NO: 2566 - DNA, 1641 bp, Staphylococcus epidermidis
aaagaaaaaggagaactaaacttcatgacgaacaatcaaaccttagtactaattatattaactttcatcatcctaattacacttgtaaatgtaattatctctattatagagagacgtaaacagattgctaaaataaatactttatgggataacaaattaaaattagaaagttttatacgtcctaattcacgattcgatgcccaatatcacgcttaccgtgatcattacaatgagcagtcatttatcgacgataagacttggtcagacctaaatatggatacgttatttcataaaattaattttaatttcactgcaattggtgaaatgcgactatatgcaactttaagaggtatgtttaaggtaaatcaaacctcattgataaacaagtttaaagataataaagtatttcgtttaaatgtatcttacattctttctaaaattggtaaaaatgtataccctttatttccagatcaaatgttacccactaagcgaaatattttattaatgttttgtccgttgttaccatttatcggggtcgcattcatttttttaattccttcaaaaggtatattaatatgtcttacttttatgattttaaatgcaatattatctttcaaactaaaaaaatcttatgaccaagatttaaaatcaattttttatactgctaatgttataaagcaaagtcaagctttaagtaagattgagagcacgcccgcgataagtgttgattttactcattttaaagcttcacgccgttttagtggtttattagttagagtagaatcacaagatatggcgagtagcataatcatgtttattaaattagtattcatgatagattattttttatttcatttaatacaacgcagctactttaagtatcaagaagaagttatggcatgttatgactatataagcatattagataatcattactctatagctatgtatcaacatactttgacacattattgttatcctaaaatcaatcacaatattaatgggcttcaaatgaaatcaatcattcatcctctactagatgaagaaaatgcgattgctaacacaattgacatttcaaatcatatattactcacaggctctaatgcatcaggaaaatctacatttatgaaagcagttgcactaaatttgattttagctcaatcgatacaaactgcaacagctcactcatttatttatcaacctggctatgtaatgacatcaatggcaaatgcggatgacgttttaagtggtgacagttatttcatgtcagaacttaagtctattcgtagattatttaacactcatcagtgcaataagatatattgttttatagatgaaatttttaaaggaacgaatacaactgaacgtattgcggcttctgaatcagttttatcgtatttagataatcaaaaagcatatcaggttatcgctgcgacacatgatgttgaattatcaacattattagaaaatacatataataattatcattttaatgaatctattcaagaaaatagcatatttttcgattacaaaattaaacctggtaaagccaatacacgtaatgcaattgaattactacgcattacgcagtttcctatcgatatttatcagcgtgctcaacaaaatattcgaaacctctag

SEQ ID NO: 2567 - DNA, 483 bp, Staphylococcus epidermidis
attatcagaggcggaacgaaattggttaaaccaacaagagaacaattgaatattaggaaaatgagtgtggaagatgttcctaaagtttttgatatagaaagaaatagtttctcacacagttcgtggtcaattgatgcattttatcatgaaatagaaaacaacgaatttgctacatattttgttatagaatttagtgacaaaataattggatatgttggtttatggttagtcgttgatcaagcacaaattacaacgatagctatatcaaaggcatttagaggctatggtcttggtcaacttttacttaaatatgcaatgaactatgcacgtttttcttgtgatgtgatgagtttagaggtaagaatagataatgatgttgcacaacatgtttataggaatttgggattccaaaatggtggcaaaagaaagaattattatggagaaggcgaggacgcattagtcatgtgggtgaatttgaaatga

SEQ ID NO: 2568 - DNA, 135 bp, Staphylococcus epidermidis; identical to SEQ ID NO: 117

SEQ ID NO: 2569 - DNA, 1314 bp, Staphylococcus epidermidis
ccttacctaattttgctttttaaaaaaacactcattatgatgtttttaaaggaagtggtaagtatgaatatgaatgatacaatatttctatttttatgtactctattagtatggttaatgacaccaggtttaagccttttttatgggggactcgtacaatcaaaaaatgctttaaatactgtaatgcaaagtatggttgccattgtcattgtcacatttgtatggataataattggtttctctttaagttttgatggaggtaatcaatggataggtggtttgaagtttttgggtcttcatcatgttggttttgaaacttcaaaaactttgagtcctcatatcccgctctcattatttatgttgtttcaaatgatgttttgtacaattgcggtatctattttatcaggttcgattgccgagaaaatgagattcattccttatctgatttttgtgagtttatgggttctattaatttatagccctgttgcccattgggtttggggtggtggttggattagtaaaattggagcaatagattatgcgggtggaacagtagttcatataacatcaggcgtatctggtttggttcttgggataatgataggtataggaaagaagaaagaaaaacatactccccataatctattaattacgcttattggtggtatattagtatggttaggatggtatggatttaatgtaggcagtgcatttacattcgatcacatagccatgatatcgtttgtgaacacagttattggtgcaagtgcaggtgctttcggttggttaatctttgaatatatcttgaaaaagactacaagtttactaggtcttttatctggagcactctctggtcttgtcgctattacaccagcagcaggatacgtcagctatatgagtgctatgattattgcaataattggtggcatatgttgctatatcgttataaatttaattaaagtaaaactccaatataatgatgcacttgatgcatttggtattcatggtgtaggtggtatcttaggagctgtgcttacaggagtttttcaatcacatcaaattaatagtgcggtgcagaatggttttatctatacagctgattttaaagtagtagtgattcaacttggcgcggcaattgcgactgtcgtttttagcgcaatagttacatttttgattgctagatttattaaaatttttactcctttagctacaactcaagaagaagataaaacaggtcttgatgctatagtacacggtgagaaagcatatttctatggagagctaaataagtttaatcgtcatatcaagttttaa

SEQ ID NO: 2570 - DNA, 537 bp, Staphylococcus epidermidis
aatagcagaattcttacagaaagtaaaataaataaaacagaaataactgatatcgtggtagcgaaaggtccaggttcatataccggtcttagaataggggttactgttgctaaaacattagcgtatgcattaaacactaacttatatggtgtctcatcacttaaagcacttgctagcacagtaaaagacagtacgaagttgttagtacccatttttgatgctagaagagaagcagtttatgcaggtgtttatcaatatcaggacaatgaattaataaccattattgatgacacttatatacctatttttgaacttattgaaaaacttcatcaattaaaccaaccatatgtgtttgtaggatatcataccgaaaaaataaaacatttattagacagtgacatcgtagaacagttaccacaagcttcaagtatgaagcaattaattcaaaaaccagaaaatatacattcatttactcctaaatatcataaattatcagaggcggaacgaaattggttaaaccaacaagagaacaattga

SEQ ID NO: 2571 - DNA, 1107 bp, Staphylococcus epidermidis
gaatttgggattccaaaatggtggcaaaagaaagaattattatggagaaggcgaggacgcattagtcatgtgggtgaatttgaaatgacaaataataaattaatcttagcaatagaaacaagttgtgatgaaacgagtgtaagtgtaataaagaatggcactgaactattatctaatactgttttaagtcaaatagatagtcacaaacgttttggtggtgttgtacctgaagttgctagtagacatcatgttgaaggaataacagcaactatagatgaatcgttagtgagtgcaaaagtgaaaatggaagacattgacgctattgcagtaacacaaggcccaggattaataggagctttattaattggtattaatgcggctaaagctttggcatttgcttatgataagcctattattccagtacatcatattgctggtcatatttatgctaatcacttagaacaaccattaacatttccacttatgtcattgattgtatctggtggtcatactgaactggtatatatgaaaaatcatttagatttcgaagtgattggtgaaacgagagatgatgcagtaggagaagcttatgataaagttgctcgaacaatcaatcttccttatcctggtggaccacatattgatcgattagcagctaaaggtaaagatgtatatgattttccaagagtttggctcgaaaaagatagttatgattttagttttagtggtcttaaaagtgctgtaataaataaactgcataatttaagacagaaaaatattgaaattgtagctgaagatgttgcaacgagtttccaaaatagtgttgtagaagttttaacctataaagctattcatgcttgtaaaacctatcatgttaatcgcttaattgttgctggtggtgttgctagtaataaaggattaagaactgcactaagtgaagcatgtaaaaaagagggcatacaccttactattccaagtcctgttctttgcactgataatgcagcgatgattggtgctgctggatattatttatatcaagctggtttgcgtggcgatttagctttaaatggacaaaataatattgatattgaaactttttctgtttaa

SEQ ID NO: 2572 - DNA, 750 bp, Staphylococcus epidermidis
gtattcgttgtagacaattatttgtattatgagatgacattcaacatatgttttaactcatttactgattttaatgatacatgcataatatacgcgaaaaagggggttagatatatgccagatgattttaaaattcctcgcgctacgttaaaacgtctacctttatattaccgatttgtcagtattttgaaaggtaaaggtatagatcgtgttaattctaaaacaataagtgaagcactacaaattgattcagctacaataagaagagacttttcatactttggtgaattaggaaaaaaaggatatggatataatatagatagtatgcttgaattctttaaatcggaattaagtgagagcgatcaaattaaaattgccattataggtatcggtaatttagggcgtgcattacttacatataacttttcaatacatgatgagatgacaattactgaagcttttgatattagaccagatattataggtgagaatatcggtgacgttgtggtaaaacatagcgatgatatcaaaatgacattagaatcagaagatattgatgtagtcattttaacaacaccagataatgtggcacaacaagtagctgatgaacttgttaaagccggtgttaaaggtatactaaactttacgccacgtcgaattaaaacgccccaagatgtccaagtacatcatattgattttggtatagagttacaatcattattgttcttcatgaaaaattatagtaaataa

SEQ ID NO: 2573 - DNA, 171 bp, Staphylococcus epidermidis
tatgaaaaagtaaacatcccgacgaatagaaagcgtttggaactcatgaatttgggagtgagagtaatgaatttagtcgagctacaaggatcaacaagagctgaaaatgaaacaagagggcgagcgcttatctcaagtgaagaaagcttcttagccgagggaataaactga

SEQ ID NO: 2574 - DNA, 1593 bp, Staphylococcus epidermidis
tgccattcattaaatctaaaagtattgaaaaataacaacattagaggggtgtttttaatggaagaacatattcaaatttttgatacaacacttagagatggtgaacaaacgccaggagtcaattttacctttgatgaaagattgaaaattgccaagcaactagaaaaatggggagtagatgtactagaagcaggttttcctgcttctagtactggtagctttaaatcagtagaagctatagctaaaactttgactacaacagcagtgtgtggattagctagatgtaaaaaatctgatattgatgctgtatatgaagctactaaagaagctataaaacctcaagtacatgtattcattgcaacctcccctattcatttagaacataaattaaaaatgactcaagatgaagttttaacatcgataaaagaacacgtttcttatgcaaaacaattttttgaagtcgtacaattctctccagaggatgcaacaagaactgaaattccatttttaattgaatgtgttcaaactgcgataaacgcaggagccacaattattaacatccctgatacagttggatttagttatcctactgagtatggcgaaatttttaagcaattaacacaggccgttaagtcaaattctaaaattatctttagtgcacattgtcatgatgatcttggtatggcagttgctaatagtttagcagctattgaaggtggagctagacgtattgaaggtaccgtgaacggtattggtgaaagagcaggaaatgcctcacttgaagaagtcgctttggctttatatgtaagaaaggaccactatggtcttgaatctcaaattaaccttaaagaaactaagaaaacatctgacttaatttcaagatatgctggtatccgtgtacctagaaataaagctatagtcggtcaaaatgcatttagtcacgaatccggaattcaccaagacggtgtccttaaacatcgtgaaacctatgaaatcatgacacctcaacttgtaggtgtaaatacaacagaattgccactaggtaaattgtctggtaaacatgcatttgccgaaaagcttaaagctctagggtatgaaattaaattggaagatcaagttacattatttaaacaatttaaagaaattgctgataagaaaaaaaatgtatccgatagagatattcatgcgattatacatggctctgaacatgaacacaatgctatttttcaacttgataacttacaacttcaatacgtatctaaaggtctacaaagtgcagtagtagttataaaggaaagaaacggacaagttaaacaagattcaagtattggaacgggttcaattgttgcaatttataatgctgttgaccgaattttcaagaaagacgcagaattaattgattatcgtattgattctgtaacagaaggtactgatgctcaagcagaagtacatgtacgaatcattattaatcatattgaagtgacaggcataggtatagaccacgatatattaaaagcttcatgtaaagcatatatcgatgctcatgctaaatatatttcagaatatgagttgaaagaaggtatacgtacatga

SEQ ID NO: 2575 - DNA, 192 bp, Staphylococcus epidermidis
ttattttcttctattattttagttattttttctttcgttgctggactcacagatccattatttaaaaagcgtgaaacagtacttttcgatactccagctaattttgctatatctgatatatttttcataaaaaatcacctatcacgtcatcaatcattcttttttattttaccatatgaaccaacgctttaa

SEQ ID NO: 2576 - DNA, 1020 bp, Staphylococcus epidermidis
ctggaggaatttattatgacaaaagtatattacgacgaaacagtaactcaagatgcattacaaggtaaaaaaattgctgtcattggttatggctcacaaggacatgcacatgcacaaaatttaaaggacaatggttatgatgtagtcattggcctgcgtccaggacgatcatttaataaagctaaagaagatggatttgatgtttatacggtaagtgaagcaacacaacaagcagatgtagtgatggtactattgcctgatgaaattcaaggtgaagtatataacaaggaaatcaaaccatatttagaaaaaggaaatgctttagcattcgcacacggttttaatatccacttcagtgttatcgaaccacctagtgatgtcgatgtctttttagtagcacctaaaggacctggtcatttagttagacgtacatttgttgaaggaagtgccgtaccagcattatttggtgttcaacaagatgctacaggccaagctagaaacattgctttaagctacgcaaaaggcattggtgctactcgtgccggggtcattgaaacgacatttaaagaagaaactgaaacagatttattcggtgaacaagctgtactttgtggaggagtttccaaattaattcagagtggattcgaaacacttgtggaagcaggttaccaacctgaattagcttattttgaagtcttacacgaaatgaaattaattgttgatttaatgtatgaaggcggaatggaaaacgtccgttattctatctctaacactgctgaatttggcgactatgtttctggaccaagaataattacacctaatgttaaagaaaatatgaaaaaagtacttgaagatattcaaaatggtaactttagccgtagatttgttgaagataacaaaaatggctttaaagaattctatcaattacgtgaagatcaacatggtcatcaaattgaacaagttggacgtgaattaagagaaatgatgccattcattaaatctaaaagtattgaaaaataa

SEQ ID NO: 2577 - DNA, 684 bp, Staphylococcus epidermidis
atgtctcaatcatctaagcgaaaaaacgattctgtggtagaaacttttaaggacatcattcctttaacatttggagaagagattggtaatgcagcatcacatggtgctgctgcattacttacattatttattcttccatatgcagcagtgcatagttttaacaatggtggcacattagagtcaattagtgtgtcagtttatgtgattagtatttttatgatgttcatatcatcaaccatttatcattcaatgcaaaataatacgtctcataaatatatattaaggattattgaccatagtatgatttatgtggctatttcaggaacatacacacctgttttgttaagtgttgtcggcggttggttaggttggctcgtgacaatattattatggggaacgacattatgggggattttgtataaatcaatagcaactaaagtcaatcatagattaagtctcattgtttatttggtgatgggatgggtaggtatcatatttttacctattattattatgcgaacatcatggtggtttattttctttatatttcttggtgggttatcttatactatcggagcatggttttatgcccaaaaaaataaaccttattttcatatgatttggcatatatttattgttcttgcttctttcttacatatgataggcattttttattttatgtga

SEQ ID NO: 2578 - DNA, 249 bp, Staphylococcus epidermidis
agacttaaatcctatcgctttcatagtgccacctctttaaaattatttaattttattatatcacttcaatttaccacttatagtgcaaacgttttatcgacaagtaaattaatgctttgcttttattcacttgccactttaataacttgtttaccaaaattatcaccagttagcagatttctaaaggcttgcggcactttatcaaaaccatcttctactgaaacttgtgttttaattttattctcttga

SEQ ID NO: 2579 - DNA, 981 bp, Staphylococcus epidermidis
aggggtgaatcgcatatgattaaacaaaacctgaagatgcgctataccattgtcttactgttattaatttttagtacaatctttagtctatgtataggatcagtaatgattaatcctattcatgcagttacaggcttctttttacacaatgactttattttaaatgaatatcgaattcctagaacacttttaggattacttataggcagtagtttagctatttctggctcggtgatacaaggggttataagaaatccacttgcttcacctgatgttattggaataacaaaaggggcaagtttagcagcagtaatgatcataatgatatttccatcagcacctctatttgttcttcctttaggttcatttatcggtgctttgacaataagtattattctttcagttcttatttcaaaatttgatgtaaagggatcaaaattagcattgataggtttagcgataggtgcaatttgtacggccattgtccaattcttgcttatacgtaatcctcttgatgcaaataatgcgttattatggttgactggtagtttatacggtcataatatagtcaatttttatagtttattaccatggtttattatcactgtacctatagtattgttattagggtatcaacttgatattttaaatttaggtgatcatgtagccattgcactaggagcacgtgtaaaaatcttaaaaatgattttacttgtattagcagtaatgttagcaggtgcttccattgcggtagtagggggtattagttttttaggtcttatagcacctcatattgcacgtcaacttgtcggccataaaaatatacatgttataatcatgtcaggtttggtaggagcaatattattaacttttggtgatggtttagcaagaggtatacaacctcctcttgatattcctgtaggtgttgtaatagcaattataggcgcaccttatttcttatttttattacgtaagatgtag

SEQ ID NO: 2580 - DNA, 1008 bp, Staphylococcus epidermidis
ggagtggaatcagtgagaggtttaaaaattttaagtgtaattggcttattgtttgttttaattgcaactgcagcatgtggaaataatagttcaagtaactcaagtaaagagtcatcaaaagatggagttgaaatcaagcacgaagaaggtactacgaaagtacctaaacaccctaaacgtgttgttgttcttgagtattcatttgttgatgcgttagttgctttagatgttaaacctgttgggatagcggatgataacaaaaaaaatcgtattattaaaccattaagagataaaattggaaaatacacttctgtaggaacacgtaagcaacctaacttagaagaaatcagtaaacttaaaccagatttaattattgctgataataatagacacaaaggtatttataaagacttaaataaaattgctcctacgattgaactgaaaagtttcgatggagattataatgaaaatattgatgcttttaaaacaatttcaaaagctttaggtaaagaagaagaaggtaaaaaacgcttagaagaacacgataagaaaattgaagaatataaaaaagaaataactatggataaaaatcaaaaggtattgcctgcagtagctgctaaatcaggtttgcttgctcatccaagcaactcttatgttggtcaattcctaagtcaactaggttttaaagaagcattaagtgatgatgttactaaaggtttaagtaagtatcttaaaggaccttacttacaaatgaacactgaaactttatctcaagtgaatcctgagcgtatgttcataatgacaaacaaagcaagttctaacgaaccttcactaaaagaactagaaaaagatcctgtatggaagaaattaaacgctgtgaaaaatcaacgtgttgatattttagaccgtgacttatgggcaagatcacgtggtttaatttcttcagaagaaatggcaaaagaacttgttgaattatctaagaaagatagtaaaaaagataataagtaa

SEQ ID NO: 2581 - DNA, 123 bp, Staphylococcus epidermidis
attcaaaatccctactcatgctccaaaatcaaacacgtcaaatccgtagaatttcttgatgaaactttcttaattttagggcatagcatagtattgaaaaagcttgaatatgatgctttttaa

SEQ ID NO: 2582 - DNA, 945 bp, Staphylococcus epidermidis
ggaagatgtccaatgattttaacattaactttaaatccctcagttgatatatcttatcctttagatcagtttaatttagatactgttaatagggtatctcaaacaagcaaaacagcaggcggtaaaggattaaatgttactagagtattgtctgaatttggtgaagacgtaatagcaagtggttttttaggtggagcattaggtcaatatattgaagaacaaatagaaactactcgtattaaacaagcatttttcaaaatcaaaggcgaaacacgaaattgtattgcaatactacatgaaggacaacaaactgaaatccttgaaaagggtcccacgattgaacttaaggaatcagaggaattcaagtcacatctattaaaacttttcaaagaaactgatgtggctgttatgtctggtagtctgcccaaaggacttaatactgattattatgcggatattgtgagattagcaaaagaacaaggaattttgaccattttagatagctctggtcaatcacttgaggaagttcttattagtaatgtgaaacctacagtaattaaacccaatatagatgaattatcacaacttttaaattacaaagtaaccaatgatattaaagaattgaaagcggcagtaagtcagccaatatttaatgatattgaatggattattgtttcattgggcagtgaaggtgcttttgcaaaacataatcaaaaattttataaggtgaatattcccaacattaaagtagttaatcctgttgggtcaggagattccactgtagcaggaattgcttctggactcattcatcaacaaaccgatgaagagttattaaaaaaagcaaatgcattcggaatgctaaatgcaatggaacaacaaacaggtcatattaatacagataaatttgacgaaatattcaaacaaatagaagttatagaggtgtaa

SEQ ID NO: 2583 - DNA, 366 bp, Staphylococcus epidermidis
tatccttcaccatattgtctactagtaattaaaacaccaactgtaccatcacctataaatgaagctagattatcaactgtcgatctaccaggtaaagtaaacaaaggtcgcatgataggtctaaagatgggtccaagtaattctaatagaccatactccattaataaaggtaaaaagattgcagcaaataaaaatactgctacaagagtaggtaataaacttgaaaatactaatccacctgtatcttcagatttaatcatttcaggtccaatatttaaaaatgttaaccaagaaaagaagacagctaatactctcaaaacaagccatcctattttaacgttgaaagcactgctcattaaaccttga

SEQ ID NO: 2584 - DNA, 303 bp, Staphylococcus epidermidis
cgcttgccacctacgtattaccgcggctgctggcacgtagttagccgtggctttctgattaggtaccgtcaagacgtgcatagttacttacacatttgttcttccctaataacagagttttacgatccgaagaccttcatcactcacgcggcgttgctccgtcaggctttcgcccattgcggaagattccctactgctgcctcccgtaggagtctggaccgtgtctcagttccagtgtggccgatcaccctctcaggtcggctacgcatcgtcgccttggtaagccgttaccctaccaactag

SEQ ID NO: 2585 - DNA, 123 bp, Staphylococcus epidermidis
tttgtaacgtttcgttactgtttattggaattaacgtcgacatattgtcattcagttttcaatgttcatttagtaaaatcaatctttttcattgtactatattgttttaagaaaagtcaataa

SEQ ID NO: 2586 - DNA, 1080 bp, Staphylococcus epidermidis
gggggatttactttgttaacggtaaatcaagttaaagaaattgtaggggcattaaaggatccgattattgatgtgccattgagagaatctgaaggtattgttgatgtctctattaaggataatattaaccatgtgagtgttaaagtggcaatggcgcaattagggggacagccacaattagatcttcaaatggctatagtcaaagccttaaaagaaaatggtgcaaatactgtgggaattcgttttgaagaacttcctagcgaagtagtcgaaagatatataggaaaaggtagtgaaaagcccaaaaccattgaagaactattatcacaaaataatccagttgaattcatttctatagcttcaggtaaaggtggggttggtaaatcgacagttgctgtcaatctagccgtagcattagcaagagaaggtaagaaagtaggattagtagacgctgatatatacggttttagtgtgcctgatatgatgggaatagatgaaagaccaggtatagatggtaaggagattatacctgtagagagacatggagtaaaagttatttcaatggcattttttgttgaagaaaatgcaccggttatttggagaggtccaatgcttggtaagatgcttacgaatttctttacagaagtacagtggggagaacttgattacttacttcttgatttaccacctggcacaggagatgtagctttagatgtacattcaatgttaccatcaagtaaggaaattatagtaactacaccgcatccaaccgcggcgtttgtagcggcacgagcaggtgcaatggctaaacatacagaacatacaattcttggtgttatagaaaatatgagctattttgaaagtaaagaaacaggtaaaaaagagtatgttttcggaaaaggaggaggcaaaaagctttctgatgaacttgagacgcaattatttgctgaacttcctttagaacaacctacatggaatcccaatgacttttcgccttcgatatatcaatcggatgatcgtttaggagaattgtatactttaatcgcaagaaaagttatagtaagcacccaaaaacaataa

SEQ ID NO: 2587 - DNA, 666 bp, Staphylococcus epidermidis
ggagggaatactgtgggtcaaaaaattaatccaatcggacttcgtgtcggtgttatccgtgattgggaagcaaaatggtatgctgaaaaagactttgcttcacttttacatgaagacttaaaaatccgtaaatttattgataatgaattaaaagaagcgtcagtttctcacgtagatattgaacgtgcagcaaatcgcatcaatattgcaatccatactggtaagccaggaatggttattggtaaaggcggttcagaaattgaaaaacttcgtaacaaattaaataccttaactgataaaaaagtacacatcaacgtaattgaaattaagaaaattgatattgatgcacgtttagttgcagaaaatattgcacgtcaattagaaaatcgtgcttcattccgtcgtgtacaaaaacaagctattacaagagctatgaaaaatggtgctaaaggtatcaaaactcaagtatcaggtcgtttaggcggagctgacatcgctcgtgctgaacaatactcagaaggaactgttccacttcatacattacgtgctgacattgattatgcacacgctgaagccgatacaacatatggtaaattaggcgttaaagtatggatatatcgtggagaagttcttcctactaagaacactagtgaaggaggaaaataa

SEQ ID NO: 2588 - DNA, 252 bp, Staphylococcus epidermidis
gggagggataccatggctgataataacaatcaaaacggacaagacgctactcaacaatttataaatattttaaaatcgtttaaatggcgtattattggatttttagcatttttaattatagctatattattcctaactctcggattttggaagacaattttaattatagtgttatgtttaataggaatcggtatcgggtatattaaagaccgtacacaagatttcttaaacttcctaaatagatggagttag

SEQ ID NO: 2589 - DNA, 564 bp, Staphylococcus epidermidis
ttgagttggtttttggtgtttttttacaacgttaacaccttccacaacgacacggtctttttttggttcagtagctactactttaccttctttacctttgtctttacctgcgataacttttacgttgtcaccttttttgatatgcatgtgggcacctccttaaattatgtgaatttatttgattggtattatagtacttctggagctagtgatacaattttcatgaagtttccttcacgtaattcacgagcaacaggaccaaagatacgagtaccacgtgggcctttgtcatcacggatgataacacatgcattttcgtcaaatttaatatatgaaccgtcttcacgacgaacacctgattttgtacgaactacaacagcttttacaacgtcaccttttttgacaacgccacctggtgttgcatttttaacagtacatacaataatatcaccaatgttcgctgttttgcgaccagatccacctaatactttaattgtaagaacttcacgagcaccagagttgtctgctacttttaagcgtgtttcttgttggatcattcgttaa

SEQ ID NO: 2590 - DNA, 153 bp, Staphylococcus epidermidis
atcacctggtttcgggtctacgaccaaatactcaacgccctattcagactcgctttcgctgcggctccacatttgctgcttaaccttgcatcagatcgtaactcgccggttcattctacaaaaggcacgccatcacccattaacgggctctga

SEQ ID NO: 2591 - DNA, 516 bp, Staphylococcus epidermidis
aggagggacacattcatggctcgtagagaagaagaaactaaagaatttgaagaacgcgttgttacgattaaccgtgttgctaaagttgtaaaaggtggtcgtcgtttccgtttcactgcattagtggttgttggagataaaaatggtcgtgtaggtttcggtactggtaaagcgcaagaggtaccagaagctatcaaaaaagctgttgaagcagctaaaaaagatttagtagttgttccacgtgtagaaggtacgactcctcatactataactggtcaatatggatcaggtagcgtatttatgaaaccagccgcacctggtacaggagttatcgctggtggaccagttcgtgccgtattagagttagcaggaattactgatatcttaagtaaatctttaggatcaaatactcctattaatatggttcgtgcgactatcaacggtttacaaaacttaaaaaatgcagaagatgttgctaaattacgtggcaaatctgtagaagaattatacaattaa

SEQ ID NO: 2592 - DNA, 492 bp, Staphylococcus epidermidis
tttattcgcactgcaataatgaacgaagcatttatttttaggaggacaattattatgcgtcaaacatttatggcaaatgaatcaaacattgagcgcaaatggtatgttattgatgctgaaggccaaacattaggtcgtttatcatcagaagtagctgctatattacgcggtaaaaataaagtaacttatacaccacacgttgatactggtgattatgtaattatcattaatgcatctaaaattgaattcactggtaacaaagaacaagacaaaatgtactaccgtcattcaaatcacccaggcggtttaaaatcaatctctgctggtgaattaaaaagaacaaatcctgaacgtttattagaaacttcaattaaaggtatgttaccaagtacacgcttaggtgaaaaacaaggtaaaaaattatttgtatatggtggcgctgaacatccacacgctgcacaacaaccagaaaactacgagttacgtggttaa

SEQ ID NO: 2593 - DNA, 1023 bp, Staphylococcus epidermidis
agaggtggcactatgaaagcgataggatttaagtcttcattccaattagatgaaggaaattgttttgaggaatttaactttgatatacctcatccatccggccatgaattattagtcaaggttcaaagtattagtgtgaatcctgttgatacaaaacagcgtacaatgccagttgacaaagcgccacgtgtacttggctttgatgctgttggtgtgattgaaaagataggagatcaagtgtcaatgtttcaagaaggggacgtcgttttttattcaggttctcctaaccaaaatggttcgaatgaagaataccaattaatagaggaatatttagtagctaaagcacctacaaatttgaaaagtgaacaagcagctagcctacctttaactgggctaacagcttatgaaacgcttttcgatgtttttggaatttcaaaagaaccatctgaaaataaaggtaaatcattgttaataattaatggagcaggtggtgtaggtagtattgcaacacagatagcgaaattttatgggttgaaggttattacaactgcttcgagagaggatactataaagtggtctgttaatatgggtgctgatgttgtactgaatcataagaaagatttaagtcaacaatttaaagataatcatattgagggtgttgactatatcttttgtacattcgatacagatatgtattatgaaatgatggttaacttagttaaacctagaggacatattgcgacaattgtcgcatttaattcgcaacaagatttaaatttattgaaatctaaaagtgtaacatttacgcatgaatttatgttttcaagaccattacaccatacagatgatgtaatcaaacatcatgaatatcttaaggatataacagaaaaggttgaacagggatattatcaaccaactaccacgaaagttatcgacggattagatgtagatagcctttatgaagcgcatcaaattttagagtctcattctatgattggtaagcttgttatcaatcttaagtaa

SEQ ID NO: 2594 - DNA, 126 bp, Staphylococcus epidermidis
gcaatttcaactaatatacgcaatatttacactcctgaaaattttaaaataaataatatagtagcgataggtattaaaagtaagactgttaatgtgtctttatattgccaatgtaataacctatag

SEQ ID NO: 2595 - DNA, 351 bp, Staphylococcus epidermidis; identical to SEQ ID NO: 2376

SEQ ID NO: 2596 - DNA, 195 bp, Staphylococcus epidermidis
tttaattatttaatagcaatgattgataatgctattaaaaattgcaattgtatcatgctttaccaagctgttcaaagtttaaataattacactataatggcatccaaaataataagaaatctctatattattctgagcattaagtttgtatcggtaattaaaatttggttgaatatggaattatcatttgaataa

SEQ ID NO: 2597 - DNA, 123 bp, Staphylococcus epidermidis
attacccgtgcaatcatgagcacgccaaaattaggtgcaatagcagcaacgatagaccctatcagaaatgatcccattgcacctaaatatagcggtcttgtttttactttatccattaaataa

SEQ ID NO: 2598 - DNA, 372 bp, Staphylococcus epidermidis
attaatatggcacgtattgcaggagtggatattccacgtgaaaaacgcattgttatctcattaacatacgtatatggtattggtacttcaactgctaacaaaattgtagaagaagctaacgtatcagcagatactcgcgttaaagatttaactgacgatgaattaggtcgtatccgtgaagttgtagatggctacaaagtagaaggtgacttacgccgtgaacaaaacttaaacattaaacgtttaatggaaatttcatcataccgtggaattcgtcatcgtcgtggcttaccagttcgtggacaaaaaactaaaaacaatgctcgtacacgtaaaggtccagttaaaacagtagctaataagaaaaaataa

SEQ ID NO: 2599 - DNA, 840 bp, Staphylococcus epidermidis
gcgacaatggctcttaaaaaatataagccaattacaaatggtcgtcgtaatatgactactttagatttcgctgaaatcacaaaaacaacacctgaaaagtcattattacaaccgctaccgaaaagagcgggacgcaataaccaaggtaaattgactgttcgccatcatggtggtggacacaaacgtcaataccgtgttatcgattttaaacgtaacaaagatggaatcactgctaaagttgattcaattcaatatgatccaaaccgttcagcaaacattgcattgctagtttatgctgatggtgaaaaaagatatatcatcgcacctaaaggattacaaataggtcaaactgtcgaaagtggtgctgaggcagatatcaaagttggtaatgccttaccattgcaaaacattccagttggtacagtaattcataacatcgagttaaaacctggtaaaggtggacaacttgctcgttctgctggtgctagctctcaagtattaggtaaagaaggtaaatatgtattaatcagattaagatctggtgaagtacgtatgattttatctacatgtcgtgcaacaattggtcaagttggtaacttgcaacatgaattagtaaatgttggtaaagcaggacgctctagatggaaaggtgttcgcccaactgtacgtggttctgtaatgaaccctaatgatcacccacacggtggtggtgaaggtcgtgctccaatcggtagaccatctccaatgtcaccatggggtaaacctacgcttggtaagaaaactcgtcgtggtaaaaaatcttctgacaaacttatcgttcgtggacgtaagaaaaaataa

SEQ ID NO: 2600 - DNA, 1965 bp, Staphylococcus epidermidis
attatgaatttcaatcaatttataaataaacaaaatataataatgactgaagatgaacataatgtatatgactttcttaaacatcataatcctaattggtcttctaattatattgatcatttattagatggacgtgataaagtaagtcaacgtttaattacatctttacatagggagaatttagtaaaaagtcgcgatcatagtcgtatacttaatcgacatcagtttgctggatacggagttaatgtgattgccattttagaaatctattttccaacatctaatatttatttgtatgcaccaataactggaatgcatgcattcgatcgcattgatgttgaaggacctttttattttaagaatctaagtaaagaagatgattttgaacgtgtactacatcctaatcaaatattagattggatattaattgaagatgaaaacttaaataacgaggctagcgtacaatttagaaatgatttaaataatagtgcagctaatatgacttttgctttaagtttccagcactatacgatgcgtaatgaaagagcgccattatataaccttattaaaaatgcaaatgatagttacttgcgttccgaacaatctgtcatcgaaggtcatccccttcatcctggtgctaagttaagaaaaggaatgaatgctgaggaaaactttatgtattcatcagaatttggtaatgttattcatctaagagccgtttttattcataaaagtataagtcgtattcaatcatcgaatgtagattacaatgttgccgtaaagcaaatgtttcccgacttaattaaaaccttagaaaaagaatttggcgaagattttaatttacaaaattatcatttaatgatggttcacccttggcaaataaaacatattttacaaagtgattatcgggatgaactaaatgaaaagttaatattgataagtaatcattcggtaccatattatgccggtctatcatttagaacgttagtacctaaacaacctgatttatccccgcacatcaagttatcgacgaatgtacatataaccggtgagattcgaacattgtctgaacaaacgacatataatggaccactagtgacgcaaattttaagagagattatgtcaaaagatgaagatttttcacattatcaatctacttatatcgatgaaaatgcagggattcacttttataatcgaaacgacaatgaggcaattcaaacagatagaagtgaacaattagggactttgtttagaaataatttatatcaatttatatctaatgaaacagtgccagtaattccatcaagtttggttgcgacctatccttataatactgaagcaccaatctgtacgttaatcaaaacgtatcaaaatacgtatcaatataaaaattatgaagaagcagcgaaacaatggattaaagactatagcaaagctcttcttggcttagttatccctctttattcaaaatatggaatttcgctagaggcacatttacaaaattcagtggcaacttttaataaagatggctcactaaatatgatttatatcagggactttgaaggattacgtattgataatgaacaattgaataatgctggatttaccactagacatttccatgaaaaatctagaatccttacaaattctaaaacatcagtatttaataaaatgttctattcaacagttcaaaatcatttaggtgaactcgttattacaatagctaaatattctaatagtaaagtccttgaacaagaaatatggcaaattatttcacaaacagtagaagacatttttaatcacatgactcacatttcaaaacaacatctcaacaacatcaagcgcactattttcgcatccgaaatcgattataagtgtgtcacaacaatgcgtttagaggatcaagcacatgaatatacgtatattaaagtgcataatccacttcatagaaagaatgatttataa

SEQ ID NO: 2601 - DNA, 1479 bp, Staphylococcus epidermidis
atatggaattatcatttgaataaaaaggagtatatgtttatggccagttatgaattgtctaagactaagcgaaatttaattgtatctgtaatgttaattagcgctttcgtggccattttaaatcaaacattacttaatacagccttgccacacattatgcgtgagttaaatattaatgagaatacatcgcagtggctgattacaggtttcatgttagtgaatggtgtcatgattccactcaccgcttatttaatggataaagtaaaaacaagaccgctatatttaggtgcaatgggatcatttctgatagggtctatcgttgctgctattgcacctaattttggcgtgctcatgattgcacgggtaattcaagctgtcggtgcaggtatactcatgccattaatgcaatttacattgtttacattgttctccaaagaacaccgtggatttgcaatgggacttgcaggattagttatacaatttgcacctgcaattggacctacatttactggtttaatcattgacaatgcaagttggagagtgccatttattgttattgtcggtatagcattagttacatttatatttggttttgtatcgatttcaagttataacacgacgaaagaaacaaaactggataaaaaatccgttatatactctacattaggttttggcttaatgctttatgctttcagtagtgctggtaacctaggtttttctaacccaattgttctttgttcacttttaataagtttaatcatcattggcatttttgttaaacgacaaattacaatttctaatccattattaaatttgaaaatatttaataacaaaatattttgtttttctacaattacttctatgatcattatgttatctatggtaggacctgctttacttattccattgtatgttcaaaatgctttaggattatctgcgttgctatcaggattagtaattatgcctggcgcgattatcaatggtattatgtctgtgtttacaggaaagttttacgataaatatgggcctagaccgttaatatttactgggtttatcttattgatttcttgtacatttctattatgctttcttaaagtagatacatcctatacgtatttgatagtaatctatgcgattcgtatgtttgcagtgtctttactaatgatgcctatcaatacgaccgggataaatgcattgaaaactgaagacatttcccacggaacggcaattatgaactttggtcgtgttatggcgggatctctaggaactgctctaatggtcacttttatgagtataggtgctcaatgggttgtatcatcaagtgaacacgctagtaaagaaatgatccagcgacaaagtgttgctgtgggagttgatgtatcgttcgccttagtcactgtttttgtgattattgcttttgttctagcgttatttataaaggagcctaatcatttaactcacaatagtaggaaagtataa

SEQ ID NO: 2602 - DNA, 372 bp, Staphylococcus epidermidis
ctcatgggttacagaaaattaggtcgtacttctgatcaacgtaaagcaatgttacgtgacttagcaacttcattaatcgttagtgaacgtatcgagacaactgaagctcgtgctaaagaagttcgtagtgtagtagagaaattgatcacacttggtaaaaaaggtgatttagcatctcgtcgtaatgctgctaaaactttacgtaatgttgaaattttaaatgaagatgactctacacaaactgctcttcaaaaattatttggtgaaatcgctgaacgttatagtgaacgtcaaggtggttacactcgtattcttaaagtaggccctcgtcgtggtgacggcgctgaatcagtaattattgaattagtttaa

SEQ ID NO: 2603 - DNA, 1215 bp, Staphylococcus epidermidis
aattacgtatacataaggagcgttatcatgttagacaaaaatcaattggaaaagtataaccaagagcatttgtatgaatatgaaaaattaatgagtagtaatgaaaagaatgctttagatgaaaaagtagatcagttaaatcttgcagaaattcaagatttatatcaagatttatatgttaatagaaaaactattgatgatgtatcttctgtatctgaagtcaaatatgaagtgaaatcgcgactcaatgaagaagaacgacatacatatgaacaaaaaggttatgaggcaatacgaaatggtgaatttgctgtattattgatggctggaggacaaggtacgcgtttaggatataaagggcctaaaggttcttttgaaatagagggtacgagtttatttgaacttcaggcgcgtcaactgattcgtttaaaagaagaaaccggccacacaattaattggtatattatgacaagtgacattaatcataaagatacaatagagtattttaaacaacataaatattttaactatgatgccaatcatattcatttctttaagcaagataacattgttgctttaagtgaagaaggaaagcttgttttaaatagagatggacatataatggaaacacctaatggtaatgggggtgtattcaagtctcttaagaaagcaggatatcttgataagatgcaacaagatcacgtcaaatatatcttcttaaataacattgataatgtcttagttaaagttttagacccgttatttgccggttttacagtgacacaaagtaaagacatcacatcaaaaacaattcaacctaaagatagtgaaagtgtaggtcggcttgtaaatgttgattgtaaagacactgtgttggagtattctgaattagatacagacatagcaaatcaatttaacaatgctaatataggtatccatgcttttaaactaggtttcattaccagtgctgttgatagagaattaccgtatcatttggcaatcaagcaattaaagcaattagatgaaaattttggtgtggttgaacgacctacattaaagtttgaattattttattttgatatatttaggtacggtacaagctttgtaacattacaagttccaagagaggaagaattttcacctttaaaaaataaagaaggtaaggatagtgtacatacagctacagaagatttaaaacgaatgggtttgatttaa

SEQ ID NO: 2604 - DNA, 150 bp, Staphylococcus epidermidis
aattctcatcttgactacctgtgtcggtatgcggtacaggcacctgttatctatctaaaggcttttctcggcagtgtgaaatcaacgactcgaggatacaatttcctctccccatcacagctcatccttatgagtgccggatttgcctaa

SEQ ID NO: 2605 - DNA, 126 bp, Staphylococcus epidermidis
aactctattcactcggttttgcttggtaaaatcttacttacttatctagttttcaatgtacaaataaatggtgggcctaagtggactcgaaccaccgacctcacgcttatcaggcgtgcgctctaa

SEQ ID NO: 2606 - DNA, 579 bp, Staphylococcus epidermidis
gaagctagtcaaaacgttgtattacaaaagaaaactgaagaagtagatggttataatgctatccaagtaggttttgaagataaacaagcatataagaaaggttctaaatctaataaatatgctaataaaccagctgaaggtcatgctaaaaaagctgacacagcacctaagcgcttcattcgtgaattccgcaacgttaacgttgacgaatacgaagtaggtcaagaagtctcagttgatacattcgaaactggtgacatcattgatgttacaggcgtttcaaaaggtaaaggtttccaaggtgctattaaacgtcatggacaaggtcgtggaccaatggctcacggttctcatttccatagagcgccaggttctgtaggtatggcatcagacgcttcaaaagtgtttaaaggacaaaaaatgccaggacgtatgggtggaaacactgttactgttcaaaacttagaagtcgttcaagttgacactgaaaatagtgtgattttagtaaaaggcaatgtacctggacctaaaaaaggtttagtagaaatcacaacttcaataaaaaaaggtaataaataa

SEQ ID NO: 2607 - DNA, 372 bp, Staphylococcus epidermidis
cgaatgatccaacaagaaacacgcttaaaagtagcagacaactctggtgctcgtgaagttcttacaattaaagtattaggtggatctggtcgcaaaacagcgaacattggtgatattattgtatgtactgttaaaaatgcaacaccaggtggcgttgtcaaaaaaggtgacgttgtaaaagctgttgtagttcgtacaaaatcaggtgttcgtcgtgaagacggttcatatattaaatttgacgaaaatgcatgtgttatcatccgtgatgacaaaggcccacgtggtactcgtatctttggtcctgttgctcgtgaattacgtgaaggaaacttcatgaaaattgtatcactagctccagaagtactataa

SEQ ID NO: 2608 - DNA, 330 bp, Staphylococcus epidermidis
ggaggtgcccacatgcatatcaaaaaaggtgacaacgtaaaagttatcgcaggtaaagacaaaggtaaagaaggtaaagtagtagctactgaaccaaaaaaagaccgtgtcgttgtggaaggtgttaacgttgtaaaaaaacaccaaaaaccaactcaattaaaccctgaaggtggaattttagaaacagaggcagcaatccatgtttctaacgtacaattattagatcctaaaacaaatgaacctacacgtgtaggatataaaacagttgatggtaaaaaagttcgtatcgctaaaaaatcaggcgaagaaattaaagctaataattaa

SEQ ID NO: 2609 - DNA, 165 bp, Staphylococcus epidermidis
gtaagtaaacacaataatgctgtaattatgaatgatgaagtaatagtgatccgtaacagaagccctttgtcatatttatcagctatggatcctgcccaaacacttaatagtaaaataggtataagacgacagaaattaactaaacccaaatatacagcattatga

SEQ ID NO: 2610 - DNA, 144 bp, Staphylococcus epidermidis; identical to SEQ ID NO: 2403

SEQ ID NO: 2611 - DNA, 132 bp, Staphylococcus epidermidis
attacgtggcaaatctgtagaagaattatacaattaaggagggaaaataagttatggctaaattacaaattaccctcactcgtagtgttattggtcgtcctgaaacacaacgtaaaactgttgaagctttag

SEQ ID NO: 2612 - DNA, 429 bp, Staphylococcus epidermidis
ccaaaacttaaacctgcaaaaacaaccgcaaaagcaataagcaatgggagttttaagccaaacattatcatcagactactaactaataaaacaaaaaatgagcaaatatataatgtttttctagtaaaatgcgcttctattttacctaaattgaaattaagcgtaatccaagcaacagacaacgggaatattacaaatccactttgtaaaggtgataaactaagtttttcttgtaaatatactggtatatataaattatatcccatcagtgttatcgcaataagtaaatccgttataaaaactagaactattgatatgttaaattcttttgttggaagaaatggttgttcgatactattttctattttaaatagtagccataaaacagctaaagctaaaataattgagaatatgttaaaaataatatga

SEQ ID NO: 2613 - DNA, 183 bp, Staphylococcus epidermidis
gttatggctaaattacaaattaccctcactcgtagtgttattggtcgtcctgaaacacaacgtaaaactgttgaagctttaggtcttaaaaagactaatagttcagtagttgttgaagataaccctgcaattcgtgggcaaatcaacaaagttaagcatttattaacaattgaagaaaaataa

SEQ ID NO: 2614 - DNA, 222 bp, Staphylococcus epidermidis
tcaatggctaaacaagatgtaattgaattagaaggtacagtactagatactttaccaaacgcaatgtttaaagtagaattagaaaatggtcatgagattttagctcacgtaagtggtaaaatcagaatgaattacattcgtattctacctggcgacaaagtaactgttaagatgtctccgtatgatttatcgcgcggtagaattacttatcgttataaataa

SEQ ID NO: 2615 - DNA, 201 bp, Staphylococcus epidermidis
aaggaggctaataaagtggctaaaacttcaatggttgctaagcaacaaaaaaaacaaaaattcgctgtacgtgaatatactcgttgtgaacgctgtggtcgtccacattctgtgtatcgtaaatttaaattatgccgtatttgtttccgtgaattagcttacaaaggtcagattcctggcgtacgtaaagctagctggtaa

SEQ ID NO: 2616 - DNA, 585 bp, Staphylococcus epidermidis
ttgatgtataatctaaaattaacttttgctaaggaggtgacgtgcgaggtgaaaagacttaagaattttattctcggcttactcattgtggctatagttggcttcctattatttatgtatatagatgatagtcgcattcaaagttatcaagactacttcttacaatttaattggttccaaccactattgattgggcttgcaggattacttatattaatcggacttatattagtacttagtatttttaaacctacgcatcgcaaacctggactttataaaaactttgatgatggacatatttacgtatcacgtaaagctgttgaaaaaacaatttacgatacaatcgctaaatatgatcaagttagacaaccaaatgttgtaagtaagctttataacaaaaagaataaatcatttattgacatcaaagcagatttcttcgtaccaaaccatgttcaagttaagagtttaacagagagtatccgtgctgatatcaaaagtaatgttgaacactttactgaaattcctgttagaaaattagaagttaacgtacgtgatcagaaaacatctggtccacgtgtattgtaa

SEQ ID NO: 2617 - DNA, 525 bp, Staphylococcus epidermidis
tttaaaaataaaggagaatgtattatggcagtagataacaataaagctaaacaagcatatgataatcaaacaggtgttaatgaacaagaaagaaaagagcaacaacaagctcaaaataatcaacctcaatttgaaaacaaattaactttctcagatgaagtagttgaaaaaattgcaggtattgcagcacgtgaagttaaaggaattttagacatgaaaggtggcttcacagatagctttactaacgctttctcaaacggtaacaatgtaactacaggcgtatctgtagaagttggagaaaaacaagctgctgtagatttaaaagttattttagaatatggtgaatctgcacctaaaattttccgtaaagtgacagacttagttaaagaacaagtaaaatatattactggtttagaagttgttgaagttaacatgcaagttgacgacgtaatgacaaaaaaagaatggcaacaaaaaaatgaaaaagataacaaagaaaacaatgaaagagaaggtttaaaataa

SEQ ID NO: 2618 - DNA, 771 bp, Staphylococcus epidermidis
gaagtgaataaatcaatgaacaaatatgataggttagatgaaatcacaaaattagtaaataaacgaggttctgtaagaacaaatgaaatcgtcgaagatctaaatgtgtcagatatgactgtgcgccgtgatctcgcagagcttgaagaaaaaggtgttctcactaaaatacatggtggtgctcgtagtaattcagctttccaatataaagaaatgtctcatcaagaaaaacatacacgttttattgaagaaaaacgatttatagcaaagaatgcagtagatttaattgaagatggagatactattttcttaggtccaggtactacagttcaaaaattagctgaagaaataaatcattattcattaacaattattactaattgtttaccagtatttaatatattaataaaaaaacaaacgttacatttcagagtctatttattaggtggggaaatgcgtgatttaactgaagcatttgtaggtgagatgacaaatcagttattaagtcaactaagatttagtaaaatgttttttagtagtaatggtgttaaagatggtctagctatgacatcctcaatagaagaggcttatacgcaacaaattgcacttagccattcgttggaaaaatatttactgattgactcttcaaaaattggtaaggatgatttttcatcattttgtgagcttcgtgaactcaatgcagttttaacagataataatgacttggaaaagaaagaaaaaatagaatcatatgttgaggttattagctaa

SEQ ID NO: 2619 - DNA, 228 bp, Staphylococcus epidermidis
catagtgataaatttaattctacctcttactatgtcaacttttttaaatccattcatatatattcaatccatttctatctttttatatccatatgtaatttaaagtatatcacattatatatatgcattattttgaataattacgtaaagaacactatacgctatttattaacttttagcaaatccattttaactctttttcatttaagcagttctattcgtatatga

SEQ ID NO: 2620 - DNA, 507 bp, Staphylococcus epidermidis
tttaggtgtaaagatttgaaagcgctttttcaaaaacacatgtgtttaatcaccttaattcaaaaaaggagacttattatgacgattattattggttcagatgtagatggcaaacgcttaaaagaattaattaaagattatttggaagacaacgattatgatgttttagatgttacagaaggaaaagatttagactttgttgattcaacagtctctgtagctaaagaagttcaaaagtccgacgacaatctaggtattgctatagatgcctatggtgcaggtagttttattgtagcaactaaaattaagggaatgattgcggctgaggtttcagatgagcgttcagcttacatgacacgtagccataataatgcacgcatgattactatgggagctgaaattgttggagatacgcttgctaagaatgtcgcaaaagaatttgtcaatggtcattacgatggtggacgtcatcaaattcgcgtagatatgttaaataaaatgtgttaa

SEQ ID NO: 2621 - DNA, 225 bp, Staphylococcus epidermidis; identical to SEQ ID NO: 2414

SEQ ID NO: 2622 - DNA, 873 bp, Staphylococcus epidermidis
tatacagtcaatttgaattattgtagaatgtttagtgatataaaaatattaggagtggttgatgtgaatgggtcaaatcctatcattgagtttaaagatgtatcatttcaatatcaaagtgacgctgctttcacattaaatcgcgtttcattctcaataccagctggacaatggacttctattgtaggtcacaatggttcaggaaaatctactattgctaaacttatggtaggtatagaagaaccaagtgaaggacaaattctatttcaaaatctaccagtagactctcaaaataagcgagaagtgaggaaacatatcggaattgtttttcaaaacccagataatcaatttgtaggttctatagttaaatttgatgttgcttttggtcttgaaaaccaacttgttccttataaagaaatggtatctaaagttaatcaagttttaactgaagtagatatgataaataaagccgatgatgagccccattcactttcaggagggcagaaacaacgtgttgccattgctggggtacttgcacttaatcctgatgtgctgattttagatgaagcgacaacgatgctagatcctcatggaaagtcatctttacttaaccttgttaatgaagttaaagtaaataatcatgttacaattatttcaatcactcatgatttagatgaagcaatgcatgctgatcaaatcattgtattgaataaaggaactgtttttaaacaaggaacacctcaagatatttttaagtgcgaagatgcactaatatcggttggattggacttaccatttcctttgaaaatgaatcgacttttaggttttgattcaacttatgtaacttatgaagggttgattaaaaaattatga

SEQ ID NO: 2623 - DNA, 150 bp, Staphylococcus epidermidis
ataataaccaaaactaatactgttgtagaaaagattgtaaataatagaattgtgaattttgacttcatcattagccctcttcatgtttatttattaattatactattattagtaataaattatttgatttatgggattactttaaaataa

SEQ ID NO: 2624 - DNA, 156 bp, Staphylococcus epidermidis
aactgcttaaaacgggcgggaatcaattctatacaagagttagctgataaatctgaagctgacatgatgaaagtgcgtaatctaggtcgtaaatctctagaagaagtgaaatataaattagaagatttaggattaggattaagaaaagaagattga

SEQ ID NO: 2625 - DNA, 546 bp, Staphylococcus epidermidis
aatatgctaaaatatttttataaaggagaacaaaacatgacaggtaaaacacacgcatcatgtggctttttagtcggtgcaataaccacacaatattttcatacagatatatttacttctatatcagtgattgtactttcagtcatttcaagtatattgccagatatatgtcatacacaaagtaaaataggaagacgatttaggcttactagtttttttgtcagaattttatttggtcatagaacatttacgcattcacttttatttattataggaattagttttttactgtacttcatacaaactccgatgtattatatggttgcaattgttattggtatgttttcgcatgttatacttgatatattaacaccaagaggtgttaaactattatatcctttaccatttaatatcgtatcacccattcattttaaaactgggggactagtagatgtatctctagctactgcattaagtgttggtgcgatatatactttatttcaaccatatttaaatactatgatgcactattggttaatcaaataa

SEQ ID NO: 2626 - DNA, 126 bp, Staphylococcus epidermidis
ggaggtataaaaatgaaagtaagaccatcagtaaaaccaatatgcgaaaaatgcaaagtcattaaacgtaaaggtaaagtaatggtaatttgtgataatccaaaacacaaacaaagacaaggttaa

SEQ ID NO: 2627 - DNA, 201 bp, Staphylococcus epidermidis
atacctacaaaccagaagaacgcaaacgcaccgaatatgagtgttaccccaatccaaccatctgccgcagtaaatagtggctcaaatacttttaatactgcatttgctacattcgtgtggactattgctctagaaagtaagtctaaagcatacaaaattaaaattacggctgataaagggaaaatatctttaaatacttga

SEQ ID NO: 2628 - DNA, 981 bp, Staphylococcus epidermidis
tttatgacaaaatcacaacaaaaagtgtcatcaattgagaaattaagtaatcaagaaggtattatttcagctttagcatttgatcaacgtggtgcattaaaaagaatgatggcagaacatcaatctgaaacaccaacagttgaacaaatagaacaattaaaagtacttgtttctgaagaattaactaaatatgcgtcttcaattttattagatccagaatatggtttaccagcatcagatgctcgaaataatgactgcggactattacttgcatacgaaaaaactggatatgatgtgaatgcgaaaggtcgtttgccagattgcttggtagaatggtctgcgaaacgtttgaaagagcaaggggccaatgcagttaaatttttactttattatgatgtagatgacacagaagaaattaacatacaaaagaaagcatatattgaacgaattggttcagaatgtgttgccgaagatattcctttcttcttggaagttttaacatatgacgacaatattcctgacaataaaagtgcagaattcgctaaagttaagccacgtaaagttaatgaagcaatgaagttattctctgaagatcgttttaatgtggatgtacttaaagttgaagtacctgtgaatatgaattttgtggaaggattttcagaaggagaagttgtttatactaaagaagaagctgcacaacatttccgtgatcaagatgcagctactcacttaccatatatttatttaagtgcaggtgtatcagcagaattgttccaagatacattaaaatttgcgcatgattctggtgcgcaattcaatggtgttttatgtggacgtgccacatggtcaggagcagttaaggtatacattgaagaaggagagcaagctgccagagaatggttgcgtacggtaggatttaagaatattgatgatttgaatacagtattgaaaacaacagctacatcatggaaaaacaaataa

SEQ ID NO: 2629 - DNA, 483 bp, Staphylococcus epidermidis
gggaggacaaaagtgatgaaatttttaaaaaataaatcatatcatttattagtaacacttattgttctcactatatttgttatttccggagcaatttttttaacatttttaggctttggtttgtacggtttgagtcgcatccttatttatttacacttaggcgattttagttacaataaaggcttttatgataatttaatatactacggtagttatatcgttttaggctattttactttattttcaattgagcatttaatggattattttaaaaagaatcttccaaaaaatccatactttcaaggtattaactttcatctcatctcctatattgttactacaattatgttttattttatagttcacatacactatgtacatgttaatatacatttttgggtaattatgattattataggatttttatttgtatgtaaagaagttttttatcctgaaagtaaaaatttgaataataaaaagtaa

SEQ ID NO: 2630 - DNA, 132 bp, Staphylococcus epidermidis; identical to SEQ ID NO: 66

SEQ ID NO: 2631 - DNA, 1776 bp, Staphylococcus epidermidis
attatacaaaaaagggagctgacccctatgaataaattaatagcatggatagaaaaaggaaagccattctttgaaaaaatatcacgaaatatttatttaagagcgattcgtgatggatttattgctgctattccaattatcttattctcaagtatatttattttaattacctatgtaccaaatgtgtttggttttacttggagtaaaactatggaaggtatattgatgaaaccctataactatacaatgggaatagttggtttgcttgtagcaggaaccacagctaaatctttaactgattcttacaatcgaaaactagataaagcgaatcagattaactttatttcgacaatgatggcagctatttgtggatttttattcttagctgctgatcctgttaaagatggtggattttcaagtgcatttatgggaacaaaaggtttattgacagcctttatttctgcgtttattaccgtgattgtttataatttctttgtcaaaagaaatattaccattaaaatgcctaaagaagtaccaccaaatatatctcaagtatttaaagatattttccctttatcagccgtaattttaattttgtatgctttagacttactttctagagcaatagtccacacgaatgtagcaaatgcagtattaaaagtatttgagccactatttactgcggcagatggttggattggggtaacactcatattcggtgcgtttgcgttcttctggtttgtaggtattcatggaccttctattgttgaaccagcgattgcagcaattacttatgcgaaccttgaaacaaatttacacttaatacaagctggagaacatgctgataaagtaattacaccgggtacacagatgttcgtagcaactatgggaggaaccggtgcaacattagttgttccatttatgtttatgtggttaacaaaatcaaaaagaaataaagcgataggtagagcatcagtcgtacctacattctttggtgtcaatgaacccatactttttggtgcaccactagtactaaatccggtattctttataccttttatttttgcacctatagtaaatatatggatttttaaattttttgttgatgttttaaatatgaatagttttagtatctttttaccttggactactcctggtccactcggtattgttatggggactggatttgcattttggtcatttgtgttagcaatattacttattgttgttgatgtgattatttactatccattcttaaaagtatacgatgaacaagtgcttgaagaagaattaggaaataaagaagcaaataatgaattaaaagaaaaagtatcagcaaactttgatacgaaaaaagccgatgctattttagcaactgcaggggcaagtgaagcggatactgatgatacatcttcagttgatgaaacaacttctacatcctctacagatactattagtgaacaaacaaatgttttagttttatgtgcaggtggaggtacaagtggtttactagctaatgctttaaataaagctgctgaagagtatgaagtaccagtaaaagcagcagcaggtggttatggtgcacatatggatattatgaaagattatcaattaattatcttagcaccacaagttgcttcgaattttgaagatattaaacaagatactgatcgcttaggaattaaattagccaaaactgaaggcgctcaatatatcaagttaacaagagacggtgaggcggctttagaatttgtaaaacaacaatttaacaattaa

SEQ ID NO: 2632 - DNA, 405 bp, Staphylococcus epidermidis
aggaggcaaaatttaatggcacgtaaacaagtatctcgtaaacgtagagtgaaaaagaatattgaaaatggtgtagctcacatccgttcaacattcaataatactatcgtaactatcactgatgaattcggtaatgcattatcttggtcatcagctggtgcattaggattcaaaggatctaaaaaatcaactccatttgcagctcaaatggcttcagaaacagcttctaaaactgctatggaacatggtttgaaaacagtagaagtaacagtaaaaggacctggtccaggccgtgaatctgctatccgtgcactacaatctgcaggtttagaagtaactgcaatcaaagacgttactccagtaccacacaacggttgtcgtccaccaaaacgtcgtctcgtataa

SEQ ID NO: 2633 - DNA, 1380 bp, Staphylococcus epidermidis
atatatatgaatggatttaaaaaagttgacatagtaagaggtagaattaaatttatcactatgtcattgttagggattatattatttttagttcctataccagtcgttcaagatggaaagcagcaaacgacacttcctatagcttttttagctggtttattaaaagattggcttggtggtatcatgccaattttaattgtaaccatcataactgtatcaggtattttaacaatattatgctctacaatttataaaaataaattaaatcctcaaggtttaatgagcagtgctttcaacgttaaaataggatggcttgttttgagagtattagctgtcttcttttcttggttaacatttttaaatattggacctgaaatgattaaatctgaagatacaggtggattagtattttcaagtttattacctactcttgtagcagtatttttatttgctgcaatctttttacctttattaatggagtatggtctattagaattacttggacccatctttagacctatcatgcgacctttgtttactttacctggtagatcgacagttgataatctagcttcatttataggtgatggtacagttggtgttttaattactagtagacaatatggtgaaggatattactctagaagagaagcaacagtaatatccacaacctttagtgttgtatctattacgttcgctattgtcattgccgaaacaattagaatgcaagatcaatttttctatttttatttaacagttgtcatttcatgcttaattgcagcaatgattatgccaagaatttggccacttaaaaatattcctgacgaatatgctaaagaagtaagtgaagaggctcgtaatgaacagctaccagaaggcaaaacagcattaaaatatggttttgatttagcaactgaagttggaattaaatcgccagggtttaaagaatttttaatttcaggttttaaaacagttgtagatatgtggtttgtaattttaccagttgttatgagtataggaacaatagctaccattattgctaactacacgcctgtttttgaaattataggaaaaccatttgttccagtactagaattgttacaaattccagaagcacatgaagcatcacaaacaattttaattgggtttgccgatatgttcttaccttcaattcttattgaaggggttcaaaatgatgtaacacgttttgtaattggagcattgagtatctcacaacttgtgtatttatctgaagtaggcggcgtgattcttggttctaaaattccagttagtataagtaaattatttatgatttttttaattcgtactatcattacgcttccaataattgctttattagcgcatttatttatcggataa

SEQ ID NO: 2634 - DNA, 747 bp, Staphylococcus epidermidis
aaacaaatgaaaaaaccagatattcaacagttaaaagatatcgtaaacaactctaatcaaattgttttctttacaggagctggtgtttcagttgcaagcggaattccagattttcgctcaatgggtggcttgtatgatgaaatatcaaaagatggacagtctccagagtatttgcttagcattgatcatttacatgataataaagaaagttttataaacttttatcatgaaagacttttaattgccgataaaaaacctaatattgttcatcaatggattgcacaactggaaaatcagcaaaaatcacttggcgtcatcactcaaaatatagatggtttacacgaagatgcaggtagtcacaatattgatgagctacatggtacacttaatcgcttttattgtattaactgttatgaggagtactcaaaatcatatgtcatgacacatcatctcaaatattgtgaaaaatgtggtaacgtcatcagacctgatattgttttatacggcgagatgttaaatcaaaaaacagtcttcaaggcattagataaaattcaacatgcagatacactcatcgtattaggttcatcacttgttgtacagcctgctgctggttttgtatcagaatttaaaggtgacaacctagttatcattaatagagatgcaactccatatgatcatacagctagcttagttatacacgatgatatgactaatgttatagaagaaatcttaaatagtaatagttaa

SEQ ID NO: 2635 - DNA, 1065 bp, Staphylococcus epidermidis
tgcatggcgaatgttcgtgtcaatttatctaaaattaaatataatgccaaagtacttcaatcgttattagaacgtagacatatccatttcacaccagtaattaaatgtgtcgcaggggataaacgtattgtatcaagtattaagtctttaggaattactcattttgctgaatcaagactagataacattgaacaactcaaagatttagatattacatttacattgttacgacctactgttgaagcagatttggaaaagatgatttcaagagtagaaatgagtatccaaactgaattaaccacaatcaaaaaacttaatacgttagcaaaatcacttgatattaaacatcaaatcatgctaatggttgactggaaagatggtagagaaggggtcttgacctatgatgtggtgcgttatgttcaagaagtacttagattatctcacatacaacttgttggcttggcatttaattttatgtgctttaaatcagaagcacccaatgaaaaagatgttcgtatgataaacaaattcatacataatgtagaaaacgaaactcattttaagtttagaattatttcaggtggaaattcgagtatgttacctcaaacactgtacaatcatttagataaaatcaatgatcttcgtataggggaggcattattaaggggtatagatacgacgacaaatcattcaattaatagcttatatcaaaatgcgatagtattagaagcagaaattatagagataaaaccacgtctatatcaaaaaaataatcaatcttatttacaagctatagtagatatcggttatttagatacgtttattgaggggataaaacctcttgggaatgatataagaatattaggtgcatcaagtgatcatttgatgattgatttaaataaccaagatcattatcaaatcggtgataaacttcaatttagcttgaattatgaagcactgtctcagagcatgtatatgaaaaatttaactaagttatatagtagtgattcaaaaatagaatcccttgttcagaacttcgatatgcctatatattcccagtgctaa

SEQ ID NO: 2636 - DNA, 237 bp, Staphylococcus epidermidis
aacgtgaagaattgggtggtgaaacaaatgaaagctaaggaaattagagacttaaccacttcagaaatcgaagaacaaatcaaatcttcaaaagaagagctttttaacctacgctttcagttagctacaggtcaattagaagaaacggcacgtattcgcacagtaagaaaaacgattgcacgtctaaaaactgttgctcgtgaaagagaaattgaacaaagcaaggctaatcaataa

SEQ ID NO: 2637 - DNA, 1047 bp, Staphylococcus epidermidis
gtaaggtggaaaacaatgactatggtgaataaagatagtcaatccgctattgaacaaaaaaagaaaaagcgcactacactcacttttattgtgggtgtgtgccttctttttatttcagtatatttgaatttagcgattggttcttcaaaaatacaatttaatgatattttaagttatgtaactggacacacgaatacaaaggcaactttcttaatacacaatgtacgtatgccaagaatgttagctggtttaattattggtggcgctttagcaattgcaggtttattgatgcaagcaattaccaaaaatcctttggcttcaccacagatttttggtgtgaatgcaggtgcttccttcgttattgtacttataactgtacttataccatcactaggctcttactctacaattttagcgataattggtgccttcttaggaggttttactgtttatacattgtctggctctactaagtcgattacaccgattaaattagcacttgcaggtatggctattcatctgttctttagtagtatgactcaaggtataattattttaaatgaagattctaatgatacagtgatgttctggttagttggttcattagccggtataaaatggcaacagattatattcatcttaccatttttactccttgctatttttgtgaccatatttatgggaagacaattaactatattagagttaggtgatgatattgccagaggattaggacaaagaacagaaatcgtcagaatgattgttggaatattggtcgttgttcttgctggtgtttctgtttctattgctgggcctataggatttgtaggtttgatagttccacacatagtgaaaagatatataaataaaaattatgtattgatgatacctttaacatttatattcggcgctactttattacttatttctgatgtattgtgtcgcttaattacttatccattcgaatcgccagtaggtattgttacatcatttgttggtgctttttacttcttattcataactgttagaggggtgaatcgcatatga

SEQ ID NO: 2638 - DNA, 453 bp, Staphylococcus epidermidis
ggaggtgccgaaatgaaattacatgagttaaaagcagctgaaggatcacgtcgtgtacgtaaccgtgtaggtcgtggtgctgcaactggtaacggtaaaacaagtggccgtggtcaaaaaggtcaaaaagcacgttcaggtggtaaagtaagaccaggatttgaaggtggacaattacctttattccgtcgtttgcctaaacgtggtttcactaacattaaccgtaaagaatatgctattgttaacttagaccaactcaataaatttgaagatggtactgaagttactccagctttattagtagaatctggtgttgttaagaatgaaaaatctggtatcaaagtactaggtaacggttcactagacaagaaattaacagtgaaagctcataaattctcagcttcagcagcagaagctattgatgcaaaaggtggagcacacgaggtgatctaa

SEQ ID NO: 2639 - DNA, 156 bp, Staphylococcus epidermidis
ctccgtatagagtgtcctacaaccccaacaagcaagcttgttggtttgggcttttcccgtttcgctcgccgctactcagggaatcgatttttctttctcttcctccgggtactaagatgtttcagttctccgggtctgccttctgacatgctataa

SEQ ID NO: 2640 - DNA, 387 bp, Staphylococcus epidermidis
cactctaaagaaaggagtattgaaatgatcagtaaaattgataaaaacaaagtacgtttgaaaagacgtgctcgtgttcgtactaaattatcaggtacagctgaaaagccacgtttaaatgtgtatcgttcaaacaaacacatctatgcacaaattattgatgacgttaaaggcgtaacacttgctcaagcatcatcacaagataaagatattgcaaacacatcagcttcaaaagttgacttagcaactactgttggtcaagcaattgctaaaaaagctaacgataaaggtattaaagaaatcgtcttcgatcgcggaggatatttataccacggacgtgttaaagctttagctgatgctgcaagagaaaatggattagaattttaa

SEQ ID NO: 2641 - DNA, 285 bp, Staphylococcus epidermidis
ttgaaagaggaggttacaaaagtgagcgaaagaaacgatcgtaaagtttatgtaggtagagttgtttcagataaaatggacaaaacaatcactgttctagtggaaacttacaaaacgcacaaattatacggcaaacgagtaaaatactctaaaaaatacaaaactcatgatgaaaacaattcagctaaattaggagacattgttaaaattcaagaaactcgtcctttatcagcaacaaaacgttttcgtttagtagaaattgttgaagagtcagtaattatttaa

SEQ ID NO: 2642 - DNA, 372 bp, Staphylococcus epidermidis
gtagaggaggaaatcctgatggaagcaaaagcggttgctagaacaataagaatcgcacctcgtaaagtaagacttgttcttgatttaatcagaggtaaaaatgctggagaagctattgctattttaaaattaactaataaagcttcatcaccagtgattgaaaaagtattaatgtccgctttagcaaatgctgagcacaactatgatatgaatacagatgaattagttgtaaaagaagcatatgctaatgaaggaccaactttaaaacgtttccgcccacgtgcacaaggacgtgcaagtgcaattaataaacgtacaagccacattacaatcgtcgtaagtgacggtaaagaagaagctaaagaagcttaa

SEQ ID NO: 2643 - DNA, 1848 bp, Staphylococcus epidermidis
ctacatttactattatgggaattagcactatcagtatttcactcattttttatatcatacaacgtatttcgaatatggaggagagcaataatgaatcataaggaatggcttttagctgacaaaaacatccaatatcgaacgattaacgcaatgattaaggaacatattgtttctgaaggtatgcgtattaaagaaggtacgtgtaaagttgaaatttttctcaataatcaccttttatcgttaaaagtagcgcgaaaaagtgccttaaaaagatacgtttttactggtgacatagtattaaaaaataaaaaattgtctcaatcaattgaaagtttagaagaacttcttcaaatactaacggaaatatttcatatcaacatttcaaaacgattatacgatgaattaatacatagtagggatagtttgtatgaaacgtacaaacatttttataatagacaaacactcattcatcagagtatgaaatttagtaaattacccgattctataaattttattgcttggctgcaacatttacaagatagtggtattacagatgatttaagttactcggaaagtcttgtgatagaagggcatccaacacatcctttaacaaaaactaaattgcctctcagtactaatgaattgaaactttatgcaccagaatttgaaaaagttattccattaaatattatgcttattgaaaaaaatcatgtagtaacaacagcaataaatgatgatcaaaattttattctaaatcaagttattcctgaatatcgagatcgtttaaaatgctacctcgagccacttcgattaaatcttaacgattacagagtgatgttgatacatccttggcagtatgatcatactatcggcgaacaatttgaagaatggatagccaagaaaatcttactacctacaccatttactgttgagtccaaagctactttatcatttagaacaatggatttaattcatacaccatatcatgtgaaattgccagtaaatgttcaagctacaagtgctgttagaacagtttcatcagttacgactgtagatggtcctaagttaagccatgcattacaaggattgcttcaggaatttccagaacttcaagtcgcgatggaaccttatggagcttatgctcacacggcatctgatttatcaaaacaattagcgcttatcatacgtcaaaaacctacgatatatgattatggttgtacagttgtaacagctagtttagttaatcctaatccaattgataatcaggcagttgtagatagttatttaaaatggatagaaaatgaaatcacacttgatcatattaagcattttatagcaatttatacacaaaccttagttacaccgcttattgcgtatattcaaaattatggcatagcacttgaagcacatatgcaaaatacgattgttaatcttggacctaattataaaatgaaattcattgtacgtgatttaggtggttctcgtatagatttaaatacacttaaacagaaagttcctcaaatagatgttacaaatgaaagtcttattgcagatactattgaagaggttattgctaaatttcaacatgcagttattcaaaatcaactagcagaattgattcatcattttaatcagtatgatgaagtaatagaagaagaattatttgaaattgtgcgtgaagaaatcgaaatggcaatcgataatgacaagccacatgctgaaaaattgaaaaaaatattgtttgggtcaactatcacagtcaaagctttattaagtatgagaatggaaaataaagtgaaaaaatatttaaataccaagttagataatccaataaaaaaagaggtgtag

SEQ ID NO: 2644 - DNA, 1353 bp, Staphylococcus epidermidis
aaagggagtttttttatgaatcttaagtctatcattactgtaatggcactcatactaataatgtttatggcagctatagaaacatctattatttcattagcattaccaacaataaaaaatagtttgaatgccggtaatctagtttcattagtatttaccgtatattttattgctttagtcatagctaaccctatcgttggtgaacttatgtctagatttaaaattatttacattgctgttgtaggggtattattgtttgccttaggtagtttaatgtcgggattaagtcagacgtttacttttttaattatctctcgaacagtacaaggttttggagcaggagttatgatgtcactctcacaaatagttcctaagttggcttttgaaattcctttgagatataaaattatgggtatagttggaagtgtttggggaatttcgagtattattggcccattattaggtggtgcgattttagagtttgcttcatggcattggctattctatatcaatattcctattgctatagtggcaataatacttgtacttatgacttttcattttcctgatgagacacaagtacaacagagtcgttttgatataaaaggattgattatcttttatatctttatagctttattaatgtttggtttactcaaccaacatcatattatttttaacatattctcaattattttagctttagctgttttatggctactatttaaaatagaaaatagtatcgaacaaccatttcttccaacaaaagaatttaacatatcaatagttctagtttttataacggatttacttattgcgataacactgatgggatataatttatatataccagtatatttacaagaaaaacttagtttatcacctttacaaagtggatttgtaatattcccgttgtctgttgcttggattacgcttaatttcaatttaggtaaaatagaagcgcattttactagaaaaacattatatatttgctcattttttgttttattagttagtagtctgatgataatgtttggcttaaaactcccattgcttattgcttttgcggttgtttttgcaggtttaagttttggttatatttatacaaaagatagtgttattgtccaagaggaaacttctccaaaaaatatgaaaaagatgatgtcattttatgcattgacaaaaaatttaggttcgtcagtcggatctacgattatgggctatatgtatgcactaaatgttggtttatttggttctaatttacacaatgtattaggattagtcttaataattgcagtatgtttaattgtaatgtggatgacattatataaaagcaatactattcaatcttag

SEQ ID NO: 2645 - DNA, 225 bp, Staphylococcus epidermidis
gcacacggtttcaagttctctttcactccccttccggggtacttttcacctttccctcacggtactggttcactatcggtcactagagagtatttagccttaggagatggtcctcccagattccgacggaatttcacgtgctccgtcgtactcaggatccactcaagagagaatatgttttcgactacaggattattaccttctttgattcatctttccagatga

SEQ ID NO: 2646 - DNA, 138 bp, Staphylococcus epidermidis
ccttgtctttgtttgtgttttggattatcacaaattaccattactttacctttacgtttaatgactttgcatttttcgcatattggttttactgatggtcttactttcatttttatacctccctatattatggagtga

SEQ ID NO: 2647 - DNA, 339 bp, Staphylococcus epidermidis
aaacttatttgggtgtgcggcgtaaagctgcacgcacacaataagaagggaggcgcccaaatggctcgtagtattaaaaaaggacctttcgtcgatgatcacttaatgaaaaaagtagaagctcaagacggaagtgaaaagaaacaagtgattaaaacatggtctcgtcgttctacaattttcccaaatttcattggtcatacttttgcagtatacgatggacgtaaacatgtacctgtatatgtcactgaagatatggtaggtcacaaattaggtgaatttgctcctacacgtacttttaaaggacatgcagcagacgacaagaaaacaagaagataa

SEQ ID NO: 2648 - DNA, 156 bp, Staphylococcus epidermidis
ttatttagttggatggggtactctgagctagacaatatttgtatgtggcaaacattatcgttgcactcatttgctttatatataagtagtaaatgtgtatttattaaggttagacaactaagttataacttgtgtcttaaaattagattaaactaa

SEQ ID NO: 2649 - DNA, 1323 bp, Staphylococcus epidermidis
tgcaaaaggtggagcacacgaggtgatctaatgtttcaaacgtttgtacgtttctttacaactaaagaagtacgaaacaagattttcttcactctagcaatgttagttatttttaaaataggaacgtatattcctgctccaggagttaatcctgaagccttcaatcatccacagggatctcaaggtgccactgagttattaaatacttttggtggcggtgccttgaaacgtttctcaatatttgcgatgggaatcatgccttatatcactgcatccatcgtcatgcaattactgcaaatggatattgttcctaaatttacagagtgggcaaaacaaggtgaaatgggtagaagaaaaattaataacgtaactcgttattttgctataattttagcttttatccaatctataggtatggctttccaatttaataactatctcaaaggacaacttattatagaaaagtctgttatgagttatttattaattgcagttgtattaacagcgggaacagctttcttaatttggcttggtgaccaaatcacacagtttggtgttggtaacggtatttctcttatcatctttgcaggtatattatcaactttaccttcgagtctagaacaatttgcacaatcagtgtttgtgggtcaagacgatacttcacttgcttggctgaaaatactaggattgatagtagccttgattttactaacagtaggcgcaatatttgttcttgaagctaaacgtaaaatacctattcaatatgcaaagaaacaatctgctcaacgattaggttcacaagcaacttatctacctttgaaagttaactctgccggtgttattccagttatctttgcgatggcgtttttcttgttaccaagaactttgactttattcttcccgaaagcagaatgggcacagaatattgctgatactgccaacccgtcaagtaatattggaatgattatttatgtagttttaattattgcatttgcatatttttatgcttttgtacaagttaatcctgaaaaaatggcagataaccttaaaaagcaaggtagttatgtcccaggaattagacctggtgaacaaacaaaaaaatatattactaaagtactttatagattgacttttgttggttcaattttcttagcagctatagctattttacctattattgcgactaaatttatgggcttaccacaatcaattcaaattggtggtacgagtcttttgatcgttattggtgtagctattgaaactatgaaaactttagaagcacaagtcactcaaaaagaatataaaggctttggtggtagataa

SEQ ID NO: 2650 - DNA, 123 bp, Staphylococcus epidermidis
atagtattgcttttatataatgtcatccacattacaattaaacatactgcaattattaagactaatcctaatacattgtgtaaattagaaccaaataaaccaacatttagtgcatacatatag

SEQ ID NO: 2651 - DNA, 291 bp, Staphylococcus epidermidis
ggaggtgctcgcataatggaagcaagagatgttcttaagcgccccgtaatcactgaaaaatcttctgaagctatggcagaagataaatacacttttgatgtagatactcgtgcaaataaaacacaagttaaaattgctgttgaagaaatcttcgacgttaaagttgatagtgtaaatattatcaactacaaacctaagaaaaaacgtatgggccgttaccaaggctatacaaacaaaagaagaaaagcgattgttaaactaaaagaaggttcaatcgatttatttaactaa

SEQ ID NO: 2652 - DNA, 366 bp, Staphylococcus epidermidis
aaacaacagctacatcatggaaaaacaaataatgtaagggaggatattcaaatgaatagagatgaggtacaattactcggatttgaaattgttgcctatgctggggatgcacgttcaaaattattagaagctttaaatgctgctaaagatagtgaatttgataaagcagaacaacttgtagaggaagcgaatgaatgtattgctaatgcacataaagcacaaaccaatcttctagctcaagaggctaaaggcgaggatatcgcatatagtatcactatgattcatggtcaagaccatttaatgacaacattacttttaaaagatttaatgaagcatttaattgaattatacaaaaaagggagctga

SEQ ID NO: 2653 - DNA, 669 bp, Staphylococcus epidermidis
ataatttgtaggagggcatttatgaatatcattttaatgggcttacctggtgcaggtaaagggactcaggcgagtgaaattgttaagaaattcccaataccacatatttctactggtgacatgttcagaaaagcgattaaagatgaaacagatttaggaaaagaagctaaatcatatatggatcgtggagaattagttcctgatgaagttactgtaggtatcgttaaagaaagaatttctgaagacgatgcaaaaaaaggattcttgttagatggattcccaagaactatagatcaagctgagtcattaaatcaaattatgtctgagcttgatagagaaattgatgctgtcattaatatcgaagttcctgaggaagaattaatgaatcgtcttacaggtcgtcgtatctgtgagaaatgtggtacaacatatcatcttgtatttaatcctccaaaggttgatggtatatgtgatatcgatggtggaaagttatatcaacgtgaagatgacaatccagaaacagtatctaatcgtttgagcgttaatgttaaacaatctaaacctattttagaatattacaacaacaaaggtgtcttgaaaaacattgatggttcaaaagatattgacgaagtaaccaacgatgtcattgatatcttagatcatttataa

SEQ ID NO: 2654 - DNA, 180 bp, Staphylococcus epidermidis; identical to SEQ ID NO: 2466

SEQ ID NO: 2655 - DNA, 828 bp, Staphylococcus epidermidis
agttgtataaggagtggcatcatgaagaataaattaatcattggacgatatcttcctatgcaatcaattattcatcagcttgatcctagagctaagttaatatttgtctttttctttattattttaatttttttctgtcattcactaggtacatatgcatggttgtttctttttataatattatttattaagttagcacgcattcctttttggtttttaattaaaggattaacacctatctttttcttcttggttttcactttttctatgcatgtgttatttactaatggaggtatcgtattatttcaatggaaatttatcactattgaatcaagtggtgttatggaaggaatttatatatcactaagattgatttttatagttatgattgcaacaatcatgacactttcgactagtccgattgatttaacagatgcttttgaaaaattatttgcacctcttaaagtgattaaagtaccagtacatcaattaagtatgatgatgtctattgctctaaggtttataccaacgttaatggatgaattagaaaaaattatacttgctcaaaaatctagaggatcagaaataagttcaggaagtttaataacacgaattagagcttttatacccatcatgattccattatttatttctgcctttcaaagagcagaagaactagctatagcaatggaagtcagaggttatgatattaacatcaaacgaacaagctataggttattacattggcaatataaagacacattaacagtcttacttttaatacctatcgctactatattatttattttaaaattttcaggagtgtaa

SEQ ID NO: 2656 - DNA, 423 bp, Staphylococcus epidermidis
gagtctgaaaggaggcaacaatcaatgacaatgacagatccaatcgcagatatgcttactcgtgtaagaaacgctaacatggtgcgccacgagaaattagaattacctgcgtctaatattaaaaaagaaattgctgaaatcttaaagagtgaaggtttcattaaaaatgttgaatatgtagaagacgataaacaaggtgttattcgtttattcttgaaatatggtcaaaacaatgaacgtgttatcacaggtttaaaacgtatttctaaaccaggtttacgtgtttacgctaaagcaaatgaagtgccaaaagtattaaatggcttaggtattgcattagtttcaacttctgaaggtgttatcactgataaagaagcaagaaaacgtaatgttggtggagaaattatcgcatacgtttggtaa

SEQ ID NO: 2657 - DNA, 867 bp, Staphylococcus epidermidis
aaaattatgagtatacaatttaatcaagtgagttatatttatcaacaagggacaccttatgaatttgaagctattaaaaacgtttcactaactcttgaacagggcaagtattatgcaattattggtcaaactggaagtgggaaatccactttgattcaacatttgaatgctttattaaagcccactacaggttcagtcaacattaatggtttagaagttacaaataaaactaaagacaagcacttacgtcacataagaaaagaagtaggtgtagtatttcaatttccagaatcccaattatttgaagatagtgttgaaaaagaaattgagtttggacctaaaaattttaatatgaacctaaaaaatgttaaagataaagcttttcaacttcttcttgaattaggcttttcaagaaatgtgatgtcatcctctccatttcaaatgtcgggaggacaaatgagaaaaatagccattgtttccattttggctatggatccacaagtaattattctagatgaaccgactgctgggttagacccaaatagtaaacaccaagtcatgtctttaataaagaaaatacaaatagaagaaaataaaacgattattcttgtttcacatgatatggatgatgtagcacgttattcagatgaggttgtagtaatgaataaagggacgatagtagaaaaatcaaatcctagaaatttatttaatcaaaaaacgcaattattaaagtggcatatagagttgcctaaagtagtgaaattacagaaagatatcgaaaaaaaatataatatgttatttccaaagcttgccacgaatgaagaagagtttgtgaagttgtataaggagtggcatcatgaagaataa

SEQ ID NO: 2658 - DNA, 135 bp, Staphylococcus epidermidis; identical to SEQ ID NO: 2475

SEQ ID NO: 2659 - DNA, 558 bp, Staphylococcus epidermidis
ataataaggaggtgccataacatgagtcgtgttggtaagaaaattattgacattcctagtgacgtaacagtaacttttgacggaagtcatgtcactgtaaaaggtccaaaaggtgaattagaaagaactttaaatgaaagaatgacatttaaacaagaagaaaacactgttgaagttgtaagaccatctgattctaaagaagacagaacagatcatggtacaactcgtgctttattaaataatatggtactaggtgtttctcaaggttatgaaaaaacacttgagcttgttggtgtaggttaccgtgcacaaatgcaaggtaaagatttagtacttaatgttggatactctcacccagttgaaattaaagcagaagaaggcattactttcgctgttgagaaaaatacaactgttaaagtatctggtgtttctaaagaacaagttggtgcgattgcttctaacattcgttctgtaagacctccagaaccttataaaggtaaaggtattcgctaccaaggtgaatatgtacgccgtaaagaaggtaaaactggtaaataa

SEQ ID NO: 2660 - DNA, 1047 bp, Staphylococcus epidermidis
atgaagaggagatgtgtgttcatgagattaagtttacttgattatgtcccgttgttcgaagggcgtaccccaaatgacgccctaaagcatagtattaaattagcccaacacgctgagaaacttgggtacttacgatactgggttgcagaacatcatcaagtttattctgtcgtttctagtgcacctgaaataataatgatgtcgattttagaacacacacaacacatcagagttggtagtggaggtgtgatgttaccacattatagtccttataaagtagctgagcaatttaaaattatggaagcaagacacccccaacgtatcgatatggctatcggacgttcgccaagctttaaaaatgttaatgcagcactaaatgaaaacaaaaatgaaaaattaccattcaatactcagattactgatttgcttaaatacttcaataacgatacaactcaagaccatcgttttaaatcattattagctacacctatggttacttcatttcctcaactatatattttaggtatgagtaatagaagcgcaaaattagctgctcagcgcggactaccttttgttattgcacgaatgggacaatctgagacagaccttcatgaagctataagcacttatagaaaatattttaaagcttatcatggtgaaattaataatgcgaaaccatatgttattttagcaacttttgtggtaacagcttctaatttatctagagttaaacaattgctacatacgcttcaactttggttgatgcgtattaactatttaaatcaacctaagagttatccatcgattgaaacagcacagaacaagcattatagtcaacgagaattagaaaagcttgaaaagatgaaatcgaaaatcatatacggaatgccaaatgatgttgcggaacaacttaccttacttcatcaacaatttaaagtggatgaaatcatcatcttacctcatgtatttggtgaagacgctagaatggaattaattgagttaattgcgaatgaattgattccatcttgttcacgcgatgaattttag

SEQ ID NO: 2661 - DNA, 231 bp, Staphylococcus epidermidis
acatacaatggaataagtaaagcaggtcctaccatagataacataatgatcatagaagtaattgtagaaaaacaaaatattttgttattaaatattttcaaatttaataatggattagaaattgtaatttgtcgtttaacaaaaatgccaatgatgattaaacttattaaaagtgaacaaagaacaattgggttagaaaaacctaggttaccagcactactgaaagcataa

SEQ ID NO: 2662 - DNA, 648 bp, Staphylococcus epidermidis
aaagcgaaaggaggaaattgcataatggctaattatgatgttttaaaagtagacggatcaaaatcaggttcagttgaattaaacgatgcagtatttgctattgaacctaataatagcgttctattcgaagctattaacttacaacgtgcgtcattacgccaaggtactcacgctgttaagaatcgttcagcagtacgtggtggtggacgtaaaccatggagacaaaaaggtacaggtcgtgcacgtcaaggtacaatccgtgcgccacaatggcgtggtggtggtgtagtattcggaccaacaccaagaagctatgcatataaaatgccaaagaaaatgcgtcgtttagcattacgttctgcattatcttttaaagttcaagaaaatagctttacaattgtagatacttttggttttgaagcaccaaaaacaaaagaattcaaaaatgtattaactactcttgaacaacctaagaaagtattagttgtaacagaaagcgaagatgtaaatgttgaattatcagcacgtaacattcctggtgttcaagttacaactgctcaaggattaaatgtacttgatctaacaagcgctgacagtgtaatcattacagaagcagctgcgaaaaaagttgaggaggtgctcgcataa

SEQ ID NO: 2663 - DNA, 558 bp, Staphylococcus epidermidis
ttgaaaggaggatccactttgaaccgtttaaaagaaaaatttaatacagaagttactgaaaacttagtgaaaaaattcaattatagttcagtaatggaagtaccaaaaattgaaaaaatcgttgtgaatatgggtgtaggtgacgcagttcaaaattctaaagttttagacaacgctgttgaagaattagaattaattactggtcaaaaaccattagtaacaaaagctaaaaaatcagttgcaacattccgtttacgtgaaggtatgccaatcggtgcgaaagtcactcttcgcggagaaagaatgtatgaattcttagacaaactcattgcagtttcattaccacgtgtacgtgacttccaaggtgtttctaaaacagcttttgatggtcgtggaaattacacacttggtgttaaagaacaattaattttcccagaaattgactacgataaagtaacaaaagttagaggaatggatattgttatcgtaacaactgctaacactgacgaggaagctcgtgaattgttaacaaacttcggtatgccatttcgtaaataa

SEQ ID NO: 2664 - DNA, 168 bp, Staphylococcus epidermidis
tatttttatatcactaaacattctacaataattcaaattgactgtatatcagatatgtataatttaatcatttgtaatatgaattataaaaaaagctatagtgttattaactatagcttaaataaaaaagcgcgcaccccatcaaatgttgagttcacgcttaaataa

SEQ ID NO: 2665 - DNA, 360 bp, Staphylococcus epidermidis
atgataaatattatattgaagaaaatagacttggaggtaattagaatgttcgttgttacaaatagaatcactgtaaaaaaaggatatgcaaaacaaatggcgcctaattttactaaaggaggacctattgaatctttaaagggctttgaaggtattgaagtttggcaaattgataaagatgattatagcgaagatatgtatgtaaatagttggtgggaaactgaagaagattttaaaaattgggtgaatagtgatgtatttaaacaagcacataaaaatactggaaaatccgaagattcaccagtcattaaaagcgaaattgttaaatcaaatgttttatcttctttgaacagaagataa

SEQ ID NO: 2666 - DNA, 807 bp, Staphylococcus epidermidis
atattgcgtatattagttgaaattgcttatcaaggtaaccaatttttaggttttcaaattcagcaacaaggacgaactgttcaacaacaatttgaaaagattcttaaacgaatgcataaacatcatgtacgaattcatccttcaagcagaacagacaggggtgtacatgcgtatcagcaattctttcatttcgataccgaattgaatattgataacaaacaatggcaatatgcgatgaatcgagctttaccagatgatatttacgttaaaaatgtacgaaatgtcgacgagtattttcattgtcgttatgactgcgtaggcaaacgctatcgttacaaagtttatcaaggtaatcatcgaaatccttttaagagtggtactgaaacatttgtttatgaaacattagactatgataaaatgaacaaagctgcgcaagaatttataggtacacatgattttaccggtttttgttcacagaaaacagaagttgaaagcaaagtaagaacactatatcagagcgaaattgttgctactaaagaagggtttgattacgtcgtaacaggttctggattcctttataatatggtccgtgtattggtagctttcttaattgaagtaggaaaaggaaagcatgaacctaatgacgtccctaagctcttagaggacaaaaatagaaataatgtgcctctcacagctccacctgatggattatatttagaaaagatttatttaagcccagaagaattgatacaagaatatggaaaagatataaaaatacactacaaaaaatcgttggaaaaacactaa

SEQ ID NO: 2667 - DNA, 123 bp, Staphylococcus epidermidis
aacagattcattattttagaagtttatcatttactatcttacgaatttaaaatttatattgtagctttcaatatcaacttttactttttatatgattattttgattttcaaaaatactactga

SEQ ID NO: 2668 - DNA, 1044 bp, Staphylococcus epidermidis
cacaatagcataaactactattataaggatgatgatgatatgaataatgaacaaatagtatttaataaagtaccagacggaatgccacaagacgatacatttaaatatgaagatatagatgttattgaaccttcagaaaatgaattgcaattgaaaacattatatatatcggttgatccatatatgagaggacgtatgacaaatgctgattcttatatagatccgttcaaacaaggggaaccgttcaatggacatacggtatctaaagttttgaaatccaaggatagtaattttgatgaaggtgatatagtagtgggtatgctaccttggagaaaaataaatacagtaaatagtgagtatgttaacaaagtacctacttctgacgtaccattacatctttatcttagtgtgttggggatgcctggtcagactgcttatcatggattacttgatattggacaacctaaagaaggtgaaacagtagttatttcagcagcttcaggtgcagttggttcagttgtgggccaaattgcgaagcttaaaggttgcagagtcgttggtatagctggtggagataaaaaagtgaactatctaaaaaatgaacttcgttttgatgctggtatcgattacaaaaaagataatttccctgaagcgttaaaagaagcggtgcctaacggtatagatgtctacttcgaaaatgtaggtggatatattggcgatgaagtcttcaaacatctcaatacacatgcaagaattcctgtttgtggtgcgatttcatcctataatcatccagaaaaagatattggaccacgcattcagcaaacattgattaaaaatcaagcaatgatgagaggtttcatagtagcagaattcgctgatggttttaaagaagcgagcaaacaattagctcaatgggttcaagagaataaaattaaaacacaagtttcagtagaagatggttttgataaagtgccgcaagcctttagaaatctgctaactggtgataattttggtaaacaagttattaaagtggcaagtgaataa

SEQ ID NO: 2669 - DNA, 1236 bp, Staphylococcus epidermidis
tccatattaatgataatgataattattatcaatgaaaaagacaggtggaatttgatggcaaaatatttcttttccagttcttttctgttatttttaggaaattggattggtcaagtgggtttaaattggttcgtactcacaacatatcataatgctgtatatttgggtttagttaatttctgtcgtcttatacctattttactattaagtgtttgggcaggatccatagctgataaatatgacaaagggcttctgttacggatcactattacttcatcattcataattacagcattattgtgtttacttacttatagtcttaacagtataccgattttcatcattcttttatatgcaacatttaggggcatactaagtgctgtagaaactccagtgagacaagcagttttacctgatttatctagtaaaatttctacaactcaagcagtttcttttcattcgttcattattaatatatgccgatcaataggaccagcaatagcaggtggattaatagctgtataccatacacccactacatttttagctcaagcagtgtgctattttatcgcagcagttttatgtatacctattcattttgaagtcatattaagtcaaaaagaaggaaaagcactaccacttaaagttgtactaaattattttaaaagtaatttagaaggtagtcagatattcattacgtctataattattatggcaacaggcttttcttacactacagttttaccagtattaacaaaccatatttttcctggtcaatcgcaagtgtttggtatagctatgactttttgtgcgattggaggaatagttgcaacaatagtcttaccatcaattttaaaacacttgagtacagtaaaaatgtattatctcagttcaatattatttggtatagctttactaggtattatcatacatcatttagtagttatgtttatctgtattacgttaataggcttgtttagtcaatgggctagaacaactaatagagtttattttcaacatagtgtaaaggactgtgatagagggaaagtattaagtattataatgatggatcgaggtatgattccgttaggtagtttaataatgagctttttcgcggatatgttcggtattttaactacatttactattatgggaattagcactatcagtatttcactcattttttatatcatacaacgtatttcgaatatggaggagagcaataatgaatcataa

SEQ ID NO: 2670 - DNA, 540 bp, Staphylococcus epidermidis
aatgtgttaataggaggaataaaaatgaaaattgcaataggttgcgatcatattgttactgatacaaaaatggaagtttcacaacacttaaaatcacagggacatgaagtgatagatgttggaacttatgatttcacacgtacacattatccgatttatggaaaaaaggtaggagaaaaagttgcgagtggtgaagcagatttaggtgtatgtatttgtggtactggtgtaggaattagtaatgctgcaaacaaagtaccaggtgttagaactgctttagttagagatatgacatcagcgctttattctaaagaagagttaaacgccaatgttgtaagttttggcggtaaagtagcaggtgaattatttattttcgacatcgttgatgcattcattgaggcagagtacaaacctactgaagaaaataaaaaattaattgctaaaatcaatcatttagaagcacataacaatgaccaagctgatccacatttcttcgacgagttcttagaaaaatggaataaaggtgaatatcacgattaa

SEQ ID NO: 2671 - DNA, 879 bp, Staphylococcus epidermidis
agagggctaatgatgaagtcaaaattcacaattctattatttacaatcttttctacaacagtattagttttggttattatttataacaaaactcaatcccaatcatacatttcgactcactattctaataataaaataaaaacaacagcaacactttttttacatggttatggtggtagcgaacgctcagaaacgtttatggtcaaacaagcgttaaataaaaatgtaaccaatgaggtgataaccgctagagtgagtagtgaaggaaaagtatattttgataaaaaattaagtgaagatgcagcaaaccctattgtcaaagtagaatttaaagataataaaactggaaattttaaagaaaatgcttattggattaaagaagttctatcacaactaaaaagtcaatttggaattcaacaatttaattttgtaggacattcaatggggaacatctcatttgctttttacatgaaaaattatggggacgatcgacatttgccacaacttaaaaaggaagttaatatagcgggagtttataacgggattttgaatatgaatgagaacgtgaatgaaattatcgttgataaacaggggaaaccaagtagaatgaatgccgcatatcggcaattgttatcactgtataagatttattgtggtaaggaaatagaagttttaaatatctacggagatttagaagatggctcacattcagatggacgtgtgtcaaatagctcttctcaatcgcttcaatatttactaagaggtagcactaagtcttatcaagaaatgaaatttaaaggtgcaaaggcacaacatagtcaattacatgagaataaagatgttgcaaatgaaatcatacaattcttatgggaaacttaa

SEQ ID NO: 2672 - DNA, 450 bp, Staphylococcus epidermidis
aggaggaaaataataatgttactaccaaaacgtgtaaaatatcgtcgtcagcatcgtccaaaaacaactggtcgttctaaaggcggtaactacgtaacatttggtgagtatggattacaagctacaactacatcttggatcacatctcgtcaaatcgaatcagctcgtattgcaatgacacgttacatgaaacgtggcgggaaagtttggattaaaatcttccctcatacaccatatactaaaaaacctttagaagtacgtatgggtgctggtaaaggtgcggttgaaggctggatagcagttgttaaacctggtagaattttattcgaagtagctggtgtacctgaagaagttgctcgtgaagcattacgtttagcaagtcacaaacttccagtaaaatctaagtttgtaaaacgtgaagaattgggtggtgaaacaaatgaaagctaa

SEQ ID NO: 2673 - DNA, 768 bp, Staphylococcus epidermidis
atgatagaaattgaaaaacctagaattgagacaattgaagttagtgaagatgctaaattcggtaaattcgttgttgaaccacttgaacgtggctatggtactacactaggaaactccttacgtcgtatcctactatcttcattaccaggtgcagccgtaaagtacatcgagattgaaggagttttacacgaattttcagcagtagataatgtagtagaagatgtttcaacaatcattatgaacattaaaaaacttgcattaaaaatttactctgaagaagataaaactttagaaattgatgttaaagatgaaggcgaagtaactgcaagtgacattactcacgacagtgatgttgagattttaaatccagagcttaaaatcgcaacagtgtctaaaggtggacatcttaaagtgcgtcttgttgctaataagggtagaggttacgcattagctgaacaaaataatactagtgatttaccaattggtgtaattcctgttgattcactatattcacctgttgaacgtgtaaactatacagttgaaaatacacgcgtaggtcaaagtagtgattttgataaattaactttagatgtttggacaaatggttcaatcacaccacaagagtcagtatcattagcagctaaaataatgactgaacacttgaatatctttgtaagtctaactgatgaggctcaaaacgctgaaatcatgattgaaaaagaagaagatcaaaaagaaaaagtaattgaaatttctatggaagaataa

SEQ ID NO: 2674 - DNA, 129 bp, Staphylococcus epidermidis
gttgtagaaattttactagataaatcaggtaaaactgcttgtctcactggagtttctacagcacttagtatgcccctaaatgttgcatataaaagaatgatgaaaatcggtatactgttaagactataa

SEQ ID NO: 2675 - DNA, 408 bp, Staphylococcus epidermidis
aaggaggaaattacattggcacaagttgaatataaaggcacaggccgtcgtaaaaactcagtagcacgtgtacgtttagtacctggcgaaggtaacattactgttaacgaacgtgatgtacgtgactacttaccattcgaatcattaattttagacttaaatcaaccatttgatgttacagaaactaaaggtaactatgatgttttagttaacgtacacggtggtggatttactggacaagctcaagcaatccgacatggaattgcacgtgctttattagaagcagatcctgaatacagaggttctttaaaacgcgctggattacttactcgtgacccacgtatgaaagaacgtaaaaaaccaggtcttaaaaaagcacgtcgttctccacaattctcaaaacgttaa

SEQ ID NO: 2676 - DNA, 129 bp, Staphylococcus epidermidis
aattatatgattattaacggtattgttttatatcaccccacgataagccccggaaacttattgtgttacaagatatataagcaaagcagaacaacagttaatgaaataaatgaaatcttacgcttttaa

SEQ ID NO: 2677 - DNA, 168 bp, Staphylococcus epidermidis
aataatacgatacctccattagtaaataacacatgcatagaaaaagtgaaaaccaagaagaaaaagataggtgttaatcctttaattaaaaaccaaaaaggaatgcgtgctaacttaataaataatattataaaaagaaacaaccatgcatatgtacctagtgaatga

SEQ ID NO: 2678 - DNA, 1428 bp, Staphylococcus epidermidis
aaaggagttttatatatgactaagaaattacctgatgactttatttttggtggagcaaccgctgcttatcaagcagaaggagctactcagactgatggtaaagggcgtgtcgcttgggacacgtatttagaggagaattattggtacacagctgaaccagcaagtgatttttataacagatatcctgttgacttggaattaagtgaacgctttggtgtaaatggtatacgtatctcaattgcttggtctcgtatttttcctaaaggttacggtgaagtgaatcaaaaaggtgtcgagtattatcataatcttttcaaagaatgtcataaacgtcatgttgaaccttttgtaacattacatcactttgacacaccagaggtacttcacaaagatggagatttcttaaatcgtaaaacaatagactattttgtagattatgctgaattttgttttaaagaatttccagaagttaagtattggacaacattcaatgaaattgggccgattggtgatggtcaatatttagttggtaaattccctccaggtatcaaatatgactttgaaaaagtattccaatctcatcataatatgatggttgcacacgcacgtgctgttaaactttttaaagatgaaaattataagggagaaataggtgttgtccatgcattacctacaaaatatccatatgatccatctaatcctgaagatgtgagagcagccgaacttgaagacattattcataataaatttattttagatgcaacataccttggtaagtactcacgtgaaacgatggaaggagtacaacacatcttatctgtgaatggtggtcaattagagatttctgatgaagactacaaaattttagatgaagctaaggatttaaacgatttcttaggtattaattattatatgagtgactggatgcgtggttttgaaggcgaatctgaaataacacataatgccactggtgataaaggtggatctaagtatcaacttaaaggtgtaggacaacgtgaatttgatgttgatgttcctagaaccgattgggattggatgatttatccacaaggtttatatgaccaaattatgcgtgtagtaaaagattatccgaattatcataagatttatattactgaaaatggattaggatataaagatgtattcgacgaaaaagaaaaaacagtacatgacgatgcacgaattgactatattaaacagcatctaagtgtgatagcagatgcgattgcagatggtgccaatgttaagggatacttcttatggtctcttatggatgtattttcatggtcaaatggttatgaaaaaagatacggtttattctacgttgattttgaaacacaagaaagattccctaagaaaagtgcatattggtacaaagaacttgcagaaagtaaagaaattaaataa

SEQ ID NO: 2679 - DNA, 279 bp, Staphylococcus epidermidis
ttaaaggaagtgttttcaatggcaatgacagttaagaaaaacgataatgaagttcgtattcaatggagagtagcagatatcaaaattccaaataatgaaattaaaaatgttactcaagatcaagatattcatgccgtaccagaagagaatggtaaagaaatctctcgtattggttctactttcggaaaaacaaatcgcgtattaattgataccgatcaacacttatatattatttacactcaaaatgatcaaaaagtatataatgagttaacaaaataa

SEQ ID NO: 2680 - DNA, 189 bp, Staphylococcus epidermidis
gcagttctattcgtatatgatttatatttttattttttaatgggccatcaaaatgatattgtgacatcaataagagcctgtacattaatttgtaatgtatcaggctctataactaaaaaatacgatattgaaactatcaaatttactacatcttacgtaataaaaataagaaataaggtgcgcctataa

SEQ ID NO: 2681 - DNA, 144 bp, Staphylococcus epidermidis
tggattatatttagaaaagatttatttaagcccagaagaattgatacaagaatatggaaaagatataaaaatacactacaaaaaatcgttggaaaaacactaattgtcattgacaaaagtactgtgaaattatatgattattaa

SEQ ID NO: 2682 - DNA, 165 bp, Staphylococcus epidermidis
accttattttcatatgatttggcatatatttattgttcttgcttctttcttacatatgataggcattttttattttatgtgattgcaacattcagtcattataagttagagagaaaaataagtattatttttagaaatatcattatacttcaaataaacacatga

SEQ ID NO: 2683 - DNA, 342 bp, Staphylococcus epidermidis
agtgttcgctcatgtgaaattaattcaatctgtaggtcatcactcgaacatcctacaaagcgtgtgcttgctccctgttgtggtaaatgtagagccttttattttcaaaatgatgtagttattgccaaaacatcaatgacaactattcaacttcaacccaaacaagttattaatatgatgacgcaattacaggatgcaagtattattttcaaacaaacggattgtctccataatgctgctatcagtgatgtaaaagattttttgaacatcaccacgatatcgtacgtcataacactcttgataaattatacggttattatattcaacgacatataccggtga

SEQ ID NO: 2684 - DNA, 213 bp, Staphylococcus epidermidis
tgtaaaagattttttgaacatcaccacgatatcgtacgtcataacactcttgataaattatacggttattatattcaacgacatataccggtgagagataagattttgatttttagcggtcgtatttcattagaaattttaatcaaagcagctaaaattgatgtaggaattatattctctaaatcttccctacttcacttcaatacaacttga

SEQ ID NO: 2685 - DNA, 123 bp, Staphylococcus epidermidis
acacgtatatctagaatttttaaattttggtttgcaaagcaacttatgaagctacgacaaccaattaatctctactcgtattctagtcatatgatttttatcgtgctaatatattattcgtaa

SEQ ID NO: 2686 - DNA, 126 bp, Staphylococcus epidermidis
aatttaccatctgaagataatcgagcacgcgtacatgtggagcaaaatgattcagatacactcgtaattagaccaaattgtgcatcattatctttatgtcgaaaatatttagcaacttccccataa

SEQ ID NO: 2687 - DNA, 144 bp, Staphylococcus epidermidis
tttttaattcctgcaaacaacataatccatgtagcaaaaataaatggccatgttaaagttggtaaacctagtggtgcgagcaatgtgctcaaacctaaatgtatgaatgcagtgagtactattcctaaaatcattgcgagataa

SEQ ID NO: 2688 - DNA, 126 bp, Staphylococcus epidermidis
tcgaatgttccaataactaaagcactgatactagagataagcattgacggtactgtagagattctaaatattaaacataaaattatgataataagtggaatccatacccaaaaattcaagttataa

SEQ ID NO: 2689 - DNA, 282 bp, Staphylococcus epidermidis
ttagtaatgttattaaatatcatagaaggagtgacgcatatcaatcctaaagtattaaaagctctagcaatcacatctaatgtactattagttattggaatcatctgtttaattatgctaaagctcatgttagctattgcattttttgttgtatcattaacaattagtctcgtcatttttaatgttatgttcagacaccgtacaggtatgaaaattgcaattaatgtctcgttctttatagtgatgattgctatcgtaatagcctattttgtattatcttaa

SEQ ID NO: 2690 - DNA, 180 bp, Staphylococcus epidermidis
ctacactaccccaaaacagggctggtaaaagtgctatcaaaaaatctacaatttgcacttattactcactctcctaagaacaaaattaagtgtcccaactacactcgaaatcattctatagtaattaaaaaaataagtaaaaaacaacaccttaaaagtgttgaaatttttagtaagtaa

SEQ ID NO: 2691 - DNA, 498 bp, Staphylococcus epidermidis
ttacatccacctgaattaatcagtattcaaattattaaaattgctccaatctattcttgtgtaagaatagattggattttttatttaatagtaatgtttgtgagaggccattgcctcgaagttacgaatttgagaaaatggttctattactttaataggaggaataaaagaatgcaatggcttaaagttatattagccggttttattgaaatcatctgggtcactggacttgatcaagcgcactcattgtttacatggatattcaccctcttttttattgctttaagcttttttctagtcattgatgcttcgaagcacttaccagttggtacggtatatgcattttttgtcggaataggtgctgttggtacagtgttagttgatatgattttcttcaaccaaccatttactttcactaaaatatttttaataatgacccttattttaggaataataggattaaaactgacaactgatgcaacgaaagaagggagataa

SEQ ID NO: 2692 - DNA, 411 bp, Staphylococcus epidermidis
gcaattgagttttatcacacaaacacaacatccaagaatcaacttaggaggcatattattatgagtaacaaagtacaacgttttattgaatcagagagagaattaagtcaattaaagcattggcttaaaacgacatatcgtatttctattgaagaatttgtagttctttacaaggtctatgcagacactaaaattagtggtaaagagttacgagacacattacatttcgagatgttatgggatacaagtaaaattgatgtgattattcgtaaaatctataagaaagaactcatttctaaattacgctcagaaaccgatgaaagacaagtttactatttcttcgatgcaaagcaaaagaaattattggacaaaatgactggagaaattgaaacaattagtattgcaaattaa

SEQ ID NO: 2693 - DNA, 279 bp, Staphylococcus epidermidis
ccaagccatactttttatctcccttctttcgttgcatcagttgtcagttttaatcctattattcctaaaataagggtcattattaaaaatattttagtgaaagtaaatggttggttgaagaaaatcatatcaactaacactgtaccaacagcacctattccgacaaaaaatgcatataccgtaccaactggtaagtgcttcgaagcatcaatgactagaaaaaagcttaaagcaataaaaaagagggtgaatatccatgtaaacaatgagtgcgcttga

SEQ ID NO: 2694 - DNA, 123 bp, Staphylococcus epidermidis
ataatttggttatatagtactgttgttattaataaaattttaagcgttatatataatagtaaagtaaatggtaaaatttcattttataatgcagttctagtaaatattttaatcattacataa

SEQ ID NO: 2695 - DNA, 138 bp, Staphylococcus epidermidis
attattatcacgtttaaacagtggatacattctacaaatctaaccaaacctggtgacaaaacaacaattaacattcttgttggatttttacgtgatgatgatatcaatcgtagtatgatatatgttaaatctgcttag

SEQ ID NO: 2696 - DNA, 438 bp, Staphylococcus epidermidis
cagtccatcacccaatcgtttaaggaggctatatcaatgattcctggtgaaattattgttaaaaatactgaaatagaagtcaataaacatcatcccgaaacggtgattgaagtgaaaaatacgggcgatagacctatacaagtaggttcacatttccactttttcgaagcaaataaggcattagaatttgatcgtgagaaagcatatggtaaacatttggatattcctgcaggagctgcagtgagatttgaacctggagatgaaaaaaaagtacaacttgtcgaatattctggacgacgtaaaatttatggattccgtggtttagtcgatggcgatattgacgaagaacgcgtattccgtccaaatgattcaaatcaaaacgccgccgttaaaaacgatgcaggcgaagacaatgcgaataaaaaaggtggtaaataa

SEQ ID NO: 2697 - DNA, 150 bp, Staphylococcus epidermidis
tattgttacacaatctcatttaacccaatatatttatgtaatatgaatagaaatgatacgcacagcatttttaaagtatttgattttgagcaacacaaatattgttacatgaatgtaaaattactgaaaattcattttgataataattaa

SEQ ID NO: 2698 - DNA, 177 bp, Staphylococcus epidermidis
actaatttaacgaggtgccttatgtataaagactataacatgactcaacatactctactaatggaaacttcagttcttatccccacaaatgatatttcacgacatgtaaatgatattgcagaaacaattcccgatactgaattcgatgaattcagatatcatcgtggcttaatataa

SEQ ID NO: 2699 - DNA, 189 bp, Staphylococcus epidermidis
actaaattaacaaggtgccttatgtatagagattataacaagactcaacttactctaccaatggaaacttcagtacttatccccacaaatgatattacacgatatgtacataatattgtagaaacaattctagagactgaattcagacatcatcgtgattcaacatcataccatccaaaaatgatgtaa

SEQ ID NO: 2700 - DNA, 126 bp, Staphylococcus epidermidis
gattgtgtaacaatattagcaaaaaattacaaatcaataacattgcacacaaacatcaatttttctgttagagtatggcttgtcgttaaacaagaacgaataaaaatttattttgtaactcattga

SEQ ID NO: 2701 - DNA, 666 bp, Staphylococcus epidermidis
tatagtccaaccaggagatacaattgcgctcattccaccggtcagtgggggttgatcaagatgaaagcaattattttagcaggtggagaatctagccgatttggtaaagctaaagcttttgctaaaattgataatcaatatttttatcaaaaaattatagaaacgttaaaatctacaaatatgtttaatcgcattatcattagcactaattcccaattagcttctcagtttgaatatgaatatgtgattattgatgacgaacatcatcaaaataaagggccgctaacaggaatttactcagtgatgaagcaatacatggatgaagaattgtttttcattgtatctgttgatacaccaatgattacaagtaaagcagtgaatgggttatatcatttcatggtatcaaacttaattgaatcacgtttagatattgtcgcgtttaaagaaggagaaatatgtataccgacgattggtttttatactctatcgacgtttccttttattgaaaaagctttaaattcaaatcatttaagtctaaagcatgtcattaaacaattatcgacagattggttagatgttactgaaattgactcgcctcattattggtataagaatattaattttcagcatgatctggactctttaaaaaagcagataaatgaataa

SEQ ID NO: 2702 - DNA, 543 bp, Staphylococcus epidermidis
gctctcccaactgttcctagaccttctttttgttccctatttttaacgccatttttaaaaaatgttgcacctaaagaaggcactagggtaatcgaaacaagtagtgaagctaataaactaaaagtaatggctagcgcaaatggtctaaacatttcacctactgaacctgacacaaacactagtggtaaaaacactactatagtaacaagggtcgatgacataataggtttaaatacttctctagtagcgcttataattaaattttcacctttgagcttctcattcggatcagataatcttctaaatatattctcaacgacaactatagaatcatctataactcgcccgattgcaaccgttaatgcacctaaagtaagaatatttaatgatacgttgcttaattttaatgctatgagcgcaattaatattgacattggtatagatacaattgaaatagctgtagttcttatatttcttaaaaacagaagaataacgataatagcaacaatcgtaccgagagcggccttttcaaccatagtataa

SEQ ID NO: 2703 - DNA, 126 bp, Staphylococcus epidermidis
ctacaaaatgcatttatacatttatttcttaaccaaaacatttataatagtgaaattgatgtaattaaaaatattaatcctaataatatatcactaattaagtcatcgtatttttttaaattttaa

SEQ ID NO: 2704 - DNA, 156 bp, Staphylococcus epidermidis
agagacaccgcttctttaaatgtatgtttaacatcatttttaaaaaggtttgtatcaaatataagaaaaagtattgctaaaatgacgagtatgctaattatgaacaatgtcgtcattcgaagccgagtattctttaacatttcaactaactcctaa

SEQ ID NO: 2705 - DNA, 264 bp, Staphylococcus epidermidis
agaggtttttatatgagaaagtttattttattgttatttattatcctaaatctcgtggcaatcattattacaatcaatcacccactaacaatttcatattttagtcttcgtgtcatcttcgtagcatttatatttattatatccattttttttatttttttacgtaccacaaactatgaattgattctaagtattttatctaccgttttcgctttcatacacatcggtttaattattcacagtgcctatctatatttatactag

SEQ ID NO: 2706 - DNA, 126 bp, Staphylococcus epidermidis
tgcatcaactatttggttaaatataagggagtgaataaacatgcacaaacatcaacatcagaatattcatttaaacagaccgattcatgtagcaattttgactgtatcggatacgagagattatga

SEQ ID NO: 2707 - DNA, 126 bp, Staphylococcus epidermidis
agatatatatattcagacgttttaacaaatatcgcacaacttgtctttttgctagaagaattagatgttgaaaacttaagtgaattattatcacgtttaaacagtggatacattctacaaatctaa

SEQ ID NO: 2708 - DNA, 153 bp, Staphylococcus epidermidis
ttatgtcatctcaaaaatagtgtcaaaagaattcgtcgtgtactgtcatgcatttatttcgctacaaaacaaatacatgatatgtacttaaaggatattaacaaacttgaaacgccttatgatactatagctacaattcatatcgtaagttaa

SEQ ID NO: 2709 - DNA, 369 bp, Staphylococcus epidermidis
aggagtgctcatatgaataaagcgcttgttatacgtgcaatcaaattttctttaatatttatgactgcatttttaattcttaatttattgactatgaaagaggcttcaatatcgtctattattgtacgaactgtcattgcagctattgttttctttgtcatttatatcattgtatttacaattttaagttcgtcagaacgtaaaattatttatggtacaactttacctattgcgctttttatatgccttatattcggagcaattttcttcactccgcgtataggtatcattgccggactaattataggtgtgtttgctggtgtcatatgggagttcttaaatagaaaaaatggaggtcgctcatcttga

SEQ ID NO: 2710 - DNA, 210 bp, Staphylococcus epidermidis
tgtggctatcataaaatcaaaagcctacttataaaacgattaatcgattcaaaaccaaataaaaaaataatgaggaattatagttgggaatatttcaatgcccaaattaaaaaaagctttcagaaccaaaacaaaaccatctacagtcaaagtaaaattgatgtggagcctgattttggattttcactcgtatgtccgttcgagggatga

SEQ ID NO: 2711 - DNA, 360 bp, Staphylococcus epidermidis
ttattcaatcatatgggaggctttatgaattatttagaaatttcactacatattgaacaacaacttgttaaattactctctctgagtgaaaatgcgaaatactatgcactcatacatcataacaaatttgaatcttttatagatgatttcaaccttactgtaaatcaagagatgaaatgggcaatgtctcatcaattgttgttgaattctaatgatacgcttttatcgtactgccaattgattcgaaggttaaacgattctccacttttaactttaaaccaaggacatataatttattacattaatacacaacaaacactcattcaccgacagttactcaaacataaacaagctctttag

SEQ ID NO: 2712 - DNA, 891 bp, Staphylococcus epidermidis
caaatgaatcatttaactactgaaacgagaaatatacaaacgatgcatctggatgaaatgaatctaagtgatgcattaaaaactatgaatcaagaagatcaattagtacctaaagcgatagaacctgttattcctaatttaacaaaagtgatagagagtgcaattcaacgctttaataatggaggacgaattatttatattggtgcaggtacaagtggaagacttggcgtactagatgcagcagaatgtgttccaacttttaacgtttcaccaaatgatattattggaatcatcgctggtggacaaaaagctatgacggtagctattgaaggtgcagaagatgatgctgaacaaggtgcacaggatttaaagaacatccatcttcaatccaaagatattgttgtgggtatttctgctagtggacgtacaccatatgtaaaaggtgcactagtttatgcaaataaaatgaatgcagaaacagtcgcactctcttgtaacgttcacagtgatataagtaaaaattcaaatcacgtattagaaatcaatgtgggacctgaagtattaacaggctctacgagattaaaatcaggtactgctcaaaaattagttttaaatatgatttctacaatgacaatgattggcgtgggtaaagtttatgataatttaatggttgatttacgacctacaaatcaaaagttaatccatcgttctattcgcataattcaagatgtgtgtgatttaaatcatcaagaggctatagaattatatgaaaaatcagaccacaatatcaaaatagctatcgtaatgcacttatgttccacaactcaacaagatgcaagacttcgtttaaaacaaaataatggagtgattaagcaagctatcaacacttaa

SEQ ID NO: 2713 - DNA, 642 bp, Staphylococcus epidermidis
agatggggtcaagttatggaaaataatgagttgcaaaggggattgaatgcacgtcagatgcagatgattgctcttggtggaacaattggtgttggtctttttatgggagcaacaagtacaattaaatggacaggtccatcagttattcttgcatatttaattgctggtatttttttatttttaatcatgagagccatgggtgaaatgatatatattaatccaaccactggttcttttgcgacgtttgctagtgactatattcatccagcagctggctacatgactgcttggagcaatgtatttcaatgggttgtcgtcggcatgagtgaagtgattgcagtaggagaatatatgaactactggttcccaagccttcctaattggataccaggagtgatagcagttctctttttgatggctgctaacctagtttcagtaaaagcgtttggagagtttgaattttggtttgccttaattaaagttgtaactattgtattaatgattattgcaggattacgattaattttatttggtataggcaatggagggaatccaatagggatttctaacttatggtcacatggtggatttatgccaaatggattcattggatttttctttgctttatctattgtgatttga

SEQ ID NO: 2714 - DNA, 867 bp, Staphylococcus epidermidis
gcacgacgtcttactgaaagggttaacttaatggctgagcaacgttggaccggtcaactagatttaacagttttcaataatggtcaaagctcaaaagcacgaaatatattttttgaaaaggcgctcaaagtactacgacctatatatttagaacaatctcctgtaccaacattctatattgtcaatgttggtggaggttatctagatggagatagataccgtgtcaacgtcaacttagaagataacgcacaagtgacgcttacttctcaaggtgcaactaaaatatataaaacgcctaatgaccatgtagaacagtatcaaacgtttaatttatcaaatcaatcgtatatggaatttgtagcagatcctattattgcctatgaaaacgctaaatttttccaacataatacgtttaatcttaaagaagatagtgctatgttttacactgatatattgactccaggctattcatctaatggccaagatttcacgtataattatatgcatcttattaatgaaatttacattgacaatcaattagttgttttcgataacatgatgttaagtcctgataaaagcagacttgacggcattgggtatatggaaaattatacacacttaggatcagcttattttattcatccagatgtaaaccaaagtttcatagaagatatttacacggcggttgctgattttcaaaaacaatacgactgtagaataggtatcacacaattacctactcatggattggccgttcgtattttgactaaaagaactcaaataatagaagaaattttgactcgtgttcaatcatatatcaatcaaacgatttatcatcgacaaattaacttcttaagaaaatattaa

SEQ ID NO: 2715 - DNA, 387 bp, Staphylococcus epidermidis
accttgctacaacaagatgtgcatcagaggagtggttttataatgggaaaaattaaagacatcaatgatttggttaatgcgacatttcaagtaaaaaaattttttagagatactaaaaagcaatataatttaaattatgaagaaatttatattcttaatcacattttgaaaagtgaatctaacgaaatatcttcaaaagaaattgctacatgttcagagtttaaaccgtattatttaactaaagcattacaaaaattaaaagatttaaatttactatctaaaaagagaagcgtgcatgatgaaagaacagtaattgtatttgtatcagatgaacaacgagaaaaaataaaaaaattgattttagaattagaaaactatatcaaataa

SEQ ID NO: 2716 - DNA, 168 bp, Staphylococcus epidermidis
aagagtaaacatgttaataactttttaaatcaatttgcagtacatctaataaatattacaatttttggaggcgttaaatattatgaaaaaaatcaaaacaatctcgacattggtagctggacttggtatagcatttctaggtcacacaacacatgcagatgcggctga

SEQ ID NO: 2717 - DNA, 537 bp, Staphylococcus epidermidis
ataaacatgcacaaacatcaacatcagaatattcatttaaacagaccgattcatgtagcaattttgactgtatcggatacgagagattatgattctgataaaggtggtcaactgattcaatctttgataaatcaacatgagaatcatgttgatattaaccactatcgaattgttaaagatgatatagaagctattacacaccaacttaagctttggttaacttcgtcaaatcaactagatgtcattattacaacgggaggaacaggtatctcacaaagagatgtgacaatagaagctgttcgcccattgttaactaaagaattagaaggttttggtgaattatttagatacttaagttataccgaagatgttggtacaagagcattattaactcgagctattgcaggtacctgtgatagcaccttaatttttgcacttcctggctcaactggtgcaattaaacttgcaatagaaaaattaattaaacctgaattgagtcacttagtgtttgaattaaataaagacattaggtattaa

SEQ ID NO: 2718 - DNA, 141 bp, Staphylococcus epidermidis
acgctttcgcataattgtaaaaatattgtttcaattttgtcaatttatagtataattacggaaataagattatcaaaaattcaatctagatttagagatggggtcaagttatggaaaataatgagttgcaaaggggattga

SEQ ID NO: 2719 - DNA, 150 bp, Staphylococcus epidermidis
acgccacctaatataattaaaactaccatcaaaaaaatagcgaatttattacctaacgaaaattgtaataattttttaatcattcattttttcctttcttataaaaaatctgaacgctctcaatttatctatagaagcgttcagatctga

SEQ ID NO: 2720 - DNA, 975 bp, Staphylococcus epidermidis
gttattcataaaaaaacgttaggagtatcaactatgaccaaagtatattttaatcatgatggtggcgttgatgatctagtgtcactatttttattattacaaatggaaaatatagaacttgttggtgtaagtacgattggtgcagactgctatttagagccgtcattaagtgcttcattaaagattataaatcgtttttcagacgttgaaattaatgtagcaccatcatatgaaagagggaaaaatccttttccaaaagaatggagaatgcatgctttctttatggatgccttaccagtgctaaatgagtcttgtatacccaaaagatgtaaggctagtgaggacgaggcgtatatagatattattcgtaaggtgaagagttgtgatgagaaagttacattgttatttactggaccgcttacagatttagctaaagctataaaatatgacaactcaattttaaaaaatatagagaaattagtttggatgggtggaacgtttttagacaaaggaaatgttgaagaaccagaacatgatggtacagctgaatggaatgcattttgggatccagaggctgtaaaagttgtattagatagtgatatgattgtcgatattgttgctttagaaagtacaaatcaagtccctctaacaatggaagttcgtcaaatgtgggcagataaaagacaatatttaggcgttgattttctgggcacaagttacgcagcagtaccaccactcacacattttgtgaccaattcaacatactttttatgggatgtattaactactgcttatgtgggttctccaaatttagttgaatcaacgaaattgaaaattgatgtagtcagtcaaggacctagtcaaggaagaacattccaatctgaaaatggacgtgaagttcaagtcattacggatgtaaataaacaagcattttttaaatacataacggatttagcaaagaaaatcgagacctaa

SEQ ID NO: 2721 - DNA, 1107 bp, Staphylococcus epidermidis
tataagcataaaaatttagtgaaaagaggtaaaaaaatgaaaatagctattgtaggttcaggtaatggtgcagtaactgctgcagtggatatggtagataaaggtcatgatgtacgattatattgtcgtaacgaatctattagtaaatttgatgtagccctagaaaaaggtggctttgatttttataatgagggagaagagaagtttatagagtttactgatattagtgatgatatggagtatgttttagatggtgcagacattgtccaggtaatcattccttcatcattcattgaatattatgctaaagtgatgtcaaaatttgtgacgaacgaccatctcattttctttaacattgctgcttcaatgggttcaatacgatttatgaatgtattagaagatcgccatattgatgtccatccacactttgcagaagcaaatacattaacatatggtacacgtgttgactttaacaatgctaaagtagatttatctttaaatgttcgtcgtgtgttcttttcaacatttgatcgtagtgagttaaatgaaagttatgaaaaggtatctaaaatttacgattatcttgtaaaagaagaaagtttacttaaaactaaccttgaaaatggtaacccagaagtacatcctggaccaacattattgaacgttggacgtattgattattcagaagagttttctttatataaagaaggcataacaaaacatactgtgagattattacatgctattgagatagaacgtttaaatttagggagaaaattaggttttgaattatcgactgccaaagaatcacgtattcaaagaggttatttagaacggaaagacgaggatgaaccgttaaatcgtctttttaatactagtcctgtgttttctcaaattccaggaccgaatcacgttgaaaatcgttatttaactgaagatatcgcatatggattagtattatggtctagtttaggacgtgtcattgatgtcccgacacctaatatcgatgctgttattatgatagcttcaactattcttgaacgcgatttctttgaagagggcctcactatcgaggaattaggcttagataaattaggattagagtaa

SEQ ID NO: 2722 - DNA, 792 bp, Staphylococcus epidermidis
ctaataaataataatgaagttgatgaggcgatgtttatgtcgaaaataacttttaaagatatttatattgatggaaataaaataactgaagatactagaaaggtgatttatctcttaccttctcaacctttaaaatatgctagtaacacgtggatttataaaacgatgccaacaatgaaccagtggcttaaagacattgaagttcaaaagaaaatgcatctaaatcaatcatcctatcatctttcattttcatttccagctaatgaaaagatagatgaagtattgttggaaaaaatacgtgaactaggttttcagataggagtacttgagctctatgtcattgaagctaaagcgttaaaggagctctcccgcaaaagagacgtagatattcaacttgtatcaagcaataatatcaatgattaccttcatgtttatgatgtgtttgcacggccttttggtgatagctatgccaacatggttaaacaacatatttatagctcatataacttggacgatattgaacgtttagttgcatatgttaaccagcaaccagttggaatagtcgatactataatgacggataaaacaatagaaatagatggttttggggttttagaagaattccaacatcaaggtatcggttctgaaatacaagcttacgttggacatatggctaatgagcgacctgttattcttgttgcagatggagaagatactgctaaagatatgtatctaagacaaggatatgtatatcaaggttttaagtatcatattttaaaagaaaatatttaa

SEQ ID NO: 2723 - DNA, 1218 bp, Staphylococcus epidermidis
agcaatgataaaggaggagcagtaatgaatcagtctacaataattaaagaccccatctttacgaagagttttaatattaactttgctattaacttttttgtttatctatgtatgtatttattaattgtcgttatcgcgagctatagtaaatcagaataccatgcttctgattctgttgctggactcgtagtcggactttttatagtaggatcattaataggtcgatttgtaacaggtaaatacgtaaatcgatttggtccaaaaaaaattctcatttttggtttaatatgtttagtagtaacacagctactttattttatacctggttctgtttggttcttaatgatggtgcgtttactgaacggcttagcaacagcggttgctacaactgctacaggaacaatagcagcatatattacaccacctacacgcaaaagtgaaggtatcagtttattctcattaagtttggtgttgggaaccgctattggcccattttttggtatgttattgatgaattccttttctatcaatattttatttactatttgtgtaattttaggtgtcataagtggtctattatcactgttaattaaaattaatttcacaacagttaaagaaaacacaattacacataaacgattcaatttggctcattttgtagccaaagaagccattccggtagcattcgtcatgctattaatcggtgttacttacgctgctattttaacttatttacaggcttttgctgttgaaagagatctagttacatcagcaagttactttttcattttttatgctattgcgtccctcataacaagacctattgctggaagattgatggatgataaaaacgaaaatgtagttgtttatccagcatttatctttttagtattatcttttgttctactgatgcttagttttaacggttgggtattacttattgcaggtatcgcattaggaattggttatggtaacttgtcatcttgtatgcaagctatcgcaataaaagtatctccatcaaataaatatggcttagctacatcaacttactttattggtttagatatagggattggatttggaccatccttactaggtcttttcacacatatgatttcttatagtcaattatatggaatcatgggtattttaggatttgcaactttagtcatctatatttttgtgcacggacgtaaggtttacagcacttcatattaa

SEQ ID NO: 2724 - DNA, 573 bp, Staphylococcus epidermidis
aatctatgtaaggaggatgaacaagtgactacaaaacatttagtatatacagctttaatgactgctatcatttgtattttaggtttagtaccaagtgtacctctgccatttatgccagtccctattgtattacagaatataggaatctttttggcaggaattattttagggcgaaagcttggtactacaagtgttattgtctttttattattagtagctacaggtttgccagtgctttctggaggccgtgggggaattggcgtatttgcaggaccttcggcaggattcttattcttatatcctgttgtagcttactttataggtattattcgtgatgcatatttgcataaaattaatttcttagtgatttttatagctacactagttatcggtgtattaggattagatatattaggtacactcattatgggcttcattatacatatacctatctctaaggcatttatattatcatttacatttatgccaggtgatattattaaggctattattgcaagtttaataggtgcagcaattttaaatcattcacgtttcaagactcttattcaataa

SEQ ID NO: 2725 - DNA, 1656 bp, Staphylococcus epidermidis
ataaagagcaataaagataaacatatattagttatcataattaagggaagtgggaggtattcaaaaatgaatgcaattaaacgatttggtagtgcaatgatagtacctgttttaatgtttgcttttttcggtattgttttgggattcgctacattatttaaaaatccaaccattatgggaggattagctgatcagcaaacattttggtttaaattttggtctgttattgaatcaggtggttgggtaatatttacacatatggaaattgtctttgtagttggcttaccattatctcttgctaaaaaagcaccaggacatgcagctttagcagctctaatgggatatttaatgtttaatacttttatcaatgcaattttaactcaatggccacatacttttggcgctaatttaaaaaaaggtgtagaaaacacaacaggattaaaatcgattgcaggtattgaaacgttagataccaatattttaggtgcaatcattatctcaggaataataacgtggatacataatagatattacagtaagcgtttacctgaaatgttaggtgtatttcaaggattaacattcgttgtaacaatctctttctttgtcatgctaccagtggcagcaatcacttgtgttgtttggccaacgattcaacacggtattgcttcaattcaatattttattgttgcatcaggttatataggtgtttggttatatcatttcttagagcgtgtactaatacctacaggattgcatcattttatctatgcaccaatcgaagtaggtccagtagttgttaatcatggtttgaaagcagaatggcttcaacacttaaaccagtttgccgaaagtaataaaccacttaaagaacaattcccatatggatttatgttgcaaggaaatggaaaggtttttggttgtctaggtatagcattggcaatgtatgcaactacaccaaaagaaaatcgtaaaaaagttgctgcattattaataccagcaacacttacggcagtagtagctggtattacagaaccacttgaatttacattcttatttattgcgccatttttattcgtattacatgcactactagcagcaactatggatacactgatgtatggatttggtgttgtaggtaatatgggtggcggtgtactagattttattgcaactaactggataccattaggaaaagcacattggatgacatatgtctttcaagtagtaattggtttaatctttgttgcaatttactacttcttatttaaatatttaattttaaaatttgatattccattaccaggacgtaagaaaggtgaagaagaagttaaattattttccaaacaagattataaagataaaaaaggagattcaactcgcaatcattcacctaatagtgaatatgaagaaaaggcgatgtactacctagaaggtcttggaggaaaagaaaatattaaagacgttacaaattgtacgacacgtctacgtttaactgttaaagacgaaagtaaagttcaagaaagtgcctattttacacataatcaaatgtctcatggtttagtaaaaagtggcaaaagtgttcaagtcgtcgttggaatgtctgtacctcaggtaagagaagcatttgaaaatattgtaaatgatgatctatcttag

SEQ ID NO: 2726 - DNA, 735 bp, Staphylococcus epidermidis
aatccaataaagctaaacaaattcttaaagaatatcaattttctgtataaggagttcagagctatgcctgatttaacgtccttttggatttcttttcgtgttgctttaatcagtacaatgatagttactatttttggcattttgatttctaaatggctatacaataaaaatagatattgggtaaatctattagaaagttttatcattttaccaattgtgttaccacctactgtccttggttttatactattaattatattttcaacaagaagtcctgtaggagaattctttactaatatcttacacttaccagttgtatttactttgacaggtgcagtgattgcatctgtcattgttagttttcctcttatgtatcaacatacagtgaatggttttcgaagtatagattcaaagatgttaaatactgcaaggacgatgggagcaagtgaaacaaaaatattttttaaattggtgttaccattatctaaacgttctattcttgcaggtattatgatgagctttgcaagagcaataggtgaatttggtgctactttgatggttgctggctatatcccagacaaaacaaatacattgcctttagaaatttattttttagtggagcaagggaaagaaaatgaagcatggttatgggtgcttgtattagttgcgtttgcggtaactgtcatagcgaccataaatctggttaatcgtgatacgtttagggaggttgattaa

SEQ ID NO: 2727 - DNA, 123 bp, Staphylococcus epidermidis
aaatcatcaaaaaattataaaaaagacaattcctatattatttcaatagaaattgtctttatttacttatcttggaactttttgtcccagcctttttttaataatttaattgtcagtgtctaa

SEQ ID NO: 2728 - DNA, 1035 bp, Staphylococcus epidermidis
ggaggtccaaaaatgaaagcgctaatacaagataaattaggccgtccaatacgggatttaagaatatcggtcactgatcgatgtaatttcagatgtgattattgtatgccaaaggaaatctttggagatgattacactttcttacctaagaatgaattgcttacttttgaagaattgacacgaatttcaaaaatttatgctcaattgggagttaagaagataagaattactggaggagagcctctcttacgacgcaatctttataaacttgtagagcaattaaatctcatagatggtatagaggatattggattgactactaatggcttattattaaaaaaacatgggaaaaatttatatcaagctggtttacgacgtattaatgtaagtttagatgcgattgaggataacgtttttcaagaaattaacaatagaaatattaaagcgtctacaattttagaacaaattgattatgcaatatcaataggttttgaagttaaagtaaacgtggttattcaaaaaggggttaatgataatcaaattattccgatgattgattattttaaaaataaaaatattgaagtacgttttattgaatttatggatgtaggtaatgataatggatggaatttcaataaagttgtaactaaagaagaaatgcttaatatgatagaacaacattttgagataagtcctgtaacacctaaatattatggggaagttgctaaatattttcgacataaagataatgatgcacaatttggtctaattacgagtgtatctgaatcattttgctccacatgtacgcgtgctcgattatcttcagatggtaaattttatggttgtttatttgcctcctcagagggatttgacgtaaaagccttaatacgcagtggagctacagatgatgatttaaaagcacaatttaaacgattgtggagtattagaaacgatcagtactctgataatcgtacgatgcaaactattgagaataatagaaagaaaaaaattaatatgaattatataggtggataa

SEQ ID NO: 2729 - DNA, 171 bp, Staphylococcus epidermidis
attattaaaaacacgtatcgaataattttctctcatatgtcttcctcacgatgtcctagtgtgtatttaaaattaaacttctccccgattgctaaactaaatttaactagacaacatctatttttcagtgtctattatacaactctcgaaaaattagtagtaacaaattag

SEQ ID NO: 2730 - DNA, 3156 bp, Staphylococcus epidermidis
atgattaaaaaattattacaattttcgttaggtaataaattcgctatttttttgatggtagttttaattatattaggtggcgtttattcaagcgccaaattaaaacttgaattattaccagatgttgaaaatccagttatttcagttcaaactacaatgtctggagcaacaccccagtcaacacaagatgaaataagtagcaagattgataatcaagtacgctcgttggcctacgtaaatagtgtacagactgaatctatacctaatgcttctatagtaactgtagaatacgataatggtacagatatggataaagctgaagaacaattaaaaaaagaaatcgacaaaattaagtttaaagatggcgttggtgaacccgaattaacaaggaactctatggatgcttttccaattgtggcatattcttttacgagtaataatcaaaagttaaaagacgttactaaaaagttaaatcaacagctcgtaccaaaattacaaaccattgatggtgtacaaaatgcacaattaaacggtcaaactaatcgtgaagtatcgttaaagtttaaacaaaaaaatttagatgaaaaaggtttaactgcaaatgatgttgagaactatataaaaacggctacacgtgaaacgccattaggacttttccaatttaataagagtaataaatctattgttgttgatggtcaatttaaatctgtagacgcttttaaaaatcttaaaatccctttatctatttctggacaagctgcacaaaatgatagcgattccgacagtgatagtctaatgccaagtgataatactcgctcgactaatagttcaactcatatggcacagaaaggccaaatgccatctgtaccacttaaagatttagcagatattagtgtcggtgatgaacgtacttctatatccaagacaaatggaaaagatgctgttaacttacaaattatgaaatcacaagatgctaatactgtgcaagttgcgagagaagttcagaaaaaagtagatgaatttgtacgtaatgagagtggaatgaaatctattaaaacaatggatactgctaaacctattgaagactctctttatactatggttgaaaaggccgctctcggtacgattgttgctattatcgttattcttctgtttttaagaaatataagaactacagctatttcaattgtatctataccaatgtcaatattaattgcgctcatagcattaaaattaagcaacgtatcattaaatattcttactttaggtgcattaacggttgcaatcgggcgagttatagatgattctatagttgtcgttgagaatatatttagaagattatctgatccgaatgagaagctcaaaggtgaaaatttaattataagcgctactagagaagtatttaaacctattatgtcatcgacccttgttactatagtagtgtttttaccactagtgtttgtgtcaggttcagtaggtgaaatgtttagaccatttgcgctagccattacttttagtttattagcttcactacttgtttcgattaccctagtgccttctttaggtgcaacattttttaaaaatggcgttaaaaatagggaacaaaaagaaggtctaggaacagttgggagagcctatagaagcgctttgaattggtcacttaatcataaatggattgtgcttatagttagtatttttattttagttggaagtgtggtcataggcgcaagaaatctaggaacgagttatatttcaactggagataataaatttttagctctaacatatactccaaaacctggagaaacacagaaatctgtgacacaacatgctgaaaaagtacaaaattatttagataaaaaagataaagtagaaactgttcaatattctataggtggtcctacaccacaagatcctaccggtagtaccaacagcatggcaattatgattaaatatcaatctgacacgcctaattttgatgaagagcctgataaagtacttaaacatatcgagacatttaaacaacctggagaatggaaaaatcaagatttaggaacaggagcaggtaataattctgttgaagtaactgtcaaaggacctaatacaagtgcaatgaaagatacagtcaaccgtgtagagaaaatgatgactgatattaaaggcataacgaatgttaaatctgatttatcacagacgtatgaccaatatgaaataaaagttgaccaaaataaagctgcagataatggtatttctgctgcacaacttgcgatgaatcttaatgaaaacttacctgagaaaacaatttctacagttaatgaaaagggtaaatctatagatgtaaaggtcaaacaaaataagcaaacagattggtcttctcaaaaaattaaaaacattaaactaaataagcctacgggcggtacgattaaacttagtgaaatagcatctcttaaaaaatcatatacaccaagtaaactgactcaagaagatggcgattatgctacgactgttacaggtaaagtgactgataaagatgtgggtggtaaatctcaacaagttatggctaaagtgaaagaccttgagaaacctagtcatattaaaattaatgtcggcggtgcaactgatgacattgataaggctatttctcagcttgctatggcgatgatagcagcaattatcattgtttatttaattttagttattacatttagaggtggtctggcaccatttacaatcttgttctcattaccatttacggttatcggtgtagtacttgcactcatcattaccggagaaactatttcagttccaagtttaataggtatgcttatgttaattggtatcgttgttacgaatgctatagtattaatcgatcgtgttattaacaatgaaaaacaaggtatgccgatgaaacaggcattgatagaagcgggtggtacacggataagacctatattaatgacagcaattgcaacaataggtgcactagtgccgttgttatttggtcatgacagttcaatattaatttcaaaaggtatggctgcaacagtaataggtggattaatttcttcaacgctactcacactctttgtagtaccggttatatacgaaattttattcactttaaaaaataaaattactaaaaagtttaatatgtaa

SEQ ID NO: 2731 - DNA, 1254 bp, Staphylococcus epidermidis
accatggaaaagatgaacatcactaatcaacaacatgacgcatttgtgaaatctcatcccaatggtgatttattacaattatctaagtgggcagatacgaaaaaattaacaggatggtattcaagaagaattgctgtcggtgaaaatggtcaaattaaaggtgttggccagctactattcaaaaaaatacctaaacttccatacactttatgctatgtatctaggggatttgtagctgattataataataaagaagtgttagaagctctacttagctatgctaaagaagtagcaaaagatgaaaagtcgtatgctatcaaaatagatcccgatgtcgaagtagataaaggtgcagaagcacttaaaaatctacgtgagcttgggtttaaacataaaggttttaaagaaggactgtctaaagactatattcaaccaagaatgactatgattacgcctattgacaaaacagatgatgaattagttcaaagtttcgaacgtcgaaatcgttcaaaagtaagacttgcactgaagcgtggaactaaagtagaacgatcaaatcgcgaggggcttaaaatctttgctaatttaatgaagataactggggagagagatggttttttaactcgagatattagttattttgaaaatatatatgatgcacttcatgaagacggtgatgcagaactcttccttgttaaattagagcctaagccagtattagatacggttaatcaagatcttgaagcacaattagctgagaaagagaaattacaatcaaaaaagcaagataaaaagacacttaataaacttaatgatattgataataaaattaagaaaacaaatgaattaaaatcggatttaacagaacttgaaaaaagcgagccagaaggtatttacttgtcaggagcgctcttaatgtttgcaggaaacaaatcttactatctctatggcgcttcctcgaatgactatcgtgatttcttaccaaaccatcacatgcaatttgaaatgatgaaatatgcacgtgagcatggtgcaacaacctatgactttggtggtacagataatgatcctgataaagattcagaacattatgggttgtgggcttttaaacgagtttggggtacatatttaagtgaaaaaattggagaatttgattatgtattaaatcaaccgctatatcatttagttgagaaagtgaaacctcgtttaacgaaagctaaaattaaaatatcacgtaaacttaaaggtaaataa

SEQ ID NO: 2732 - DNA, 696 bp, Staphylococcus epidermidis
ctttcattgaataaattagaacgtcaaaatcgaattattcaaactattcaaagttctgacaaaattactgcatcccagcttgcaaaacaatttaacgtatctaagagaactattttacgtgatattgatgaattagaagatcaaggggtaaaagtatatgctcgtcatggcaaattaggcggttatcaaatcaaagatgcacatgctaaaatcaccttatcgttaactgaacagcaactttcggcattatttttaacactaaatgaaagtcagtccaattccactttaccttatcaaaatgaaattcgagcaataatcaagcaatgtttaaatttacctcaaacacgattacgtaaaatgctaaaaaaaatggattattatattaaatttgaagattctaatcatgtcacactacctcaattattttctgatattttaatttattgcacggagcgtaatgtgatgttagtagatttaaatgaaaataatcaaattcaagctgaaaatgtgatttttataggcttaatatgcaaaaatgctgtttggcatgctgttgtatttgaaatcggtagaggttacactcgtgaattatctatcctggatattcaagatatctcatattcttttgaaaaaacgatacaaacccaagatatctcaattgaaaattatcgacagtttttagcgccttctgaatga

SEQ ID NO: 2733 - DNA, 792 bp, Staphylococcus epidermidis
gctatcatgaaaattaaacatatttttattattattttaacattgtgtgtagtattagcaggttgtaccaacgagaaaggtcagaataaagaacagaatgaaaaacaatcgacaaaaggtgataaacaagaacttcaagtttctgctgcagcaagtttgactgaagtcagtaaagcattaggaaatgaatttaaaaaggaccatccaaatgtagaaattaaatttaactatggcggatcaggtgcgttaagacaacaaatagaagcgggtgctccgtcagatgtcatgatgtcagctaacactaaagatatagacctgttgaagaaaaaaaacaaagcacatgacacttataattatgcaaagaatcaacttgtattaattggtgataaaaataaaagttatacctctgtaaaagatttaaatcaaaacgacaaactcgcactaggacaaataaaaacagtgcctgctggtaaatatgcaaaacaatatttagatgatcaacatttatatggtgatgttaaagataaaattatttttgctaaagacgtaaaacaagtattaaattatgtggaaaaaggaaacgcacaggaaggattcgtttacaaaacagacttatatcaacaaaagaaaaaagcaaataaagttaaagtcatcgaagaaattaaattaagcaaaccaattacttataaagcaggtgcaacttcagataaaaaattagctaaagaatggattaacttcttaaaatccaataaagctaaacaaattcttaaagaatatcaattttctgtataa

SEQ ID NO: 2734 - DNA, 153 bp, Staphylococcus epidermidis
atggtgatgaacctcagtttattgtcaattaactggtgcattcaacaacataaacacaaaaagagctatgaagatattgagttgagtctctatcttcatagctctttatttattaaaatgactgcatttttaatatttaactttatcatttaa

SEQ ID NO: 2735 - DNA, 153 bp, Staphylococcus epidermidis
atgacaaagaaaacaatagctgcaatgacagttcgtacaataatagacgatattgaagcctctttcatagtcaataaattaagaattaaaaatgcagtcataaatattaaagaaaatttgattgcacgtataacaagcgctttattcatatga

SEQ ID NO: 2736 - DNA, 492 bp, Staphylococcus epidermidis
agaagaattgatactatgattttacaaattgtaggtatgaaaaattcagggaaaactacattgatgaaccatgcgatatcatttttaaaagaacgaggctattcagtagcaacaattaaacatcacgggcatattggtgaagaaattgaattacagtcatctgatgttgaccacatgaaacatttcgctgcgggtgcagaccaaagtattgttcaggggcatcatttacagcaaacagtgacacgtaaaaagaaacaatcgcttagagaaataatagaaaattctgttacaattgattatagtatcattttagttgaaggctttaaagaagcaaattatgataaaattatcgtttataaaaataatgatgaattaagaagtctacaaggactttctcacgtcatagggaaaatagaaaccaatcatccacgtgcaaataatcaacttgagcacttactcaacaaattaattaaggataagggaatgaattaa

SEQ ID NO: 2737 - DNA, 789 bp, Staphylococcus epidermidis
gagttagttgaaatgttaaagaatactcggcttcgaatgacgacattgttcataattagcatactcgtcattttagcaatactttttcttatatttgatacaaacctttttaaaaatgatgttaaacatacatttaaagaagcggtgtctcttcaaacaagtgagggaaatatccatactaaagaagttaatggtaagtttatatatgcttccaaacaagatatagagaaagctatgcaaataaaacatagtgataatgatttgaagtacatggatatatcagaaaaagtacctatgtcagagaaggaagttaaccatatcttaaaaggaaaaggtattttagaaaataagggatcaacgtttattaaagcccaagataaatatgaagtgaatatcctatatctcatcagtcatgcactagttgagacaggaaatggtcaatcagatttatcaaaaggaattaaagaaggtaactatcactattataacttttttggtattggtgcttttgatgaagatgctgtaaagactggtaagagttttgctaaacagaagaagtggaccactcctgaaaaagcgataatgggtggcgcgtggtttgtgagataccattactttaaaaataatcaattgagcttatatcaaatgcggtggaacccacaaaatccaggccaacatcaatatgctagtgatattcagtgggccaataatatagctgatttaatggagaaatactatgataaatatggaataaaaaaagatcatataagaaaaaaatattacaaataa

SEQ ID NO: 2738 - DNA, 144 bp, Staphylococcus epidermidis
tataattatgacaaattgttcagtcacattgattccttctttctagtttatacaaatgagtactttgatatcgtgtcccacttatttagaagtatcgtatttcgtgatataatctttattaaatgtaaaaattactactattaa

SEQ ID NO: 2739 - DNA, 627 bp, Staphylococcus epidermidis
gaggcatatgagatgtcaaacccaattaaaattggtatcgggggtcctgttggtgcaggtaaaacccaattgatagaaaaagtggttaaacgccttgcgaaagaaatgagtattggcgttattactaatgatatctatactaaagaagatgaaaaaatactagttaatactggtgttttaccagaagatagaattatcggtgtggaaactggaggttgtcctcatacagctattcgtgaagacgcttcaatgaacttcgcagctatagatgaattattagaacgtaatgatgatattgaacttatttttattgaatcaggtggcgataacttagcagctacttttagtccagaactcgtcgacttttcaatttatatcattgatgttgcacaaggcgaaaagattccacgtaaaggtggacaaggtatgattaaatctgatttcttcattattaataaaactgaccttgcaccatatgtaggtgcttcattagatcaaatggctaaagacactgaagtatttcgtggaaatcgcccattcgcttttacaaatttaaaaactgatgaaggtttagaaaaagttattgagtggattgagcacgacgtcttactgaaagggttaacttaa

SEQ ID NO: 2740 - DNA, 453 bp, Staphylococcus epidermidis
tatgacaatgaggtgttaaatattttaaccaatgaatttttcaatagttttataggtatatatagaccctatattaaacttacacaacctatattagatcagcatcagattcataccggccaatggcttgtgctaagagatattgccaattatcaacctactacacttgtaaaaatttctcatcgtcgttcaatagaaaagcctacaacacgaaaattgattaaagtattgttagacaatggttgggttatgacaaaaacaggagttgataagagagagaaattattaagtttaactgacaaaggccaaatcctctttgaaactattaataaaaaggtcactgtcattcaacaagatattataaaaaaaactggattaactgatgagcaagtatttgatattacaaatgcgatgtctcaaattcatgaagcaatgataaaggaggagcagtaa

SEQ ID NO: 2741 - DNA, 831 bp, Staphylococcus epidermidis
aatgaaggtgaaattatgacagaactttatttaaaaaaattagatgaatacatatgtcaatggatacgtggtttagacgatatcattccacgtttggttgagaaaatggaaacatcaacaaaaaaagataggtttgatttagttactaatgttgataaacaaattcagaatcattttcaaaactttcttcaggaacattatcctacacatcaattactagctgaagagaaagataactcagatataacaccttacgagggtcacctctggattatggatcctatagatggaacaagtaatttagtgaaacaacaagaagattactgtatcataataggatattttattgatggggaacctaaactttcatatatttatgattatccacatcaaagattatatagagcaattgctggtataggagcctacgaaaacaatcaattaatgacaatgccaaaaagaattggtttaagagaggcaattatttcatttaaaccacaagtgttaaaagaagagacggttcaatctttatttcaatcagcctttgattttagaagtattgggtcttgtggtcttgattctattcgagtgataaaaggtcagtttggggcacacattaatacgaatcctaagccatgggatatttcagcacaatttctttttgcaagagaactaggtttgattatgacacaaataaatggtgaacctcttgattttagtaaggcgggcccatttattattagtaatcctggttgttacgatgatatgatacgtatcttaaatgaaggcggaggttattcaaagagtagtcatcatatcgagcgtggttaa

SEQ ID NO: 2742 - DNA, 813 bp, Staphylococcus epidermidis
ttaaagttagattttgttaaaatgagcaataacatgtggagggggataaagttgaacttaaaattagaccatatcattcactatatacatcaattagagtcatttaagtttcctggagaaatattagaattgcaaaatggtggaagacatcatcatttgggcacctttaatcaaatagcaccgattaaaaatagttatatcgaattgctagatgttgaaaatgagtcaaaacttaacaatgtagctaaaactgaagaaggtcgtgtatcatttgctacaaaaatagtgcaggatcattttaaacaaggctttaaaggtatttgctttagaacaaaggatatagatcaggttaaaagttccttagaaaatagaggcgttgatgtgataggtcctattgatatggaaagagaaaataaaaaaggtcatcaattaagttggagattgctatatattgctaaccctgactatagagtcaaaccacctttctttatagaatgggataacagcaaaaagcaaaacctatcacaaatacataatttcaacttgtcatcgtttaaaattaaagaggtgattattactagcactcaacgtgaaacaacagtaagtctttggaaagaatggtataacctgaaaatagtaaatgaaacggctacatctactgatctcaaattagaaactgatgaagttatctataaaatagaagacggcaaagattcaggttttcatacattaataatgaccgatatcaatgccacagcaccatattcaatatttatacgtggtgctaaatatcgttttgagccacccaactag

SEQ ID NO: 2743 - DNA, 168 bp, Staphylococcus epidermidis
attaaaaaagactccatcacatttacgccccctatgactcattttattttaaatttaattattcatagtttaacactcgactttattttttcaaaatttactaatggaacttcatacgcatttccctctgatattgaaaagttaacaattaatatatacataacttaa

SEQ ID NO: 2744 - DNA, 195 bp, Staphylococcus epidermidis
ccctttgaagaggagaatgatacgatggacttgaattcaaagttatcagaacttaaatatgattatacacgattacaaaacgatttagaaaaacgtgagtcgcttcatcaagatattgaccctctacttaaacaacttgaaaatattgaacaagaaatctcctatatacgttcaaaattaaatcaacaatcttaa

SEQ ID NO: 2745 - DNA, 750 bp, Staphylococcus epidermidis
ctaagaaaggattatcatcaaatgcaacaacagaagattaaacgattcttagcccattttgtattagatcacgtcacaatagaatatttgaaatatggccaccagttgacaattgaacagcttaaattattaatatttatattacatttcactgaaaatcataaagaagatttaagtttaaatatgatcatcttttacaaaaattatcaaaaaaaccaattgttaaaaagtattacacatctatatgaatttaattggatttcaaaaaaacgacatccatacgaccaacgtagactagttattacattaactcaaaatcaatgtagtaaaataactcaattaattgatgaattagaacacttcttagaggtgaaatctacattaataaacgaaattaatcattcaactttattatcgtattatttaaagtgccatagtcaatttagggtaattgaacaatcttgcacatctcaacatttaacattagaagaattataccttcttgggttacttatcgttagtgataacaagactacatttaaaagcataaaagtacatgctttgaagggaatcattgcaatgggacctattattaagaccttacagtcaaaaggttatctcattaaaagtcggagtagagatgatgaacgctatattgtattaacacttagaaaagaaaaaattaatgtgattcagtcagaaatcgaggaatgttacaataaattagaacagggaatacagcatgtgtaa

SEQ ID NO: 2746 - DNA, 213 bp, Staphylococcus epidermidis
agaatgaattggaggtattcaaaaatgggctatattatcctatttttcatagcaggtccagtaattataggagtgggtaatcttatattgggaccgatatttaataaacgtacacctttacatgttcaatttcgatcgtttattattggctctcttgtgtaccttattctcgccacgatctgctattttttgtttcttcaaggcaaattataa

SEQ ID NO: 2747 - DNA, 786 bp, Staphylococcus epidermidis
attacgttctggaaaagtaaatttaaaaatggtgatccatttactattgcactttttggcgtagattctgatgaaaagcgaaagcaacaaggcggtggggaacgaagtgatacaatcatggtactttccattaatccgaaagaaaagaaaactgagctagtaagtattccacgtgataccaaagcagaaatagcaggtcgaggtactgaagaaaagattaaccatgcatacgcttatggcggtcctaacatggctgttaaaacaattgaaaaattaatgaatgttccaattgaccattacgctacgattgacatggatggactacatgacatgattgatacattaggtggcgttgatgtcgtaagtaatagtacatttacaatgggggctaatcactttgttaaaggtgaaaaaacacacgtagatggtgatgctgccatggactttattagaagtcgtaaagaagatggggcaggaggcgattttggtagacaagagcgtcagcaacttatcttagaagcgatggcagataagttgacaagcgcttcttcaatcactcattttaatacattaatgaatcaaattcagaaaaatgttaaaacagatttaaaattaggtgatcttaatacaattagaactaagtataaagatgctaatgaccaagttaatcgacatcagttagagggtgaaggtggtatacaaaatgacggtttgtactatttcataccaagtgatgcatctaaaaatgaaaatacacaattactaagagataatttaaatttataa

SEQ ID NO: 2748 - DNA, 174 bp, Staphylococcus epidermidis
ttactcattcgaaataagataactataatctttcaacttcaatcaaaagtcttagtgattctaaaaaaaaagagtggtacaatttatttaaacgaacagcgtataaaatataagcattcatatcattttcatacatatattgttaacgattggaggtccccatatgttgattga

SEQ ID NO: 2749 - DNA, 1008 bp, Staphylococcus epidermidis
ttgtttgcgctttcttattttactatactattcataaaagaaggagtgatggttatgacaaaagtttatattgcaggcgcaatacctgaagtgggacttaacttattgaaagaacattttgaggtagacatgtatgatggcgaggggcttatcgataaagaaaccttaaaaaaaggggtagaacatgcagatgcattagttagtttactatcaacttctgttgataaagatattattgatagtgctaataaccttaaaattatagcgaattatggtgcaggttttaataatattgatgtcgaatatgcaagacaacaaaatatagatgttacgaatacaccacacgcttcgacaaatgcaactgctgatttaacaatcggtttaattttatcagtagcgcgtagaattgtagaaggagatcatttatccagaacaacaggttttgatggttgggcacccttattcttccgaggcagagaggtatcaggaaaaactattggtattataggtttaggtgaaattggaggtgcagtggctaaacgcgcacgcgcatttgatatggatgtactgtacactggtcctcatcgtaaagaagaaaaagaacgagatatcggtgcgaaatatgtagatttagatactttacttaaaaatgcagattttattacaatcaatgcggcatataatccatcactacatcatatgattgatactgaacaatttaataaaatgaaatctactgcctatctaattaatgcaggacgtggtccaatagtaaatgaacaatctttagttgaagcacttgataataaagttattgaaggtgctgcattggatgtatatgaatttgagccagaaatcactgatgcattaaaatcatttaaaaacgttgtgcttacacctcacattggtaatgcaacatttgaagctagagatatgatggctaaaattgttgcgaatgatacaataaaaaaattaaatggtgatgaacctcagtttattgtcaattaa

SEQ ID NO: 2750 - DNA, 549 bp, Staphylococcus epidermidis
tacaattatagttgcattaagtcattttttttacaaatggaggtaaaacctattatggacaaacacacgaattacaatgaattagaatctaagaatgtgtctgatcaaacttcatcagacaatttatcgaatgacaatatagtacaccagcaatcaactattcaaaatgaggaaagtcaagataatcgtttaatggcaatgttaatttatttattaagtttatttactggtatcattggtcctttgattatttggttaatcaaacgtaaagagtcccgacttgttgatgtatctggaaaaacgtatctaaactattttatttcttatactatctattcaacagtaggcgtgatatgtatgtttatgattgttcctttaatgaatataagtgaaagtttagccatcttttcattgattttgttgctggtggtagtttttatcttattagcattgttaataatgtcatttgtgtgtacaattattgcttgtgtaaaatatatgtcaggcaaaacttacactatcccactcacgataccgtttataaaataa

SEQ ID NO: 2751 - DNA, 162 bp, Staphylococcus epidermidis
tctccacccagtaatataattattaggaacccaataatgtttgcaattatagaaacaattccagcttttttagaacctataaaaatccctattagaattaacaaaccacctattatgctgggcattaaaaatatttgtccaaatccatctaaaactgattga

SEQ ID NO: 2752 - DNA, 333 bp, Staphylococcus epidermidis
aaagggtggctctttatgaaactttatcttattttattgcctgttttatacttaattgtttcgtacattagtatttttaaaatgcattctgtcataactcgaatcttgagaattgttatgggcatattgttactatttgtagttgctttgacaacgttacaattccctaaagaaaattggtgggtatttgtcgttttattgcttttagttggtaatgttgaagtgactggttttaaagaattaaaagatgataaaaaaggtgttagtatcttgaatatcttatcacttttattatttgttatatttattattttaatttttatactatattaa

SEQ ID NO: 2753 - DNA, 345 bp, Staphylococcus epidermidis
tgcaacgaaagaagggagataaaaagtatggcttggttatttctaatgatagccggaagttttgaaattttgggtgttgttctgttaaatgaactgtcacgtacaaagaataaaatttatgtcatttttttaggattagcatttatattaagctttagtactttaaaatttgcaatggtatctattcctatggggactgcatacgctatatggacaggaattggtacagctggtggtacattaattggaatgattttttatggagaatctacacgtttaagtagaattttatgtattttattaatcatcatttcagttgttggattacgtttaataagttattaa

SEQ ID NO: 2754 - DNA, 1722 bp, Staphylococcus epidermidis
ataagcatgagttttaaaatgacacaatctcaatacacaagtctttatggaccaactgtaggagactctgtgagattaggagatacgaacttgtttgcacaagttgagaaagactatgcaaattatggagatgaagctactttcggtggcggaaaatcaattcgtgatggtatggctcaaaatcctaatgtgacaagagatgataaaaatgtagccgatttagttttaactaacgcattaattattgattatgacaagattgttaaagcagacatcggaattaaaaatggttatatttttaagatcggtaaagctggaaacccagatataatggataacgttgacatcatcattggtgcaacaactgatattattgctgctgaaggtaaaattgttactgccggcggtatcgatacacacgtgcactttatcaatcctgaacaagctgaagttgcacttgagagtggtattacaacgcatatcggtggaggaactggtgcttctgaaggtgctaaagcgactactgtaacaccaggaccttggcatattcatcgcatgttagaagcagcagaagagatgcctattaatgtaggatttactggtaaagggcaagctgtcaatcatactgcacttattgaacaaattcatgcaggcgctataggtcttaaagtacatgaagattggggagctacaccttcagcattaagtcatgcattagacgttgcagatgagtttgatattcaagtcgctttacatgcagacacattaaatgaagctggatttatggaagatacaatggctgctgttaaagatcgtgtattgcatatgtatcatactgaaggagctggtggtggtcatgcacctgacttaatcaaatcagctgcatattcaaacatcttaccttcttctacaaacccaacattaccttacacgcacaacactgtagatgaacatttagacatggttatgatcactcaccatcttaatgcttcaataccagaagacattgcatttgcagattctcgtatacgtaaggaaactatagcagcagaagatgtattacaagatatgggcgtatttagtatggtaagttcagattcacaagcaatgggacgtgtcggtgaagttgtaacacgtacttggcaagttgcacaccgtatgaaagaacaacgcggaccactagatggtgactttgaatatcacgataataatcgtattaaacgttacattgcaaaatatacaatcaatcctgccattacacatggtatttctgactatgttggatctgtggaagcgggtaaacttgccgatttagtaatgtgggaaccagaattcttcggtgccaaacccgatcttgttgttaaaggtggcatgattaactctgcagtaaatggtgatgctaatggctccataccaacatcagagcctttgaaatatcgcaaaatgtatggtcaatttggtggtaacattacacatactgctatgacttttgtttctaacactgcatatgaaaacggtatttatcgtcaactcaatctaaaacgaatggttcgaccagttagaaatattagaaatttaactaaggcagatatgaaaaataataatgctacacctaaaatagatgtagatccacaaacatatgaggtattcgttgatggtaataaaatcacaagtgaagcagcaacagaattacctttaacacaaagatacttcttattctag

SEQ ID NO: 2755 - DNA, 156 bp, Staphylococcus epidermidis
tcattcattttttcctttcttataaaaaatctgaacgctctcaatttatctatagaagcgttcagatctgaatgtagtagttatttacctttaagtttacgtgatattttaattttagctttcgttaaacgaggtttcactttctcaactaaatga

SEQ ID NO: 2756 - DNA, 774 bp, Staphylococcus epidermidis
ttattggtgagtggaaaggatacaatgatgaaaaaagataaaaaaaggcaaagttataggtttaaagatatagtatggcgtgatttcagtttaattgcgataggctttctatgtatatttatatttagctttataggtttaacaattgctgctatagcttttcaaagtattaatgaattacaacttactatgattggaactctaggacaatttatgtcatatattttagtgatattagctttttattttttacatatcaattcatttgtagatagagttaagagtggttttgattatttgaaaaagcattggttgtttataattatcgtcatgtgtgcatcttttattatttctaatgtttatgacaaattaattgaactattacctaaatatttgcaatatagtgaaacgcaaaatgaacttgaactcaatgaattatttaaaagtggtatatttattccttttgcatttgtacttattgtaattgtaggacctattgttgaagaattggtatttagacatttgttaataggtgaactaggtaaaaagtttaactttattgtgatgggggttatatcagcattgtcttttacatatatacatgtgagtgatgctaagtccccatttgaatttggagcatatttaatactggcaatagcattagtatatgtttacttaaaatcgaatagaaacttagcttcatcaattagcttacatatgttaaataatttcatatcattcatttggacaattatagttgtattcagtaaatga

SEQ ID NO: 2757 - DNA, 207 bp, Staphylococcus epidermidis
aaaaaatggaggtcgctcatcttgactattattatcggactcattgtaattattttgttaatcattagtttacttccaaattataaagcaatggtattagctaagcagcaaggccaaaaacctacacgatatactattatggtaggcattgatttattattaattatacttattatagtaacattagtattaaaattgattatgtag

SEQ ID NO: 2758 - DNA, 156 bp, Staphylococcus epidermidis
atcaccattgggatgagatttcacaaatgcgtcatgttgttgattagtgatgttcatcttttccatggtttaaaatatctcctttattttacagtaattttaattatacatcttaatgagaacgatgtcgacgatgtcactttcaaaccgttttag

SEQ ID NO: 2759 - DNA, 132 bp, Staphylococcus epidermidis
ttcatatatggtgccaatatccaagtcattacacttgcaatcatggcactgattcctactttccaattcactgcaaacagtccaattaaaatgaataacccagtatatggattattaattaaaaccacttga

SEQ ID NO: 2760 - DNA, 156 bp, Staphylococcus epidermidis
agtgctttcggacatgttgctttcgttgaaagtgttaataatgatggttctattactgtatcagaaatgaactgtgatggtggtccattcgctataagcacacgaacaatctctgccagtgaagcaagttcatataattacatccacctgaattaa

SEQ ID NO: 2761 - DNA, 129 bp, Staphylococcus epidermidis
ctactgctcggaaatatatttttaaatcatttactgaatacaactataattgtccaaatgaatgatatgaaattatttaacatatgtaagctaattgatgaagctaagtttctattcgattttaagtaa

SEQ ID NO: 2762 - DNA, 141 bp, Staphylococcus epidermidis
ctcaattcaggtttaattaatttttctattgcaagtttaattgcaccagttgagccaggaagtgcaaaaattaaggtgctatcacaggtacctgcaatagctcgagttaataatgctcttgtaccaacatcttcggtataa

SEQ ID NO: 2763 - DNA, 750 bp, Staphylococcus epidermidis
tcataccaaggtgttgaattgattggcatctcagcaggtgaaaccaaaaatcctcaaacaaatattgtaaaggcagtcaacggagtgatatggagaattttaattttctatattggtgcaatttttgtcattgtatcagtatatccttggaaccaattaggtagtattggtagtccttttgttgcaacgtttgctaaagtgggcattacgtttgctgctggtttaataaactttgtagtcttaacagcagcattgtctggttgtaattcaggtatttttagtgcaagtcgaatgatttatactttggcaaaaaaaggacaaatgcctaaagtatttactaaagtaatgaaaaatggcgtacctttctacactgtatttgcagtatctatgggaatattaattggtgctttattaaatgttatacttccattaattattgatggagctgatagtatctttgtatatgtatatagtgcctctattttaccgggaatgataccttggtttatgattttatttagtcatctaagatttagaaggttacatcctgaaaaggttcacaatcatccttttaaaatgccgggaggggcaattgccaattatttaactatcatgtttttactcctagtattagtcggtatgttacttaacaaagaaactgtagtatcggttgttattggtatcgtgtttttaacagctgtgacactttattatcttattagatatcacaaaaaggaacgacaaatataa

SEQ ID NO: 2764 - DNA, 255 bp, Staphylococcus epidermidis
agcaaaaaaggggaaagcaagatgaaaattttatattttgcagagttaaaagagttgctcaatcaatctactgaaacgatacatttagatacgacattaactgttcaggaattcgagtcatatttattaaaacaccatagtgaacttaaatctaaaaaatttcaaattgctgttaatgaagaattcgtcagacaggatgatatagtccaaccaggagatacaattgcgctcattccaccggtcagtgggggttga

SEQ ID NO: 2765 - DNA, 657 bp, Staphylococcus epidermidis
atattgaaaggagatgacaatatgtataaagctgtagtgtttgattttgatggtactgtcattgataccgaaaagcatttgttcgatttaataaatacacatttaaaaatccatcaagtagcgccgatttctttagaattctataaacaatttattggcggtgaagctactgaattacatacatatttagaagatgctattggtttcaaaaataaagaaaaaatttatgatcaatattatcaaacaagtgttgaattgccggtaaatcctacaatcattcaattgatgcaatatttaaaaaaacgtcatatcccaatggcgattactacaagtagttataaaaagaatatatatcctatatttaaacaattaggactagatacatatattgatgttgttgttggtcgtgaaaatgtcgatagtgttcaacctaatccggaaatttttttaaaagccgtacaagagcttaattataatcctacaaattgcttagcaattgaagattctgtcaatggtgctactgcagcgatgctagcaggattagatgttgtcgttaatacgaatataataacgaagaatcaagatttttcgacagttcaatgtgttggacaagatatggaatttgaagatataaagaattttttatttaaagaatga

SEQ ID NO: 2766 - DNA, 378 bp, Staphylococcus epidermidis
tacataagaggaaaactaacaatgacagatgcaatcactgcacctgtcaaagtaaatacaactggtaagtgtaagatattagtaaagaattctcctacaggacttcttgttgaaaatataattaatagtataaaaccaaggacagtaggtggtaacacaattggtaaaatgataaaactttctaatagatttacccaatatctatttttattgtatagccatttagaaatcaaaatgccaaaaatagtaactatcattgtactgattaaagcaacacgaaaagaaatccaaaaggacgttaaatcaggcatagctctgaactccttatacagaaaattgatattctttaagaatttgtttagctttattggattttaa

SEQ ID NO: 2767 - DNA, 795 bp, Staphylococcus epidermidis
ttttcaggaggatatttaacaatgaaaaaaatcgctacagctacaattgcaactgcaggaatcgctactttcgcttttgcacaccatgatgcacaagcagcagaacaaaacaatgatgggtacaatccaaacgacccttattcatatagctacacttacacaatcgatgctgaaggtaactaccactacacttggaaaggtaactggagtccagatcgtgtaaatacttcatataactataataattataataactacaactactatggttacaataactatagcaactacaataactataataactacagtaattacaacaactatcaatcaaacaacacacaatcacaaagaacaactcaaccaactggtggtttaggcgcaagctattcaacatcaagtagtaatgttcacgttacaacaacttctgcaccatcatcaaacggtgtatctttatcaaacgctcgctcagcatctggtaacttatacacttcaggtcaatgtacatattatgtatttgacagagtaggtggcaaaatcggttcaacatggggtaacgcaaacaactgggcaaacgctgcagcacgttctggttacacagtaaacaattcaccagctaaaggtgcaatcttacaaacgtcacaaggtgcatacggacacgtagcatacgttgaaggtgtaaacagcaatggttcaatcagagtttcagaaatgaactacggtcacggtgcaggtgttgtcacttcacgtacaatctctgcgagccaagctgcttcatataactatattcactaa

SEQ ID NO: 2768 - DNA, 1164 bp, Staphylococcus epidermidis
gtcatagggggcgtaaatgtgatggagtcttttttaattcacactgacattcaaaagaagtggattcgtaaatttaaaaagattgaaagtgaattcaaagcacgtgcagctgaaaatgatattcaatctagatttccatatgaaaatattgagtggctgataaaggaaggatatactaaactaactttgcctgtagagtatgggggtgaaggtgctactattgaagatatggtaattttacaaagttatttgggtactattgatggagcaactgctttatctatagggtggcatttgagtgtaattggtcaattgtacgagcaacatatgtggacaccatcaatgttagattcctttgctaaagaagttgttcacggtgcactgatcaatagagcagtcagtgaagcggaaactggtagtcctactagaggtggtcgcccatctacacatgctgttaaagctgaaaatggttatgttataaacggtgttaaaacctttacatctatgagtaaggcgttgacacattatattgttggcgcgtatgttgaagaaactaaatcgatgggattctttttaattcctcagtcaactaaaggtgtaagtattgctgacaactgggatatggttggtatgagagcgactgagagccatgatttaattcttgatgatgtttatgttcctaatgaaaattttgtagaatcaaaacgtgaatcaagacctaatggttggcttcttcatataccgagctgttatctaggtattgcacaagcagctcgtgactatgcagtagattttgcaaaaaattatcgtcctaacagtattacaggtacgattgatagtttacctacagtgcaacaaaatttagggaaaatggaaagtttattactttctgcaagacattttctatggagtacagctagagggtatcaatcatatacagaggatgcacaaatatggaatgaaacctcagcaagtaaagtggtggtaatgaaccaaagtatagaaatcgttgatttagctatgagaatagttggagctaagagtctagaaatgagcagacctcttcaacggtactatagagatatacgtgctggattacataatccaccaatggaagatatggcttacactaatattgctaaaagtattacaaacaaactttaa

SEQ ID NO: 2769 - DNA, 150 bp, Staphylococcus epidermidis
attttaattatatcaattttcttttatatttatatagatttctcaaaatattgctcaatcatatcatcaaatcaacgtaaaatatcaaaaattcaaatactgtttattcacattgctctgttaattattatcaaaatgaattttcagtaa

SEQ ID NO: 2770 - DNA, 456 bp, Staphylococcus epidermidis
gtcatgattatagaagaaattcaaggaaatattgctaatttatctcaagatgaaaagcaaaaacatgtcgaaaaagtttatcttgaaaactcagatttggttaaacgtatacaacgtgttaaaacagatcacggtaatgaaatagggatacgtcttaaacaacctattgacctacaatatggtgatattttatatcaagacgatacaaacatgattattgtcgatgttaatagcgaagacttattagttattaaacctagaaatttaaaggaaatgggagacattgctcatcaactaggtaatcgccatctacctgcacaatttacagaaactgaaatgcttattcaatatgactatcttgttgaagatttattaaaagagttgggtatcccctactcacatgaagacagaaaggtcaatcaagcatttcgacatataggacattcgcatgattga

SEQ ID NO: 2771 - DNA, 141 bp, Staphylococcus epidermidis
acaacatctatttttcagtgtctattatacaactctcgaaaaattagtagtaacaaattagattttaattatatcaattttcttttatatttatatagatttctcaaaatattgctcaatcatatcatcaaatcaacgtaa

SEQ ID NO: 2772 - DNA, 918 bp, Staphylococcus epidermidis
atggaggctataaaattgaaattgataaaagtaattttaagtagtatctctcaagtggttttaattaataatccatatactgggttattcattttaattggactgtttgcagtgaattggaaagtaggaatcagtgccatgattgcaagtgtaatgacttggatattggcaccatatatgaattacacaaaagaagaaatcgaaagtggattagccgggtttaaccctgtattaaccgcaattgcacttactttatttttggatagcaattggagcggtatattaatcacattcgtagccactattttaacgctaccgattggagcagcgattagagaagtattgaaaccacataaaatagcatttctaactagtccgtatgttattatgacgtggattacattattaatacctaatcaacttaaaacgttacatactcagattgatattattccggagcatatagaaaaggtatctttaaataatgaccacaccagtgttcatttttttcaatcagttttagatggatttggacaaatatttttaatgcccagcataataggtggtttgttaattctaatagggatttttataggttctaaaaaagctggaattgtttctataattgcaaacattattgggttcctaataattatattactgggtggagactatagtagtataaatgaaggcatatttggctataatgtagttttatctgcgattgcgctaggtgtcacttttgagacagcaattcatagttatctcgcaatgattttaggaatagtactcactgcattcatacatttaggtttgagcacattgctcgcaccactaggtttaccaactttaacatggccatttatttttgctacatggattatgttgtttgcaggaattaaaaatcaaactgtataa

SEQ ID NO: 2773 - DNA, 1983 bp, Staphylococcus epidermidis
ggaagacatatgagagaaaattattcgatacgtgtttttaataatttagccattaatacagaaaatgcactgagtgtaaaggtattttattgtttgaaagggaaatgtgaagtcactatcaatgttcagaaacatatattagaaaaagatgatatagcatttgttgtaatgaatgatacgtattcactgttaagtaatacagagaccatgtgttgtattatcgatatacctatacatcgatatcttagtcagaaggatactcaatttttaataagtggtacaaagattgatgaaagtagtagagatagaataaaatattggatattaaaaatattagagctccattgtttatcttataatgatgtgtccgagatacaaaggttgatacaatttttacttattgaattgagttatctaaagaaaccaaaacttgatgtaaataaagatttttatttatctgaagatatacatcaatatttagtggatcatcatgacagtaaaatcaacaaacatgaactagctgaagctgttaacctatcaaatcaagcacttacatctatgtttaaacaaacgccatttcaaacatttaatcaatatttaaatcaacttagattaaaattttgtcttatagatattttgacaacccataaacctatcgaagaaatagctatagatcatggttttcatcattattctcgatttatacaattattcaaaaatacatatggttacacacctaaattgattagaagagattatatagcgacgtctatcttcaaaaatactgctgaagaaattgatttagatagacattttcttatgaacattcacgaattacaagatttagattcaaaaataataagtaaaaaatatattaagatgtcagataaaggaaaaaaatatcgatcttatgatatttatattgaagataaccgaagtactattcttgatcaggagcagatagttcatataaagcgtaatttaagtttaagtcaaaaatcaatgcgttatgtaatagaacttaactacacttctatgattgaaaacaaagagttatgtcgttatgagatgttgaaaattttacgtttttgttccggtttgaatttaattccaacatttaaaatcattaccgatcgacatgatacttttacatcaaaggaaaaaatggctctgaagttaacatttcaaatgttattcatcatgcttagggaatttaatcaacttgagattgaatttatagtagaggacatgatgttaaaacaagtggtgcagttaaaaaagatgattagctcttattttgaatattataaattaaattatcgtattaaaaatgagaaaattggaaatgttaattatcaaaatttagaaaaacaagtgactcaaattttcattcctattgatcaattacatttatatattaaagagatatcatttgaaaaagtcattttggaaaccagctatttgaccgatttaaaaagtgagattgtagaatattcatggattcaacatattcatacattaattaaaatgagtggagaagtgaggggagttttaatacaaccgtcctatgattacgctgccacatacacatatcattcaaatttaaaaccgtatcatatcttgtcttatgtaataagaatgtttaaccaattaaggggtacaatcgtctataaagatgatgcaatcattatgactaaatataagtatgaatatcaggccattgctatctttttaaaaaataggattaaggaaaatgtaaaccatcaacaattaattttttcagatattcaatcactcaaccatgcagaatatgaatatatagaaatgatgccacttttaatgaatgagaataatgagctagatagtcatataccatacccacatcaatattggttagcaaagttgaagagtaaagaaagccaacaagcaatagttgatcttcctaaaatgagtattgctcatttaacatttctttgttcgtag

SEQ ID NO: 2774 - DNA, 159 bp, Staphylococcus epidermidis
ttttggattttcactcgtatgtccgttcgagggatgaataaagccaaaagacaactaagatttgtgctaatgacacttaatataataaaagtaacaacccaacgagctgaaaataatcaaaaaatcataaaaaagacaatttctatattatttcaatag

SEQ ID NO: 2775 - DNA, 207 bp, Staphylococcus epidermidis
tctttatacataaggcacctcgttaaattagtttattggtatttattaaattatacgaaagggccatattttttaaagtattttaatataaaattacatataagcacaaagtattttggcgagactcttgagggaacaggacaagctgaagactacaggctgaagctgtccgataagaaagcgagccaacaatacgaagtattgtaa

SEQ ID NO: 2776 - DNA, 129 bp, Staphylococcus epidermidis
tctctatacataaggcaccttgttaatttagtttattggtatttattaaattatacgaatggcctcatctttttagtatttcaatgtaaaattgcatataaaaacaaagtattttggcgagattcttga

SEQ ID NO: 2777 - DNA, 804 bp, Staphylococcus epidermidis
ggaggtaacatagtgtttgaagaattagaaaataaagtggttcttattaccggagctgccactggaattggtaaatctattgcggaaaactttggtaaagctaaggccaaggttgttataaattaccgttctgatcgacatcatagtgaaattgaggaaattaaacaaactgttgctaaatttggtggtcaaacattggcagttcaaggtgatgtttcaattgaagaagatattaaacgaatgatcgaaacaacaattaatcactttggaactttagacattataattaataatgctggattcgaaaattcaatcccaactcatgaaatgtcgattgacgactggcaaaaagttattgacataaacttaactggcgcctttgtgggttcaagagaaaccatcaatcaatttttaaaggaaaacaaaaaaggtactattattaacatttcgagtgttcatgacactattccatggcctaattatgtacactatgccgcaagtaaaggtggcttaaaattaatgatggaaacaatgtcaatggaatatgcccaatacggtattcgtattaataatatatctcctggggcaattgttactgaacacactaaagaaaaattttctgacccaacgacacgtgaagaaacaataaaaatgatacccgcacgtgaaattggaaatgctcaagatgtagctaatgcagtactattcctatcttcagatcttgcaagttatatacacggtacaacattgtacgttgatggtggcatgatgaactatccagcatttatgggtggtaaaggttaa

SEQ ID NO: 2778 - DNA, 873 bp, Staphylococcus epidermidis
ttgccaaacattttgtataagattgacaaccagtatccctatttcactaaaaacgagaaaaaaattgcgcaatttattctcaactatcctcataaagttgttaatatgacttctcaagaaattgcaaatcaattagaaactagttctacttctatcatacgtctaagtaaaaaggtaacacccggtggctttaatgaacttaaaacacgtttgtctaaatttttacctaaagaagtcacacaatataatgttgagttagttgataacgaaagtacaatttcacttaaaaacaaattgcattctcgctctaaggcagcgttaagtaatgctaatgaaaccattaacgctgctatcatcgatgaaatttgtgatctaattaaaaattctgaaaccatatttatttacggctatggtgcctcatttgttgtagcaacagatttatatcaaaaattatctcgcatcggtctaaatattcaactagtgcatgaaactcatattttcaccactatgttagcaacacgtaactctaatgattgtgttatatttatatctaacaatggtactcaaagtgaaatgcaatctattgctaaagtcattgcagactatcacattcccattgcgactatttcaagcacttctgataatccagttgcaaagcaatctaatattgttttaacctatggacaaaccgatgaaaatgagatgcgtatgggagccacaacttcgttatttgcacaaatgtttactattgatatattgtactatcgatatattgcgctaaattatcaatcatctttagattttattactcaatcaaaaattgcattagataattaccgtaaacatctctcgaatatagattttaaacattaa

SEQ ID NO: 2779 - DNA, 699 bp, Staphylococcus epidermidis
gacattcgcatgattgatcaccaacatttaagactttttcagttctgtgattctcagtttcctacaggtgcatttagtcattcttttggacttgaaacatatattcaacgagaaactgtacatgatactgagacatttattaaatggttacatttgtttataaacgaacaattaacttattcagatgggttagctatgagaattgtctaccacgcattaattaacaatgacaaagataaaattttagatattaaccaaaaactcttcgtacaaaacctacctaaagaaacgcgtattggcgctaagcaaatgggtacacgcatggtaaaattagctttagatctttatgatagtgaatggattcaatggtattataatcaaatgaaaaaccataaaattaagcttcatcctgctgtgtgctttactatgctaggacattttttaggtgtagatgtggaatccatcattgattattatttatatcaaaatatctctagccttacccaaaatgcagtaagagcgattcctttaggacaaacagctggacagcaagtcgtaactgaaatgatagcccatattgagaagacacgaaatcacatactagaattggacgaaatcgattttggtatgactgctcccggcttggaacttaatcaaatggaacatgaaaatgttcatgttcgaatctttatttcatag

SEQ ID NO: 2780 - DNA, 588 bp, Staphylococcus epidermidis
aatataagcattcatatcattttcatacatatattgttaacgattggaggtccccatatgttgattgataaatttgaaacctacatcattaatgttgcaggtttgaaatctcgctcaacgcgaaaaaaattaatacatttatgtaaagaaattactttttgtgaatcttttcagtattctatcattaagcaaaacaatgtgttcgcattggaagttagcctccccaagctacaactaccttatctgataagtttcttaagtttccacaattatgctatttatcaaatacttttacccaaccgtgtaaatgaacttcttgattcagaacaactttaccaatctattaaacgctttgatttagcgatcgatggtttacaagatgccttcattaaagataaagtcatcgatattatgaatatgtttgcgaatcatcataatgtgaattatacattaaataataattgcgcgagcgtcacatgtcctcctgagattttcacaaagctgcttcaaactattgcaacgcgtaatattgatatcctatcagcaagttatagagcaaaaatgctacataaagcacgcatttcatga

SEQ ID NO: 2781 - DNA, 138 bp, Staphylococcus epidermidis
tgcaatataatccttaaaaatttagcaaaaatgtttaaaactaaaataagagaatatttaactcagccatctttaatttgcaaaaaacctagaacatttcgttctaggtttttaactcaagcattacactatatgtga

SEQ ID NO: 2782 - DNA, 186 bp, Staphylococcus epidermidis
gtaagtataatcatcttacctaagtcgtttttttacatattaaactttttagtaattttattttttaaagtgaataaaatttcgtatataaccggtactacaaagagtgtgagtagcgttgaagaaattaatccacctattactgttgcagccataccttttgaaattaatattgaactgtcatga

SEQ ID NO: 2783 - DNA, 177 bp, Staphylococcus epidermidis
ttaaaaataatgaatatatatctaatctttctattgttaatgcttactttaaattttcactctattgtaaaagaaatatttaaaaattcaaaaggggtatatgcttacgaatattcttttaaacctaaaaaacctgagacatcttttattgtcccaagttttttatcatatagctaa

SEQ ID NO: 2784 - DNA, 621 bp, Staphylococcus epidermidis
atgctcacaattaaagtgaatggtgttctttatcagacgaaaattaatataaatatagaggatcaacaccctaagatatatgcgatacagggaccatctggaattggaaagacaacaattttaaatataattgccggtttgaaatctataaattattcatatataaaggttggtaaacgtgtattaacagattcacaacaccatttgaatgttaaggttcaacaacgtcgtataggatatttatttcaagattatcaacttttccccaatatgaatgtttataacaacataacgtttatgactaaaccttctgaacatatcaatgaacttattcatactctaaaaatagagcatttacttgaaaagtatcctgtgaccttatcaggaggtgaagctcagcgcgtcgctttagcaagggcgctaagtacgaaacccgatttgattttgcttgatgagcctttttcaagtttagatgataagacaaaaaaagaaggtatcaaattaattttaaaaatattcgaagcatggcaaattcctattatatttgtaacgcattcaaattatgaagcgcaacaaatggcgcatgagattataacaattgaagattgtatacaaatatag

SEQ ID NO: 2785 - DNA, 690 bp, Staphylococcus epidermidis
  modified_base (498)..(519): a, c, g, t, unknown or other
gtcgcaacaatatcttcagcaagaatatgtcctaaactttcatctaaattaacattgatattcttcacttcaacctgttgtttcataatacgtttaattgcttctttaactgatattggcgttcttttctctatagacatacactcatctccaaaaaatattaattttcatgatatacttactcctaacaggagggaaaaaatgactcatttcacacatattaataaacaaggtaatgctaaaatggttgatgtttctaataaggaaattacaaaacgtgtagcagaagcacactcaagtataattgttaatgaaaaaatttatagacaaattactcaaaatactaatagtaaaggaaatgtacttaatactgcgcaaattgctggtattatggcagctaaaaacacttctacaatcattcctatgtgtcatccattaccacttacaggcatagatatatccttcaaatgggattcaaataatgatgattcatatcgnnnnnnnnnnnnnnnnnnnnnntctacaacaggtaaaactggtgttgaaatggaagcattgactgctgcttcagttacagcacttacaatctatgatatgacaaaagctatagacaaaggcatgataattggagaaacgtacttagaatctaaatctggtggtaaatctggcgacttccacagaaaaaattga

SEQ ID NO: 2786 - DNA, 399 bp, Staphylococcus epidermidis
ttagataaaattatcaaagtattatacttgtatacttcattaaatagttttaatataaaattcgcaagacaaattaatatgaaagaagggatagttttgcactttacacaacgtgaacaagacaaattgatgatagttgtagctgctgaggttgcacgtcgtagaaaagcaagaggacttaaacttaatcatcctgaagcacttgctttaatcagtgatgaattattagaaggcgcgcgtgatggtaaaacggtagctgaacttatgagctatggaaaaacaattttaaacgaggaagatgtcatggatggcgtagctaacatgattacagaacttgaaattgaagcaacttttccagatggtactaagttaataacagtccatcacccaatcgtttaa

SEQ ID NO: 2787 - DNA, 1128 bp, Staphylococcus epidermidis
aacatgaaaatagcaatagtaggcgcaggtataggtggtttaactgctgctgcgttattagaagaacaaggtcatcaagttaaagtgtttgaaaaaaatacttctataaacgaattaagcgctggtattgggataggagataatgttttaaaaaaattagggcatcatgaccttgctaaaggcattaaaaatgctggtcaaaatcttaccgcaatgaatatttatgatgagcaaggcaccccattaatgagcgctaaattgaagtctcattccctaaatgtcgcattatctagacaaactttaattgagatcatacagtcatatgtcgaagaatcatctattcacacaggatttaaagttactaaaattgaacaaacgagttgtaaggttaccctacattttaccaaacaggaaagtgaatcgtttgatttgtgtattggtgctgatgggttacattctgtagtaagagagtctgtaggtgcacgaactaaaattcgttacaatggttacacatgttttagaggcatggttgaagatgtacaatttaatgaccaacatgttgcgaatgaatattggggtgttaaaggacgagtaggtatagtcccattaattaatcaacgtgcttattggtttattactgttcatgctaaagaaggagatccaaaatatcaatcttttggaaaaccccatcttcaagcatattttaatcactttccaaatgaagtgagaaatgtgttagaaagacaaagtgaaacaggtatattacttcatgacatatatgatttaaaaccactgaagacattcgtttatggacgtactattttaatgggcgatgctgcgcatgccactacgcctaatatgggacaaggtgctagtcaagctatggaagatgcaattgtattagtgaattgtttagaaaaatatgattttaataaagcgattgagcgttatgataaacttagagttaaacataccacaaaagtgattaggcgttcgaaaaagataggtaaaatggctcaaaagcatcataaattaactgttaaacttagaaataccgcgatgaaattaataccaaatgctttggcatcagctcaaacaaaatttttatacaaatctaaagaaaagtaa

SEQ ID NO: 2788 - DNA, 924 bp, Staphylococcus epidermidis
aaagaaggaatcaatgtgactgaacaatttgtcataattatattattaatagcacttggttattttcttaaacgtatgaattacttgaaagcaactgatagtcaagtactttcaactttagtgttaaatgttacattaccttcactcgttatagttaacttaaatagtgcaaaattagatgtatctttttcaatattacctataatgatgattatttacggtatagtagctaaaattattgtaatttggttctttagaaaatatgataaccatatgcgtggttctgttggtatgatgactggatctatgaatattggtttgtttgcttatccgttggttgaagcgatatggccatctaaaggtatgatatatttcggaatggttgatattggtggggccattatcatgtttggtattacttattttgtaggaagttattttagcgaaggtagtgaccaatttaacttcaaatttttaggaaaaaaattagttcaatcagtcccattagtaacctatatgattatgtttggattgaacatgtctcatattcatatatggcaaccagctattgatttctttagtgtattatcaaaggcgaatatgcctttatccatgatattattaggtgtaatgcttaattttagtattgagagagaatacctccctgtaacaattaaatatctttgtttacattacgggttaggtatgttagctggaacactagttcactttttattacctgtatctgatgatatgattaaaacaaccttgcttataacgtggttattaccagtaggagtagcaatcataccatattcgattcaattcaaatataagacattaccatttgttggaatggtaactaatttaaccattattattagcattatcattttgtatatttatcaagctgtatttgtataa

SEQ ID NO: 2789 - DNA, 135 bp, Staphylococcus epidermidis
aaaaacttgattatctatgtaataaaagataaccaagattacgaactcaatttatattgtttatgtgcttcaaatcaagatttgatggatcaaaaagtaaataagttcaagtgttttattacaatgattctgtaa

SEQ ID NO: 2790 - DNA, 849 bp, Staphylococcus epidermidis
ccattgttgatagagattacattgaatttagcaatttacaacgacaaacgctcttttatagagcgtgatgcagaagatgtactaccaaaagtaatcgctgcacagaaagttttaaaagagatacgtaaagatgtagagatagatgcttatattgagcatgttaattacaatttcttagagcaacatggcatgcatgtcgatatcatattagatgcaactgataattttgatacacgtcagttaattaatgactttgcttataaacatcagattccttggatttatggtggtgttgtacaaagtacatatgttcaggcaacgtttattcctggtgaaacaccgtgttttaattgcttaatgcctcaattaccatctattaatttaacatgtgatacggttggagttattcaaccagctgtaacaatgacaaccagtttacaactcgttgatgcattgaagttgctgactggtaataaggttaataaacacttcacttacggggatatttggacaggagatcattatacatttggttttagtcgtatgcaaaatgaagattgtaaaacttgtggtaatgctccaacatatccacaccttaatcaacatcaacaagattatgcgaccttatgtggaagagacactgttcaatataaaaatgctgatatttctcaggaaatattactatcatttctcgagcgaaatcatattcaatatcgcacgaatttatatatgacaatgtttaggtttagagaacatcgaattgttgcattttctggaggtagatttttgatacatggaacgacggaacctaaaaaagcaattcaattaatgcatcaactatttggttaa

SEQ ID NO: 2791 - DNA, 1089 bp, Staphylococcus epidermidis
ttagccatgattaggtatcaagaaggagtgtttaaaatgcttggtttctcagtctatctaggacagaatttagatcgagattatattttaaatatggctgacttaggctatgatgtagtttttacttcactacagatacctgaggaagacaagaaaaatcaaatggcttatttgggagacttatgccaactattatcagcctatcaaatcacttatattatcgatgtaaccccttcattacttaatcaaactatttacagttatttgaaccaattacctcatggggatttttatattcgtatagataatcaattaaatattgaccttatcaaagacattatcagtcacggcttcaaatgctgtcttaatgctagtacattaactgatagcatgttagcgcacatatattgtactgattttaataatcaacttttatactgtcataattattatcctagacctgatactggtttatctatctcatttattgaagaaaaaaatcaactcataagaaaatacgatgcgcatgcaaaaatttgtgcttttatacctggcacgcagaagagaggccccttattcaaaggtcttcctacagttgaaaaacatcgttttgaacaccctcttattgctgcacaagaccttcaattaacgggtatatctgacattataattagtgatacgctattatcacacatttatgcggaacaattatctaatatgtggctatatcgacactttattttacacttagatcaactagactcctcatttacatcacaagttttaaagatacacacatcaagattagattcacctgaacatgtaattcgatctcaatattctcgtacagataatcaacagactgtcccaatgataggatcggcacatagagatcaaggagatatcacaattgataatcacttgaatggtcgttatgaaggagaaattcaagttataaaagctcctatgccaggtcattcccacatcaattgtattggtcatgtttgtgataaagatgttccattgttatcactgattcaacctggagatacttttaaatttgtatatacgaaggagaataacaaatga

SEQ ID NO: 2792 - DNA, 771 bp, Staphylococcus epidermidis
ggtgttaagatgattttagatgaacgtgtaaactctaatttcgatcaattaaatgataatgatatacaaattgcacattatgttaatacacatatagatgtttgcaaaaatatgaaaatacaagatttagcctcacagacacatgcttcaaatgctacgattcatcgcttcactcgtaaactaggttttgatggttatagtgactttaaatcctttttaaaatttgaagatagtaagaatcatcaacttccttctgattctatggagcaatttaaacaagaaattgaaaatacattcaactatttagaacgtattgattatcgtttattaactcacaaaatgcatcatgctacaacaatatacttatatggtactggacgtgcacagatgaatgtcgctgaagaagcacaacgtatactgttgactatgcataaaaatattatattgttacatgatgttcatgaactaaagatggtgttaaacaagacaattccagaagatttgtttttcatcatttcactttctggcgaaacacatcaacttaaagaagtcacacaattgcttcaactgagacaaaaatattttatttccgtaacaacaatgaaagacaatacattggcacaacaagctgattacaatgtctatgtttcaagcaataccttctatttaaacgatggtactgattattccagttttattagctatcacattttctttgaaacactactaagaaaatataacgaatataaagagaatcatgaattaacatag

SEQ ID NO: 2793 - DNA, 864 bp, Staphylococcus epidermidis
gtgcaaattgtagattttttgatagcacttttaccagccctgttttggggtagtgtagtcattataaatgtttttgtaggtggtggaccatataatcagattcgaggtacaactttaggtacactttttatcggattttctctacttgctactggacacgcagcgtttgataacctaacagtaattattgtcggtttagtatcaggagctctatgggcttttggtcaaggtaatcaattaaaatcagtgcatttaataggtgtatctaaaacgatgcctatttcaacgggtatgcaacttgtcggtaccactctatttagcgctattttcttaggtgaatggagcacgattgttcaagtagtgatgggacttatagcaatgatcttattggttgtaggtatttctttaacatcacttaaagccaaaagcgaaggcaaatccgataacccagaatttaaaaaagcaatgggaatattacttctatcaacaatcggttacgtaggttatgtcgttcttggagatatttttggagtaagtggtacagatgctctcttcttccaatcaattggtatggcaattggaggattaatcctttcaatgaaccataatacttcaattaaatctactgctctaaatcttataccaggtgttatctggggtatcggtaacttatttatgttctattcacaacctaaagttggtgtagcaactagtttctcattatcacaactccttgttattgtttcaactttagggggtatctttattctaggggagaaaaaagatcgtcgccaaatgattggtatttggtcaggtattatcgttatagttatagcttcaatcattttaggcaacttaaaatag

SEQ ID NO: 2794 - DNA, 129 bp, Staphylococcus epidermidis
tatttcaatgtaaaattgcatataaaaacaaagtattttggcgagattcttgagggaacaggacaagctgaagactacaggctgaagctgtcccctaagaaagcgagccaacaatacgaagtattgtaa

SEQ ID NO: 2795 - DNA, 171 bp, Staphylococcus epidermidis
tctaaaacagttgcgactataaatttaaaaataatcacaatgtatcaattaaggttaactcaattttcaaattttaatattttcactttatttatgcattatttatacagtttgatttttaattcctgcaaacaacataatccatgtagcaaaaataaatggccatgttaa

SEQ ID NO: 2796 - DNA, 342 bp, Staphylococcus epidermidis
ctaaaaggagttgaaagaatgattttagacaatgtgaatcctgatgatttatttcctaccgagaaaaaagggccctctgtattaggtatgattgagtataacgtgcagggtcagactaaatttgaaggtgccttcatagctacaaatgaacggttaattatgaatgtagatatgaatggacaattttattatcgaaatatacgttatgatgaaattaatcaaattcattttgatggttcagatattatatttgagttcaatattggaacagttccaatgcgtgaaattaagacagaagatgtacaagcttttgttgattatataaaacaacaaattcaataa

SEQ ID NO: 2797 - DNA, 339 bp, Staphylococcus epidermidis
ggatttttggtttcacctgctgagatgccaatcaattcaacaccttggtatgatcaaatcacaatagataaagcaaagaaaaatccaatgaatccatttggcataaatccaccatgtgaccataagttagaaatccctattggattccctccattgcctataccaaataaaattaatcgtaatcctgcaataatcattaatacaatagttacaactttaattaaggcaaaccaaaattcaaactctccaaacgcttttactgaaactaggttagcagccatcaaaaagagaactgctatcactcctggtatccaattaggaaggcttgggaaccagtag

SEQ ID NO: 2798 - DNA, 243 bp, Staphylococcus epidermidis
ataggagtggtagggatgcaaagatcagataaaagaaaaatgagcctgccgatgaaaatactactatgggtagtgggaattttatttctattagcaatcattgcagttatttatgttagtgcaaaaatatttattacaggagacaaaatacataatccgttaaatagaaatcattctgaattacgttctggaaaagtaaatttaaaaatggtgatccatttactattgcactttttggcgtag

SEQ ID NO: 2799 - DNA, 1287 bp, Staphylococcus epidermidis
aaattaatattttttggagatgagtgtatgtctatagagaaaagaacgccaatatcagttaaagaagcaattaaacgtattatgaaacaacaggttgaagtgaagaatatcaatgttaatttagatgaaagtttaggacatattcttgctgaagatattgttgcgacctatgatataccaagatttaataaatcaccctacgatgggtttgcaattagaagtgaagattcacaaggtgcaagtggcgaaaaccgtattgaatttgaagtaatagatcatatcggtgcaggttcagtttcagaaaaaacaattgataaaaaccaagcaattcgaataatgactggtgctcaaattccttctggagctgatgccgtagtaatgtttgaacaaactattgaatctgaaacaacttttacaattagaaaatcctttaaacatttagaaaatatttcgctacaaggtgaagaaataaaagctggtgatattgtactgcataaaggtatgcgtattaactctggtgtgatagcagtcttagctacatacggttatactaaagtgcgagtggctcgaaaaccaactgttgcagtaattgctacaggtagtgaattgcttgaagtagaagatgagcttgaaccaggaaagatacgaaattcaaacggaccgatgattaaagcattagctaaacaatttggaatacaagttggaatgtataaagttcagcatgataatctcgaaaagagtatggaggttgtaaaaaaagctttatcagagcatgatttagtaattactactggaggtgtgtcggtaggagattttgattacttaccagaaatatacaagtctatccaagcgcagatactatttaacaaagtggctcaaagaccaggtagtgttactacggttgcatttgcagatggtaaatatttatttggcttatctggaaacccttcagcctgctatacaggatttgaattatatgtcaaacccgctgtaaataagctcatgggaactaaagcttgttatccgcaaataatcaaagctacacttatggaagactttaataaagctaacccatttacacgattgattcgtgctaaggcaacattaacaaaagctggaatgacagtaataccatctggatttaataaatcaggtgcagttgtagccattgcgcacgctaatgctatgattatgcttcctggtggcacacgtggatttaaagcgggcaacattgttgatgtgattttgaccgaatctaatagttttgaagaagaattgatactatga

SEQ ID NO: 2800 - DNA, 2172 bp, Staphylococcus epidermidis
catgatgtattttataaatgtgaaaggaaaattaaaatgaaatctttaatcttagctgaaaaaccatctgtcggaagagatatcgctaatgctttgaatcttcaacaaaaaagtaatggttatatagaagggaaacagtatatagtaacttgggcattggggcatcttgtgacaaatgcaacgcctgaacaatataacccttcatataaagaatggaatttagaagacttacctatcattcctaagaaaatgaaaacagtagtgattagtaaaacaaatagacaatttaaaattgtaaaatctttaattttagataaaaatgttaaagaaattattatagcaacagatgctggacgagaaggtgaacttgtagctcgtcttattttagatagagtaggtaataaaaaaccaatcaagcgtttgtggattagttcggttacaaaaaaagccatacaagaaggatttaaacggttaaaaaatggaaacgcgtatcaaaatttatatgaagcagcacttgcacgaagtgaagcagattggatagtagggattaatgcaacacgtgcactaacgacaaaatatgatgcacaattatcattaggtcgtgtacaaactccaacaatacagttagttaaatcaagacaagatgagattaactattttaaaccagaaaaatattacacgttatccattaatgttgatggttacgatttaaaacttaaccaacaaaagcgatataaagataaaaaagaattagaattgattgaacatgaaattaaacaccaagaaggaaaaatattagaagttaaaggaaaaaataagaaatcttacgcgcaacctttatttaatttaacagatttacaacaagaggcatataaacgttacaagatggggccaaaggagacactaaatacattacaacatttatatgagagacataagttagtaacctatccccgtacagattctaattatttaacagatgatatggtcgatacaattcaagaacggttaagagcaattttagctacagattataaatctcatgttcgagatttaatttctaagtctttttcttctaaaatgcatatttttaataatcaaaaagtttcagatcatcatgcgattattcccacagaagttagaccatctattgaacaattgagtcaacgagagtttaaaatttatatgctaatagcagaaagatttttagaaaatttaatgaatccttatttatatgaagttttaacaatccatgcacaactgaaagattaccattttgttttaaaagagaaaatacctaaacaattaggatataaagctttaaaagatcaactctcttcgcatactttaacgcattcttttaaagaaggtcagttatttaaagtacatcgtattgagattcatgaacatgaaacaaaggcaccggaatattttaacgaaggttcattacttaaagccatggagaatccacaaaatcatattgatttgaatgataaaaagtatgcaaaaacactcaaacatacgggggggattggaactgtagcaactagggctgatattatagaaaagttatttaacatgaatgctttagagtcgcgagatggcaaaattaaagttacatcaaaaggaaaacaaattttagaattgtctccaagtgaattaacctcacctatactaacagcccaatgggaagaaaaattaatgcttatcgaaaaggggaaatataattctcagaaattcatacaggaaatgaaaaactttacatttaaagtggtaaataaaattaaaagcagtgagcaaaaatataaacatgataatttaacaacaactgagtgtccaacatgtggtaagtttatgataaaagtcaaaactaaaaatggacagatgcttgtatgtcaagatcccaaatgtaaaactaagaaaaatattcaacgcaagactaatgcacgttgccctaattgtaagaaaaaaatgaccttattcggtaaagggaaagaagctgtttatagatgtgtatgtggccacacagaaactcaatcacaaatggacaaaagaatgagagataaaacgaatggtaaagtttcacgtaaagaaatgaaaaaatatataaataaaaaagaagaaatcgacaataatccatttaaagatgctctgaaaaatctcaaattgtag

SEQ ID NO: 2801 - DNA, 132 bp, Staphylococcus epidermidis
caaatagtatttataaatagagttagaattgaattcaatgatatgatgactcactttcctatgttaattcatgattctctttatattcgttatattttcttagtagtgtttcaaagaaaatgtgatagctaa

SEQ ID NO: 2802 - DNA, 417 bp, Staphylococcus epidermidis
atattacaatttttggaggcgttaaatattatgaaaaaaatcaaaacaatctcgacattggtagctggacttggtatagcatttctaggtcacacaacacatgcagatgcggctgaaaataacaatcaacaacaaagtacatataactatagtacaactgaagtatcattttctaattcaggaaatttatatacttctggccaatgtacttggtatgtttatgataaaactggtgggaaaatcggatcaacatgggggaatgcaaatagctgggcaactgcagctcaagcagcaggattcactgtaaataatacacctgaagaaggtgcaattatgcaatcatctgaagtgctttcggacatgttgctttcgttgaaagtgttaataatgatggttctattactgtatcagaaatga

SEQ ID NO: 2803 - DNA, 453 bp, Staphylococcus epidermidis
atgaagcaatttgaaatcgtgactcaacctattgaaacagaacaatatagggattttacgattaacgaacgtcaaggtgccgtagtcgtatttactggtcacgtaagagagtggactaaaggtattcgtacacaacacttagagtatgaggcttatataccaatggctgaaaaaaaattagctcaaattggtaaagaaattgaagaaaagtggcctggaacaataacaacaattgtacatcgaattggtccgttacaaatatcagatattgcagttttaattgcagtatcttcaccgcatagaaaagcagcatatgcagcgaatgaatacgccatcgagcgcataaaggaaattgttccaatttggaaaaaggaaatttgggatgatggatctgaatggcaaggccatcaaaagggaacatataatgaagcaaaaaaggggaaagcaagatga

SEQ ID NO: 2804 - DNA, 1455 bp, Staphylococcus epidermidis
caattaaaatttaagaaaagaggttttgtttcaaatcatactgaagggagcaaaagtatgactcaaaagtatagatatcctacttttttagaatctatttctactattttagttatggttgtcgttgtagtaattggttttgttttctttaatatcccgatacaaatattattattaatttcttcagcttatgcagcatttattgcacatagagtgggattaaaatggaaggatttagaagaggggattactcatcgattgagcacggcgatgccagctatctttattattttagctgttggaatcattgtaggaagttggatgtattctggaacagttccagcgttaatttactatggacttaaatttttaaacccaagttatttattagtatctgcatttataatcagtgcaatgacttcaatcgctacaggaactgcttggggatcggcatctacagcaggcattgcactcatatcaattgctaatcaattaggtgtgccagcaggtatggctgctggtgccattattgcaggggcggtttttggtgataaaatgtctccattatctgatactacaaatttggcagctctcgtaactaaagttaatatttttgctcacattaaatcgatgatgtggacaacaatccctgcttctataataggattggctatatggtttattgttggattacaatttaagggagacgcaaatacacaacaaattcaaaatctattaaaagaattaacaacaatttataacttgaatttttgggtatggattccacttattatcataattttatgtttaatatttagaatctctacagtaccgtcaatgcttatctctagtatcagtgctttagttattggaacattcgatcatcaatttaatatgaaagatggttttaaagcttcttttgatggatttaatcatacgatgctacaccagtctcatatttcagataatgctaagacgttgattgagcagggtggtatgatgagtatgactcaaatcattgtaactatattttgtggttatgcttttgctggtattgttgaaaaggcaggttgtttagacgtaattttagagacaatagctaaaggcgtaaagtcagttggaacactaatattaataactgtagtttgtagtattatgctagtatttgcagcaggcgttgcttcaatagttattattatggtaggtgtacttatgaaagatatgttcgaaaagatgaatgtctcaaagtcagtgttatcgcgtacacttgaagattcaagtacaatggtattgccactcattccatggggcacatctggtatatattatgcacaccaacttaatgtttcagttgatcagttctttatatgggcaatcccatgttacttatgtgcattcattgcaataatttatggctttacaggtataggaattaaaaaaataagtagaaaataa

SEQ ID NO: 2805 - DNA, 156 bp, Staphylococcus epidermidis
ccttgttcttctaataacgcagcagcagttaaaccacctatacctgcgcctactattgctattttcatgttttacacctcaaatttatcattctttattattttagcatacacacacatgttgaaaagcaaacccttctattttaattgtcaataa

SEQ ID NO: 2806 - DNA, 132 bp, Staphylococcus epidermidis
gaattatattctctaaatcttccctacttcacttcaatacaacttgaaaaagatttaatcattaccgcaattggttttattggagaaaatcattttaatatctatagtcacccaaaaagaatcacaaattaa

SEQ ID NO: 2807 - DNA, 261 bp, Staphylococcus epidermidis
tttgtatattcaaaatataaagagaggtttagagatctaatgcaagaaagatactcgagacaagtgttgtttaaggaaattggtttaaaaggtcaaagtctacttgagaaaaaacatgtgcttatagtaagtatgggtgcgttaggaacacacttagctgagggattagtgagagcgggaataaataagttaaccattgttgatagagattacattgaatttagcaatttacaacgacaaacgctcttttatagagcgtga

SEQ ID NO: 2808 - DNA, 1437 bp, Staphylococcus epidermidis
ggaggagattccatgagtaaagaagaacgtcttgccaaagacattacccacgcattaggcggttctcaaaacataagcaatatcatccattgtatgactcgagttcgtattaaagtacacaatgatgcaaaagttaattatgatgaattaaaatcaatcaatggcgtattaggcgttgttgaagatgaaagaattcaagttgttgttggaccggggattgttaataaagttgctaaacttatggctgaccagtcaggagcaactctagctgaagagacgactgaaaatcaaagttataaatcacaggcagaaaaacgtgcgtatgaacataaaaaacaattccaaagtcaacgaaaacaaagtaaatggaataaagtgttaaaatctattgctaatatctttatacctttaataccagcatttataggtgcaggattaatcggtgggattgcagcaatacttagtaacttgcttacagcaggttccatttcaggtcaatggattcaacaaattgttactgtcttaaatgttattaaagatggtatgttattttacttagctattttcactggtattaactcagcgaaagtattcggtgctacaccaggtttaggtggagtaatcggtggtactacattactaaccggtatcacggatgaaaatccaattaaaaatattttcactggagaacatctagctgctggacaaggtggtattattggtgttatcttcgcagtttggttattaagcatggttgagaaacgactacataaaataatacctaactctattgatatcatcgtaacgcccacaataaccttactacttattggtttgttaactatatttataatcatgccactagctggctttgtctccgatggtcttgtttatgtaattaactggattattggagtaggaggcattttcagtggattcattataggagcattctttttacctttagtcatgctaggattacatcatatcttcaccccaatccatatcgaattaatcaatcaaactggctccacttacttgttacctattgccgctatggctggtgctggacaagtcggtgcggcgattgcattgtgggtgagatgcggtaaaaataaagaattacgtaatacgctcaaaggtgcccttcctgtagggttcttaggtataggtgaacctttaatttatggtgtaacacttccattaggtcgccctttcttcactgcgtgtataggtggcggtgttggtggtgctgtcattggtggtatcggtcatattggggcgacagctgtaggaccaagtggtatttcattattaccattgattgctaataatatgtatctcggttacatcgtaggtttactagctgcttatacgggtggctttatctttacttatttcttcggcacaactaaagaaatgagaaatcctgaataa

SEQ ID NO: 2809 - DNA, 156 bp, Staphylococcus epidermidis
tatgtcttctcacttcaaacatattcattctttctcattttacactatatcagtgttttatcattaattttacttaaagaacatttacttgaatactttaaatgtctacaaaatatcatactcattacatatacaataatgtataatgtgatttaa

SEQ ID NO: 2810 - DNA, 144 bp, Staphylococcus epidermidis
tcaatttactcaaaaataatatttaaaagttacgtattttataagttagcttttgaatattcaacaaccatctctaaatacatttcccttttgaaaggaggtcatgaacatgagcatcgtatcaactatcatcgaagtcgttaa

SEQ ID NO: 2811 - DNA, 1221 bp, Staphylococcus epidermidis
ttgttaccatctttccagatggaagcgatcgatacatgtccaaacaaatattcaactataaggagagttttaataatgaataaaaaaacgcaaatgatacatgggggacatacgacagacaactatactggagcagtgacaacacctatttatcaaacaagtacttatttacaagatgatattggtgatttaagacaagggtacgaatattcacgtactgcaaatcctacacgtgcgtctcttgaaagtgttattgctaatttagaacatggtaagcatggttttgcttttggttcaggaatggcagcaattagtgcagttatcatgttattagataaaggagatcacttagttcttaattctgatgtttatggtggcacatatcgtgcattaactaaagtatttactcgctttggtatagacgtagattttgttgatacaactaaaattgaaaacattgaacaatatattaaacctgaaactaaaatgttatatgtagaaacaccttcaaatccattattgcgtgtgactgatattaaagcatcagcaaaaattgcaaaaaaatatgatttgatatctgtagtcgataatacatttatgacaccttactaccaaaaccctttagactttggtattgatatcgtattgcattcggctactaaatatattggaggccatagtgatgttgtagctggtcttgttgctactgctgatgatgatttagcagaacgtctaggctttatttcaaattctacaggtggtgtacttggacctcaagatagctatttattaatcagaggtattaaaacgctaggtctaagaatggagcaaataaaccgaaacgttgaaggtattgtgcaaatgttacaaaagcaccctaaagttcaacaagtattccatcctagtattaaggaacatatgaactatactatccatcaaaatcaagcaactgggcatacaggggtagtatcttttgaagttaaagatacagaagcggctaaacaagtgattcacgcaacaaactactttacactggcagagagtttaggggcagttgaaagtctaatttctgtaccggcacttatgacgcatgcgtccatcccatcagatgtaagagccaaggaaggtattacggatggtctcattcgtttatctattggtattgaagacacagaagacttagttaatgatttagaacaagccttaaatactttgagataa

SEQ ID NO: 2812 - DNA, 255 bp, Staphylococcus epidermidis
atataccaatctcctgtagcgatatacaataaaatgacagcaatcaataacgacaaccatgccaatataaatgaccaagctgaaattcttgctgcttccctaggcaccttccataatttgttaactttaatgagccgtgttaacacaaataatgttgcaccccaaaacatggtcattaaccttaagtctccacttaaccatgccaatgaagcaaatgcagtaattaatgtaaaaaacggaaaatatttacggtaa

SEQ ID NO: 2813 - DNA, 246 bp, Staphylococcus epidermidis
accgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtag

SEQ ID NO: 2814 - DNA, 939 bp, Staphylococcus epidermidis
tactcattgttgtcatctgaaccaaaaataatgattgcatacgatttgataggacaaactccattagttttattagaaagctttagtgacgagaatgttaaaatatacgccaaacttgagcaatttaatcctggtggtagcatcaaagaccgtctagggaagtacttaattgaaaaagcaatagatgaaggacgacttaaagaaggggatacaatagttgaagcgactgctggtaatacaggcattggacttgctattgcttctaatcggcacaaagtaaaatgtatcatctttgctccagaaggatttgcagaagaaaaaatttcaattatgaaagcattgggtgcagatgttagacgtacccccaaagctgagggaatgactggcgcacagcaagaggcgttggcatacgcaacacgatatggatatttatatatgaatcaattcgaaactaaagataatcctggggcatatacacaaacacttgccaaacaactcacagatgaactttcacatattgattattttgtggcaggtgttgggtccggtggtacgtttacaggagttgcacaacacttaaaaacgtatgatgtaaaaaattatattgtagaaccagaaggctctgtcttaaatggtggtgtcagtcatcctcatgcaactgaagggattggttctgaaaagtggccatcatttttagaaaaagaattagtagatggtatttttactgttgccgataaagatgcttttaataatgttaaacttgtcgcgaataaagaaggattgttagttggtagttcttcgggagcggcattacaaggagcgttggaattaaaaaaaagcattcaaaatggtgtgattgttaccatctttccagatggaagcgatcgatacatgtccaaacaaatattcaactataaggagagttttaataatgaataa

SEQ ID NO: 2815 - DNA, 825 bp, Staphylococcus epidermidis
tgcatggatccgtataaggtattaattgaagtaatgaaaacagaaagttttactagagcagcagaaaatttatatacttcgcagccttctgtgagtcgtgatattaaacgtttagaattaaaatataatgttaaaatatttgaatttaaatctccatatttaaaactaactagagatggcgaaaagctattacaatacgcattgcaacgggaaagtattgaacaagaattatggcaaaacttaacatcggaatctgaaatcatctcaggcaccttaacaattggaagcagttatacatatggtgaatatttattatcagaacagcttaccagtcttatgcaacaataccctaagttacatattcatttacgtgttaataattcagattctgttataaatgatattaaacacaacagagtagatataggtattgtagaaaaggaaattcaagacaatgcaataaaatgtaaggaaataatggaagacgaaatggtgtatatttacaaaaaatcgattcaacctagaatggatatatgtttcgttagagaaaaagggtctggaacaaggttttatcaggaagtaggtctttctgagttgaaattaaatccatatttgatagaaattaacaatattaagattattaaacaaatggtagaggctggaaatgggtttgcaattatttcaaaatcagcacttcatccagaagattatgaaaaattaatgataacaactttaaatgtgaaacgtcactattaccttgctcaacatgttgataaatatataggtgaaaatattagagctgtcattgaaatgattatgaagtag

SEQ ID NO: 2816 - DNA, 129 bp, Staphylococcus epidermidis
aatctatcgttaaaaaacgtgaatattaacgtacctaaaaacaggcaactaaagattatcatcatccaagtaaaaggtgttttaaaaaaattcttggattgcatcttaaaacctcaattctcaacttga

SEQ ID NO: 2817 - DNA, 303 bp, Staphylococcus epidermidis; identical to SEQ ID NO: 2359

SEQ ID NO: 2818 - DNA, 555 bp, Staphylococcus epidermidis
ggagctgctttaattatgacgaaacaagatttatctttatctgtatttaccaatgaaaattataagaatcttcattacacatcatctagttttagaaattctatgtatgatgaattagaggttaataaaagtcgctttaaaaactgtaattttaatgaaggtatttttaagaatatagaagcaatttgtaattgtaaatttacaacgtgcgggtttaataattgtattttcgaagatgttcatttttacaaaaaccaatttaaagattcaacatttgtgaatacaccatttgatcaatccgtatttaatagcactttattccaaaatgcaatgttcgatagcaatctcattcgtagcgtaaaatggactgatatcatttttaaaaacgtttctttcaaaaatgtagaaattgaaggaacaacatttaaagatgtaaaattcaaaaattgtgagttcaaaaatgtaattattactaattcaactatgtcgcaaaagttaatgaatgaattacaaaaacaagatgttactttagaaaatatagacacttctatttaa

SEQ ID NO: 2819 - DNA, 123 bp, Staphylococcus epidermidis
ataaagaagccagtaaatgaatttatgaaaactcatttactgtctattttgataggaattatgtcccaggctctctatcctacgattagtcaagtacttataattaaaataagcattacttaa

SEQ ID NO: 2820 - DNA, 1233 bp, Staphylococcus epidermidis
ttactatttacaaaagagagggttcttgaaatggcgaaaatacctgtaactgtattaagtggatatttagggtcgggcaaaacgacattgcttaatcatatattaaaaaatagagaagggcgtcgcattgctgtcatagtcaatgatatgagtgaagttaatattgataaggatttagtagcacaaggtggcggcttatctagaacagatgagaaattagtagaactttctaatggatgcatatgttgtactttaagagacgatttgttacgagaagtcgagcgcttagttcacaaaggaggaatcgatcaaattgtaattgaatcaactgggatatctgagcctgtgccggtagctcaaacgttctcatacatagatgaagaattaggtattgatttaacctctatatgtcgattagatacaatggtgacggttgtagatgcgaatcgctttgttaatgatatacgtagtgaagatttattggcagaccgtgatgaaagtgttgatgatgaagatgagcgtactattgctgacttactcattgatcaagtagaattttgtgatgtgatgattatcaataaaatcgatttgattagcgacgaagctctagaaaaattagaaaatgtattacgtgcattgcaacccgaagctaaaattattaaaacagtaaatgctaaagtggaattatcagatgtacttaatacgcaattatttgattttgagaaggcaagtgaatcagctggatggatcaaagaattaacagctggaggacatgcgacacatacgccggaaacagaagagtatgggattacatcatttgcttatactagacgattaccatttcatgcaaaaagatttcatcaatggctagaacaaatgccagaaaatattgtaagaacaaaagggattgtatggttagcgcagtataatgatgtagcgtgtttgttatcacaggctggttcatcttgtaatattcaccccgttacatactgggttgcaacaatgagtgaaagtcaacagcaagctattttggaggcacgtcaagatgtagtagaagattgggatatcgaatatggagatcgtcaaacgcaatttgtaattattggtacggatttagatcaagaaaaaatttcccgggaattagatgcatgcttaattcatagtagtgagattgatgaagattggcgattactagatagtccgtaccaatggacttatgatcgacgaatgtaa

SEQ ID NO: 2821 - DNA, 150 bp, Staphylococcus epidermidis
aagctatgtacctacaatgagtacgcagcttatagtcgaaatatatttatgatgtataatctcgtggcgcagatttgcgcagtgagtttcacagtccaaatatggacagtgatatatacaaatttgtttacatctcatacagtattttag

SEQ ID NO: 2822 - DNA, 135 bp, Staphylococcus epidermidis
ataaatcgtacactttatttaaataagctgcctatatcattttgtagtaaagtaagaactctttcccctttatcaatcaaggttattcaacctaaaattgctaaagcaagacttagttattaccttttcgaataa

SEQ ID NO: 2823 - DNA, 129 bp, Staphylococcus epidermidis
tcattttacaccttttacagctactgtcagaagtactgttttttaaaagttaccagatgttttcaatatactatttcaaaacatttagccacagaatttaagttcaaagaattttcaagacgacgataa

SEQ ID NO: 2824 - DNA, 261 bp, Staphylococcus epidermidis
ggaggcgacacattgtttactaaaaaaatattgatttatattgcgctccttattaccttaattcgtttttttattccattacatccagactttgatacgttgttagtatggttgtttattctttacataattccaattattttatgtatcattggctttaaatcagataaactcatcgctactatgattatgattccaaatttaatgggtataggttatcgtatattcatcttctttaatgactttttgcatttaaaataa

SEQ ID NO: 2825 - DNA, 1695 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattcccgagactgaattcgatgaattcagacatcatcgaggtgcaacatcataccatccaaaaatgatgttaaaagtagttttatatgcctacacccaatctgtgttttcaggacgtaagatagaaaaattactcaatgatagtatccgaatgatgtggctatcacaaaatcaaaagccttcttataaaacgattaatcgatttagagtaaatcccaaagtagacgctttattagaatcattatttattcaatttcatagtcagtgtttgaaacaaaatcttattgatgatcaggccatttttattgatggtacgaaagttgaggcaaatgccaatcgatatacatttgtatggaaaaagagtattcaaaaccatgagtcaagaatgaatgaaaactctaaagcactctatcatgaattggtgataaataaaatcatacctgagattaaaaaagatcatgataatgacttaacaaaagaagaaatagatttgattggtagtcatttagataaagaaatcgaagatttaaaccaacatatcgataatgaaaaatgtactaaaataagaaaacaaatacggctcaaaagaactaaaattaaaaaatacaaaaagcaaattaatgattactctcagcgaaagcataaatacgaagtccaaaaatctattttaaaggatagaaatagttattctaaaacagatcacgatgccacatttatgagaatgaaagaagatcatatgaaaaatggacaacttaaaccggggtataatttacaaatagcgacaaattctcaatttgttttattttatgatgtgtatcaaaatccgactgatacaagaacaatgataccttttttaaatacaatacaagagacctacggtcatttacctgaatatattgtagctgacgcaggttatggtagcgaagccaattatatggcaattatagataattttaatcgaacgccactcataacttatggaatgtttataaaagataaaactaaaaaatataaaagtgacatctttaatactcaaaattgggattatgacgaaattaacgatgaattcatttgtccgaataataaaagactaggatttaaaagatatgcctatcgtcatgataaatatggttttaaacgagactttaaattatatgaatgtgatgattgttcagaatgccctctgaaacaacaatgtatgaacttcaattcaaaaacaaataaaaaaataatgaaaaattataattgggaatattttaaagcccaaattaataaaaagctttcagaaccaaaaacaaaaaccatctacagtcaaagaaaaattgatgtggagcctgtttttggatttatgaaggctattttgggtttcactagaatgtccgttcgagggatagataaagccaaaagagaattaggatttgtgctaatggcacttaatataagaaaagtaacagctcaacgagctgaaaataatcaaaaaaataataaaaaagacaatttctatattatttcaatagaaattgtctttttttacttatcctgggactttatgtcccacactcatttttga

SEQ ID NO: 2826 - DNA, 153 bp, Staphylococcus epidermidis
caatatataactatcaaattaagcccattgatgattggattaagaatcatcaatgggcttaattatagttttataaagatgctaccaaatctttataatatcggaaaacttgactattttaataagtctaagctttgcataagttgtttgtaa

SEQ ID NO: 2827 - DNA, 189 bp, Staphylococcus epidermidis
gtcatacagaccataaaactatcctacaaatatataggcatgttactgaataaattagaaaagatacataataacttattaataaagataggatttttaaataaattttgttatatatcctttattatgtggtttattttgtgctttactagaagtaatcgatttatggtatgcaaagaaaataactaa

SEQ ID NO: 2828 - DNA, 789 bp, Staphylococcus epidermidis
tcaatgagtgcaattactattttaggtttcttattattgttgataatggttattttcggaggtaaaaaaggactcatttcttttttcactttgtttttaaattttatcattcttgtaataagtattcttttaattatatatggtgtgtcaatctatcttgtcacatttatattttgctttatcatagccgcaattaatttatttgtattaaatagttacaatgtaaaaacacaagcggcttttctaggtactttagtaacaatacttatattaatactcatgatatacttttcagttgagatgggtcacttacaaggttttgccaccgaacagcaggatgaaacatatgtgtattcaatgaatattggtattaatatggtacaatttatggtatttacaattgttcttgcagtgatagctgcagtcattgatttagcaataacaattagttcccctatgtatgaactaaatgagactaatccaaatttaaatcagcatcaattatttcagtctggtatgcgtgtgggtagagagatattagcaacttctgccaacaccatttatttagcatttttcggaggacaattaactttattcttctggttctttaaattaaaatattcatttggacacatcattaattcgaagatattcacacaggaatttatagctattttacttggtggtatcgccgttgcaattagcattcccattactgcatggattacagcatttatgattaaacatttcagtcagaagaagactcttacgaatcaacaaaataaataa

SEQ ID NO: 2829 - DNA, 192 bp, Staphylococcus epidermidis
gagttgcacgcatacatattaacaaaaatattttctccaactttgaatagaaaatattctgttcattttatgtattcacataatcgtgaaatcatttatgactttgatcaattttcaaatcgcctagtcctagcgctcatcattgtatactcagttatgtcgttgtgtcccgttctaacatttgctttttag

SEQ ID NO: 2830 - DNA, 192 bp, Staphylococcus epidermidis
tgccaatgcgctaagggcagttgttccaataatggcagtaatatattttttttgcacttgaaatcctcctctactttaggttttgtttattcgcgttttaacaatacaaagatattatactctttaattatgtatagcatgtttgctttagatgacattctgattacaaatattattttaaataaaaaatag

SEQ ID NO: 2831 - DNA, 1359 bp, Staphylococcus epidermidis
cactttagcgctttaaagggagttggtaatttgagtggtcattcacaatggaagacgtctaccggttttatattagctagcgcaggttctgcaataggattgggtgcaatgtggaagttcccatatatggcaggtatatacggcggtggcgcttttctattaatgtttttaatttttactatatttgtaggactaccactgttaattatggaatttacggtaggtaaaatgggtcgtacatatacaacgcaaatatataagaaattaacgggaaagaaatggcttaatattatcggatggaatggtaatttagccgtatttatactatttggtttttatagtgttattggtggttggattattatatatataggttatgtcatagcacaaatcatggtttttaaatcaagtacgctgacaaatattcaatttgaaacaatcattagtaatccatggttgactgttttaggtcaaggcatatttattttgataacaatggtaattgttatgttaggtgttgaaaaaggtttagaaaaagcttctaaaataatgatgcctctattatttatctttttaattatcgttgtagcacaatctttaactttagaaggtgctttagaaggtgtacgttatatactgcaacctcgagttgaagatatgtctattcaaggtgtactatttgcgttagggcaatcgttttttacgctgtccctaggtacaaccggaatgattacttatgcaagctatgcacctaaaaatatgacgataaagtcttcagcactttcaattgtcgtaatgaatattttaatttctgtcttggctggattagctatatttcctgcgcttaaaacatttggttaccaaccccaagaaggccctggcttattatttaaggtcttaccactagtatttagcgaaatgacttttggtacattcttttactttatatttttactattattcttatttgcggcattaacgtcttctatatcattattagagttaaatgtatctaattttactaaaaatgataatagtaaaagacaaaaagtggcaatcataggtagtatacttgtatttatcattagtatcccagcaacattatcttttagtagtctaagtcatttgcgttttggcgctggtacgatatttgataatatggattttattgtatctaatattcttatgccattaggggcactaggaacaacattagtggttggccaattactagataaaaaattattaaaagaaagctttgggaaagacaaattcaacctatttttaccgtggtattatttaattaagttcatcatgcctattgttattattttagtatttatagttcaattattttaa

SEQ ID NO: 2832 - DNA, 600 bp, Staphylococcus epidermidis
aatatgcattatccagaacctatatcaaagcttatcgatagttttatgaaactgccaggcattggaccaaagacggctcaacgtctggcttttcatactttagatatgaaagaagacgatgttgttaagtttgctaaagcactagttgatgttaaaagagaacttacctattgtagtgtttgtgggcatattacagaaaatgatccttgttatatatgtgaagataaacagcgagatcgttctgtcatatgtgtagttgaagatgacaaggatgtcatagcaatggaaaaaatgcgtgaatataaaggtttatatcacgtgcttcatggttcgatttcaccaatggatggtattgggcctgaagacatcaatatacctgcattagttgaacgcctcaaaaacgatgaggtgaaagagcttatattagctatgaatcctaacctagaaggcgagtctactgcaatgtatatatctaggttggttaaaccaattgggattaaagtcacaagactggcacaaggtttatctgtaggcggcgatttagaatatgctgatgaagtgactttatctaaagcaattgcaggtagaacggaaatgtaa

SEQ ID NO: 2833 - DNA, 2631 bp, Staphylococcus epidermidis
aacccaatctatagaaagtcatccatcatatttaaaacgattttagtaaaggaggatagaattatgcttcaatcagatatcaatgaattagtcaatcaggctaaacgtgtaattacacctttatcaccgatttcaacatttgctgcccgtaatccgtgggaggggctagaagatgcttcgtttgatcaagtggcacgttggttaaaaagtgtgagggatattgacatttatcctaatgcgtctactattcacagagcgattagtaataaagaaatagatttaaaagtatttgaagaacggttggatgaaaatcgtgcgcattataataataggtcactatctgacagtgatatcaacacatatattcaaagagcgaaaaatttaaaaacgattgaagaaggttactttaatacaaaagataacgagaaactggaaaaatgggtacaaactaattttaaggattataagaaaaaagaagatgtgatagcgcaaagtgctagtgttttcacaaaggaaggtacacgacttattgatattttaaatgctcatatgattaagtggtctaaattatatgttgatgactttcaatcaagttggactatgccaaaaagagaaaaaggattctatcatgcctggcaacgtttagttaaacatgatccattattcacaaaaaaacaacgacttactttaacacatttgccaaatcaagcaaccgaagcaatagagtacgcctttcaagaattaggagtaaaagaagaacatcgacaatcatatattgagagtcatttattatctttaccaggttgggcaggaatcatgtatcatcggtcacagacacaaagtaatgatgcgtacttattaacagactatgttgcgattcgtctatcaattgagatggtacttttaaatgaccaccatacaacattattaaaaaaatctatatatcttcaaaaaaagttagagcaaatacgttatttgctatttaacatacaaatgaatgttgagcagtggttaaatctatcatctaaaaagcaacaagcatacattgaattggggacacgattcagcccgttttattttaaaaagttatggttagatgcatgggaagaaacgcatgaacgtcgattggttgatgaaatttatcgtgttccaaccgaagatactgatcaagcaaaagcaaaagtacaacttgcgttttgtattgatgtacgatccgaaccgtttagaagacatttagaaagtgaagggccttttgaaacaatagggattgctgggttctttggtctgccaattcaaaaagaagtacttgatgaacaatttgcacatccatctttaccagtgatggtagaacctgcatatcgtattaaagaatatgctgatcaacatgaaatgaaaatttataatcaacaacaacatacacttacatctatgttttacaactttaaattaatgaaaaacaacgtgttgccaagtttgcttttaccagaattaagtggtccttttttaagtattgcgactatagctaacacaattttccctaaaaaagcaaaacgtattgttcatcgattctcacaaaaatggctacgtaaaccaacaggtaaattaactattcagcgtgagcaagatgcgtattcaaaactaccaatcggctttactttagaagaacagattcaattttccaaaaaagcattacaattaatggacttaacagatgattttgcaccacttattgttctatgcggacacggtagtgaatcacataataatccctatcatgcttcattagagtgtggggcttgcggcggtgcctcgagtgggttcaatgcgaaattattagcagtaatgtgtaatcaagaaaatgttagacgtggattattgatggaaggaatcgacattccaagacatacagtgtttatagctgctgaacatcaaacgtcagttgatgagttagagtatatttatgttccacctttaactacagaagctcaaaatgcctttgacgaacttaagcatgtgatgccaaaagtatgttataaaaccaatttagaacgtttggcatcgttgccaaatataaataacactgaccataatcctaatgctgaagcgcatcgtcacgctagcgattggagtgaagttcgtccagaatggggtctagcacgaaatgctgaattcattattgggaaacgtcaaatcacccaaaatagtaatctagagggacgggcatttcttcataattatgattggacaaaggatgaagacggtgagattttaaatacaattatttctgggccagcactagtagcacaatggattaatttacaatactacgcctcaaccgtggcacctcactattatggaagcggtagtaaaacaacgcaaactgtaacaagtggtgtaggtgtcatgcaaggaaatgctagtgatttaatgtatggcttaccatggcagtcagtaatgatgaatgacaaagaggcgtatcacgcacctattaggcttttaattgttattcaagcgccagatgcatatattcaacgtttgttaaaacatcataatcactttagacaaaaggttgatcatcaatggataagacttgccagtattgatgaaaataatagttggaaagactggtag

SEQ ID NO: 2834 - DNA, 306 bp, Staphylococcus epidermidis
gggtacctttttgtgtataaccgaacccaatgtggtttcgttaaatgtgtccgtaagtggacgtattatctacttagcttaatatcctcaaatttggggatattgatttatacacagccccaatgtgggttcagtaatagactgaataactctatatatttactcagctcaaatgtgagcgtattaattaataatacaaatgctgacgcactaagtcagtgcattagaaaacgaaaatattcgttctctaaaattaagctgaatacagccgaaatgtcggcactagtagatatatcacaacggtaa

SEQ ID NO: 2835 - DNA, 4590 bp, Staphylococcus epidermidis
tctaatttatatattgaacagataaataaattacattatagtaattactatcaaacaaaattgtcagaaaattctaataagggagtgtgcatcatgtacaatgagaaattaaaaaagggactatacgattatcgtgaagagcatgatgcgtgtggtattggattttatgccaatatggataataaaagatctcacgatattatagaaaaatctttagaaatgttaagacggttagatcatcgtggtggagtaggtgccgatggtattactggtgatggtgcaggaattatgacggagataccataccaattgttcgaacaattaacagaattcaaagttcccggcgaaggatattatgccgtgggattatttttttctaaagagaaagttagagattcaattcacgaagagatgtttaatcaatattttgaaagtgaaggttttaaagtcattggatatagagatgtgccagtagatactcgcgctattgctcaacatgttgcagatactatgccttatattcaacaagtatttgttgacatcacaggtgtaaaagaagttgaaaaacgattgtttttagcaagaaagcaaattgaaaaatatagtgaaacacaatccatagatttatattttacaagtctctctcatagaacgattgtttataaaggttggttacgttcggatcaaattaaaggcttatatttagacctacaaaatgaggcatatcaatcaaaattaggacttgtacactcccgctttagtactaatacatttccaagttggaaacgtgcacatcccaatcgcatgcttatgcacaatggtgaaattaataccattaagggtaacgtaaactggatgcgagcacgccaaaataaactagttgaaacattatttgaagatgagaaagataaggtgcattttattgttgatgaagatggtagtgactcatcaatagttgataatgcgttagagttcttatcattagcaatggagcctgaaaaagcagcgatgttattaattccagagccatggttatacaatgaatctaacgataaaaaagttcgctctttctatgaattttatagttatttaatggagccatgggatggaccaactatgatttccttttgcaatggagataagataggtgcattgactgatagaaatggattaagacctgggcgttatacaataactaaagacaattttattgttttttcttccgaagtaggtgtcattgatgttccagaagaaaatgtagcatttaaaggacaacttaatcctggaaagttattacttgtagactttttgcaaaataaggttgtagaaaataatgagctaaaaactaatattgctaatgagttgccctacgaacaatggctaaaagattataaaaataaaaatgatttagataatatttattaccaatcttccgactgggatgatcaaacactcttccgcttacagaaacaatttgcttacactaaagaagatatcaataaatatatgacagatttagtcatcaataaaaaagatcccatcggagcgatgggatatgatgcacctattgcagttcttaatgataagcctgagtcactatttaattattttaaacaattatttgcacaagttaccaatccacccatcgatgcttatcgagaaaagattgtaactagtgaactttcatatttaggttcagaagggaacctcttatgtcctgatgaatcagttttagaaagaattcaattaaaaaaaccagttttaaatgaagcgcaattatcatcaatcgatcattcgtattttaatgtaacgtatttatctacactttatacaggtgatttggaaagtagcttaaatgaactagggaaccgagcaatacaggctgtacatgaaggtgcgaaaattttggtgttagacgatacgtctttaactcacgaaaatagttatgcaatgccaattttattagcgttaagtcacgtgcatcaattattaattcgagaaggattaagaatggagaccagcctcattgcgcagtccggtgaaacacgagaagttcatcacgttgcatgtttacttggttatggtgcaaacgctgtagttccatatttagcgcaacgaacgattgaacaattaacgcgtcaaggtcaactttcaggaactgtcgctgaaaatgttgctacgtataccaatgtattgtcagaaggcgttattaaagtgatggctaaaatgggcatttctactgtacaaagttatcaaggagcacagatatttgaagcggtaggtttatcgaatagcgtcattgaaaaatattttacaggtacacagtcaaaattatctggtataagtattgaacaaatagacaaagagaataaagcgagacaaagtgatgattctgattatcttgaatccggaagtgtattccaatggagacagcaaggtcagcatcatgcatttaatcctcgtacgatttttttattgcagcatgcatgtagagaaaatgattacgagttatttaaaaaattctccaaaactgtaaatttaaaacgtacggatcatattagacatttattagaattcaagacacgccaatctattgatattagtcgtgttgaaccagcaagtgaaatcgtaaaacgttttaatacaggagcaatgagttacggctctatctcagcagaggcacatgagacgttggctcaagctatgaatcaaattggaggtaaaagtaatagtggagaaggtggtgaagattcttcacgttacgaaattcaaaaggatggaagtaataagataagtgcgattaagcaagttgcatcaggtcgttttggggtgacgagtgattacttgcaacatgcaaaagaaattcaaattaaagtcgcacaaggcgctaaaccaggggaaggtggacaactaccaggttcaaaagtatatccatggattgctgagactagaggttcgacaccaggtataggattaatttcaccaccaccacaccatgatatttattcaattgaggacttagcacagctcattcatgatttaaaaaatgcaaatagaagagctgatattgcagttaagcttgtatcaaaaactggcgttggaactatagcttcaggggtagctaaagctttcgccgataaaattgttataagtggttatgatggaggtacaggtgcatcgcctaaaacaagtattcaacatgcaggtttgccatgggagataggccttgccgaaacacatcaaacacttaaattaaatgatttgcgtagtcgcgtaaaattagaaacggatggtaagttactgacgggtaaagatgtagcttatgcttgtgcgcttggtgcagaagaatttggtttcgcaacagcaccacttgttgttttggggtgtattatgatgagggtttgtcataacgatacgtgtccagtaggggttgcaacacaaaacaaagatttaagagctttgtttagaggtaaggcacagcatgtagttaactttatgtattttatagctgaagaattacgtgaaattttggcttcacttggtttagaaacagtagaagagttagtaggaagaacagatcttcttcaacgttcgacgcaattgaaaccaaatagtaaagcagcttcgcttcaaatagaacgtttaatagaacaatttgacggggttaatacgaaagagatatcacaaaaccatcatcttgatgaaggattcgatttgaattatctgtacccagacgcacgctatagtattgaaaacgggcactcttttaccggaaattatgttgttaataatgaacagcgagatgtaggtgtaattacaggtagtgcgatagctaaacaatatggagaagaaggattacctgaagatacgatacttgcttacactgaaggtcatgcaggtcaaagcttagctgcatatgcaccacgcggattaacaatccatcataccggtgatgctaatgactacgtaggtaaaggattgtccggtggaactgtcatcgtaaatgctccaaatagtcaacgtgaaaatgaaattatagcaggaaatgtaaacttttacggggcttctagaggtaaagcgtttatcaatggtaaagctggtgagcgtttctgtatcagaaatagtggtgcagatgttgtagtagaaggtattggtgatcatggacttgaatatatgacagggggacatgtcattatcttaggagatgttggaaagaactttggccaaggcatgagcgggggcgtaagttatattttcccttctgacgtggagaaatttaaaaaggttaatgcgcttgaaactttagaattcagtagcatacgttttgatgaggaaaaatctcttatcaaagacatgcttgaagcacattttaagcatacacgtagtaacaaagcacgccaattacttgaccaatttgacaatattgaaaagttagcaattaaagttattccgaaagattacaaattaatgatgcaaaaaattgatttgaaaaaacgtcaaatggaacgtgaagatgaagcaacactggcagcgttttatgatgacagagaaacaattgaacaagagctacagccagcagtcatttattaa

SEQ ID NO: 2836 - DNA, 159 bp, Staphylococcus epidermidis
catcctgatttaaacaatctattgttacatagagattttatattcactaaccatagaggaagccccctatcaattacatcaatcaatagaaatttacaaattggtgcaaagaatgtaggtattgaaaagcatataacgagccatactaatgtgtcatag

SEQ ID NO: 2837 - DNA, 543 bp, Staphylococcus epidermidis
aatggaggatacatgcatatttatttaagtactttaacagaggtcgattatgaaacgtcactaaatagtatagaaaataattataatctaaatccagaatccagttggcaagatcgagcgcgcgttaaaaatctaagaaaacttgaaagctacaattatgaattagaagttatagctaagaatgaattgaatgaagttataggtcacgttgtgttagcagaggttaagttgtcgtctaaaaacaaaaaagcgatagcgttagccattggtgcactgtcagtagataaatctattcgaaaccaaggtttaggtcaagccctgttaaaagctgtagaagaacgtgctaaagaacaaggctattgtgctatttttgtaaataatcatcctcagtactttgagaaatctgattatgaagcagcccatttatataatatacatatagaagaaaaacgaaatcatcaatcattattagtaaaatttctaaaaccagttcaaaatgaatggtctggaatgacggtgtattatccggaagtactggattga

SEQ ID NO: 2838 - DNA, 1512 bp, Staphylococcus epidermidis
gatggaggatacgcaatgttaagttcagagttaattttgtttatgttttttattacacttgtcattgctatactgagtggattaatatttttgaatcatcgagttcccattcaatatattaaatttcatatatatttacttgttttacctatcattacgggattaagtggattaatatttttcggtgaaagggcgaatgttggaccttttgtagttgatcatcttacttggttaatgatgacatttattttgactttaggctttatcattcaaaagttttctatgcgttatttaattggcgacatgcattaccgtaaatattttccgttttttacattaattactgcatttgcttcattggcatggttaagtggagacttaaggttaatgaccatgttttggggtgcaacattatttgtgttaacacggctcattaaagttaacaaattatggaaggtgcctagggaagcagcaagaatttcagcttggtcatttatattggcatggttgtcgttattgattgctgtcattttattgtatatcgctacaggagattggtatatttattcgaatatgtcagatgataatgcaatcaattatggaatgcgtctctgtatcaatttacttattgttttagctgtgattattccggcggcacaatttccatttcaaggctggcttattgaatctgtagctgcgcctacgccagtttcagctattatgcacgctggtattgttaatgctggtggcgttattcttacacgcttttctccggtatttaatgacgaaatagccatttcactgttattaattattgcaagtatttcagtattgtcgggttctggaatcactcttgtgcatgtagattacaagagacaacttgtacgttctacgataagtcaaatgggttttatgttagtacaatgtgcgcttggggcatattctgcggcgatagtacatttaatattgcatggtgtgtttaaagcgacattatttctacaatcgggttctgttgttaaaagatttaacattcctacgtctccatctgttaaaaaatcatatggctggcttgtatttggtcgtctactagctattcttatagcgataatattttggttgaatagtgatagacatgcatatgatgtattaagcgctcttatattagcttggtcgttaatggtgtcatggaatcaattagttgcttttagtcatggactcatcggaagagtcatcggagtatgtatgattattgttgtagcaattgtttatattattacgcatcattatttcttcacgacattaagtaacgttgatattcatattgtttcaccaccactcataagtattattctatcgattgctattatagttttcggcagtatgttaagcatatgggtatcacggcgaagagaatcaaaggcatttgcgaagttatacttgtggcttattaaagtaggagaggctaaaacccaatctatagaaagtcatccatcatatttaaaacgattttag

SEQ ID NO: 2839 - DNA, 213 bp, Staphylococcus epidermidis
cgagataatctatatggttatctctattttttgcgttcaaataaaaacaaacttcacacaccgtcttttccaacttcagaagtacaaaaacaaccccttaagcctatgcctaagggttttcattattctatgctattattcccactcgatgatatgtatttttcacatgtgttttcgactattgatatacgttgtcatattagagttttatag

SEQ ID NO: 2840 - DNA, 126 bp, Staphylococcus epidermidis
aactctattcactcggttttgcttggtaaaatcttacttacttatctagttttcaatgtacaaatgaatgttaataaacattcaaaactgaatacaatatgtcacgttattccctcatcttcgtag

SEQ ID NO: 2841 - DNA, 165 bp, Staphylococcus epidermidis
gagaaatgtcttcaacgacaattaatcattgaaaaggatttgaaattagatataagttattcaagtaagtctattacttttaaaacttttccatcttttaactacggaatttttggtgatcattttacaccttttacagctactgtcagaagtactgttttttaa

SEQ ID NO: 2842 - DNA, 543 bp, Staphylococcus epidermidis
aggagaatacatatgaaaaaattattatgtacattatttgctgctgcactagtgttaagtgcttgtggccaagacgacactaaggaagatgaaaataaaaagtcagaaattactactgaaaagaaatctgacgataaaaaagacaaaaaaactaatgaggataaaaagtctggagaacaaaagaaatctcaagaaaaaaagaataacaagtcaatgcaagaatctgctacaaatgaacaggttcaatctcaacaacaaacgcaacaagctaatcaacaagcacaacagtctgataatcatgaacctacaaaagaagagatatatgaatgggataaacaaaacattcccggaggtacagattttggtttgattgatccagaagatgtaaatgaagcttcggaatctcaaaacgaagaaccagatgaatggattaaaggacaagaggaatggaataacgctactcaatcagaaaaagaggagctacgtaaacagaacgcgcaaaagtatggttatgagtatgatcctaaagattatgaagaataa

SEQ ID NO: 2843 - DNA, 489 bp, Staphylococcus epidermidis
cttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 2844 - DNA, 156 bp, Staphylococcus epidermidis
atagtaaaacattgtaacaagcttcaacttactctaccaatggagacttttattagaattcctcaaattaatcctccacgacatattaatgaaatgattgaaacgatacacaatcgtgattttgatgaattcagttctctaaaaagaacaatttaa

SEQ ID NO: 2845 - DNA, 144 bp, Staphylococcus epidermidis; identical to SEQ ID NO: 2403

SEQ ID NO: 2846 - DNA, 1731 bp, Staphylococcus epidermidis
gtaattgttaatggaggtgctacggtggattaccaagctttgtatcgtatgtatagaccgcaaagttttgatgatgtggttggacaaacgcatgtaactaaaacgctgcgtaatgcaatttcaaaaggtaaacaatcccatgcatatatttttagtggtccgagaggtacgggtaaaactagtattgcaaaggtttttgccaaagctattaattgtcttaatagtgacgatggtgaaccttgtaatgaatgtgcgatttgtaaaggaatcacacaaggtacgaataacgatgtaattgaaattgatgctgcaagtaataacggtgtagatgaaataaggaatattagagataaagttaagtacgcacctagtgaatctaagtataaagtatatattattgatgaggttcatatgttaactactggtgctttcaatgctttgcttaaaacattagaagaaccaccagcgcatgctatatttatcttggcaacaacagaaccacataaaattccacccactattatttcgagagcgcaacgatttgactttaaagcaattagcagtgaccaaattatagatagacttaagtatgtagctaattctcaatctttggattacgatgacgcagcattagaatttattgctaaagcatcagaaggtggtatgcgagatgcattaagcattatggatcaagcaatagcgtttggagacgaacgacttactttacaagatgctttaaatgttacaggtagtgttgatgaagcggcattaaatgagttatttaatgacattgtaaaaagtgatgttaaagccgcatttaatagatatcatcattttatttcagaaggtaaagaagtcaacagactcattaatgatatgatttactttgttagagatacaattatgaataaaacgtctaacgaatccgttcattttgaatcacttattcatttcgacttagatatgttatacaggatgatagatatcatcaatgatacactagtatccattaggttcagtgtaaatcaaagtgttcattttgaagtgttgctagttaaacttgcagaaatgattaagacacagcctcaaactgtacaaaatgtagcaacagcatcggtagctaatgaaccagataatgagatgttattacaacgtttagaacaacttgaaaatgagcttaaaaccttaaaagaacaagggatcaaaactaataaagttagtcaacaacctaagaaaccaacacgtacgattcaacgatctaaaaatacgttttctatgcaacaaatagcgaaagtattagacaaagcaaacaaagatgatatcaaattgttgaagaaccattggcaagaagtgattgatcatgcaaaaagtaatgataaaaagtctttagtaagtttgctactgaattcagaaccagtagcagctagtgaagatcatgtgttagttaaatttgatgaagaaattcattgtgaaatagtaaataaagatgatgaaaagagaaacaatattgaaagtgtagtttgtaatatagttaataaaactgtcaaagtagttggagtgccggctgaccaatggctgagagtgagagcagagtacttacaaaatcgtaacaccaatgaaacacatcaaagcgaaaaacaaagcacacaacagtctcaacaaatagatattgctcaaaaagctaaagacttatttggtgaggaaactgtacacttagttgatgaagactga

SEQ ID NO: 2847 - DNA, 282 bp, Staphylococcus epidermidis
tttatgactaaacaagcaaacgcttcacgtttatcaagattattcaatgtagcaggattcattgtagatggttataacggaattcgctataatgctaagaataaacaacttgtctatttatcattaggtctaagcgcacttggaacaatcattgatttttacatttctattaaatctgcatctaaacttcgtaagttaagtgcacttggatcatttgcaatcaatggggtacgcttattcacaagttttaaaaaagttagagatgaatatgactatcactaa

SEQ ID NO: 2848 - DNA, 141 bp, Staphylococcus epidermidis
ttaattctcctttatttcaaacttaaattattagataagttgtataaattgttaattacttatgataaacatttttatgaaaattacaagaattttaataactattcagaatttgtactatataaccgtgtttgtgtttag

SEQ ID NO: 2849 - DNA, 150 bp, Staphylococcus epidermidis
aatttaaataacttcacatcggactatacatctaagtttcataacctagatctttattatctatataaaaatttgcttaaatctaaagtaaaaaaccatgcacctttgtatcgaacgcatatcataaacgttaccgaagtcgacagctaa

SEQ ID NO: 2850 - DNA, 132 bp, Staphylococcus epidermidis
aaaacgtacaatcaatttgaaattcaaacattatttaaaataagtatttttatttttataattgattacgtttatatgagaatacgtaacgaaagtgttatgataggggtaaataagctaacacatcgataa

SEQ ID NO: 2851 - DNA, 1044 bp, Staphylococcus epidermidis
cgctataacaataacgtgctaagatttcatatcgaggtgaaagtacatatgaaatcaataacgcaggcttcatttatgaaaggtattatgtttacatttacgattgcaataatcagttatatattagctaaatttcctattttacatacgattggggcgttagctattgccatcatttttgcgatgatataccgccaagtcataggttatcctgagcatattcgtccaggtattacgtttgcatcgaaacgtttattaaaatttgcgattatcttatatgggttaaaattaaatatgggagatattctaggtaaaggttggaaattactacttattgatattatcgtaattatcttttcaataagtttaactttacttttgaatcaaattattaaaggaaataaagatatctctatactacttggtattggtacaggagtatgtggagctgcagctattgcagctacagcaccaatcttaaaatctaaagaaaaagacattgcaataagtgtaggtattattgcactagttggaactatatttgcacttatttatacagctatcgaggctatttttaacatacctactataacttatggtgcttggacaggtatcagtctacatgaaatcgctcaagtcgttttagcagcaggtattggcgggtcggaggcaatgacatttgctttacttggaaaattaggccgtgtgtttttacttattccattaagtattgtcttaattttgtatatgcgttataagtcacactcaagtcaagtacaacaaaaaatcgatattccttactttctaattggatttattataatggcttgtatcaatacatttgttcctattccttcattacttatgaatattataaatgttattacaacgttatgtatgttaatggcgatggttgctctaggattgaatatcgttttaaaagaagttatttcaaaagcacttaaaccattcattgtgatctgtataacttcaatttgtctgtctggtgtgactctcttagttacgtctataatgtttaaataa

SEQ ID NO: 2852 - DNA, 138 bp, Staphylococcus epidermidis
aggagtttaaaccagctgaaaataaatagacataaaaaaaccaccatcgtaaaagatggtggttatgtagaatgtagactattttttgaattttttaacgatgtctacgatagttttaacgacttcgatgatagttga

SEQ ID NO: 2853 - DNA, 147 bp, Staphylococcus epidermidis
agaagattaaatttttacgcttgcaaagagaggccgaattatagtaatatagttcttaccgtgctacgtggggaagtaacggttccctgtactcgaaatccgctttatgcgagacttaattcctttgttgaggacgtatttttgtga

SEQ ID NO: 2854 - DNA, 159 bp, Staphylococcus epidermidis
ctttatctaaagcaattgcaggtagaacggaaatgtaataatatctactattttaaagtctgggatataagtctatattctagactttatttacatttaaatagaagaagattgaacacgcttatatatgaatcttcccaacatagagaatttcactga

SEQ ID NO: 2855 - DNA, 432 bp, Staphylococcus epidermidis
aaggtagtaaaaaaaggagttacttataaaatgaaaaagttttttatatttttattaagtagtttattagtgctagctgcatgtggtaagaattatgaaatcagtgatattacaagcaaatttaaaaaagaaggtttaagtgtcgaaaacttacgaaaaatggaccgtgaagattttggtatggcaccaatgaaaactgaaaatgctaaaatatttactgtttcagaagataagaatgcacgtattttaaaatttaaaaatgaagatgacctaaaagaaatgaaaaagtattatgaagaattgggtaaatccagtgctacgttctattcacatgtatacactaaagataaatttttaattcaaatgaatggcgacattgacgatcatgtatttgaaaagtataaaaaagctatgaatgaggcattaaattaa

SEQ ID NO: 2856 - DNA, 132 bp, Staphylococcus epidermidis; identical to SEQ ID NO: 66

SEQ ID NO: 2857 - DNA, 156 bp, Staphylococcus epidermidis
aaaattcaaaaaatagtctacattctacataaccaccatcttttacgatggtggtttttttatgtctatttattttcagctggtttaaactcctttaaacatccaacatttacttctcttcattattggataacttttcaaaataaactattgtaa

SEQ ID NO: 2858 - DNA, 183 bp, Staphylococcus epidermidis
tattatcaaaacttcacatcaatagaaattgagttgcgtaatatgatgttaatatttaaaccctatctattaatcattgataaattccttaatccacgtattcactgcaggcgctatattttcactgtcattgatatcgaaccatttcatgtcagtaatttcatgatcggtttcaacttttga

SEQ ID NO: 2859 - DNA, 159 bp, Staphylococcus epidermidis; identical to SEQ ID NO: 1997

SEQ ID NO: 2860 - DNA, 747 bp, Staphylococcus epidermidis
ataggagtgaatgtaaaaatgaaagttaaatcaccacaatcaatctacttaaaaggacatcgtcaacaagctgtattgttattacattcttttacgggaactgtacgtgatgtaaaacatttagcacaacagttgaatgaagagggatttacttgttacgtgcctagttatccaggccacggtttgccgcttaaggaatttacccaacacaatatcaatgattggtgggaacaagttaccgcagcatatcaatttttaagaaatgaaggatacagtagaattaatgtgacaggcgtatcattaggcggattatttactttaaggttagctgaacattttgatttagaacgtatagctgtgatgtcagccccacataaaaagcgtgaaagcgagattgcgtggcgtcttgaaaggtatgggcatcgaatgaatgaaattttgagtttaagcgaagaagagcgtcgtcaccaaatggaaaccatcttgtcctatgataaagaaattgaagtgtttcaaggtgtaattgatgaaattatggcttatcttgcaaatattacagtaccagtgaatattatgtatggcgaagaagatgacccattatatgctcaaagtgcgcaatacatttatgataatgtaaatagtcaagataaagaactgctcaaatttgaaaaaagcggtcatcttatgacgtatggcgatcatgcatacagagtagaacaatctattattcaatttttcagtaaataa

SEQ ID NO: 2861 - DNA, 153 bp, Staphylococcus epidermidis
gacgttattgataaaactaaaacaaacggtcaattccattttttagtggagttgaccgttttactatataaagaatgttatgtagttgattcgaaatatctaacaccattaaacgagcgaatgtttaactatgatcttaaattgttttcttaa

SEQ ID NO: 2862 - DNA, 261 bp, Staphylococcus epidermidis
gtaagcgttgatccaaagatttccgaatggggggaacccagcatgaattatgtcatgttattcacatgtgaatttatagcatggtcagaaagcaaaccccggagaactgaaacatctaattacccggaggaagaagaaaaaaaatccatttcccttaatagcggccaaaccaaaacggggagaaggcccaacccaccaagcttgctttgttgggggttggtaggacacttttttacggagtttccaaaagaacctttgtag

SEQ ID NO: 2863 - DNA, 333 bp, Staphylococcus epidermidis
ggaggaaatgaaattatgcgcggtggcggaaatatgcaacaaatgatgaaacaaatgcagaaaatgcaaaagaaaatggctcaagaacaagagaaattaaaagaagaacgcgttgctggaacagcaggcggaggtatggtgactgttactgtaacaggtcataaagaagttgtggatgtagaaattaaagaagaagctgttgatccagaagatattgagatgcttcaagatttagtattggcggctacaaatgaagcgatgaataaagcagatgagttaacacaacaacgtttaggtaagcatactcaaggcttaaacatccctggaatgtga

SEQ ID NO: 2864 - DNA, 330 bp, Staphylococcus epidermidis
gggctacgttttaaaatttcgtacatcccacttgcaatagtaatagaaacatccatcactgctccaagtgtacctattagtacggaagctagaaagacatccttaggagggagagtaaggaaagtgattgtttcgtattttattccatttcccccggtaaatttgatgatgacttcggtaattccaacacataagaacgtaccaatcagcgtacttacaatagtaattaaggttcggctatgccaacctgttacaagtagtaaagtgaaagaagtggaaatgataatagcacaagtcatcaaaaagaataaacttatagccccatattga

SEQ ID NO: 2865 - DNA, 1524 bp, Staphylococcus epidermidis
aataaaggagaattaattatgatatacacagtaacaaccacccttccattatcccatggtggtagaactcaagctttactcagacgaattaaactgttagatgaagaatttaaaattccaagtaaaattctcaccactaattatcatggtaattatcctagtatttataaaaaatacagacaagaaaacaaagttacagaaaatatacaattcgagaatatgtatgaatggttatcaaatttcaaactttttaaagtcccaaaaacattgattactaggaatccaaaatacattaaaacacctagaaagattaaaggacttattgataagcaaggaaaaaagagtggtcttattcattattataataatgaatgtcatgtgagatctcgaaagtattatggacagtctaatgttcttgaatatgaggacttcatttctcccacatcaggattgaaatatgagcgccatcaatataacttatacggccaacttcatagaaaagaatattattatgatgactcttctttaaaacatagcgacgaattatttgatactgagggctctatgtactgcaagagatatttcaaaactaaaccaaacagcaaaattaatggcgtagaaatatatagaaataaaaaactttataagacctttaaaaatgataaattattagctcagttttattttcagaatagattcaaaaatcaagatatcgtctttaatgatgctcgatttttagataaaccattacttaaacaaacgcaccaaacaaaaaatattcttgttttacatagctcgcatttatcaggggaccaaataaaaaaatcatatcgatttgctttaaatcaatcaaaaaatgtttataagtatattgttctcactcaccaacaaaagcacgatatacagcaacatttccatataagtgacgaccaattccaactagtaccacattttatcgaattagatacggaggtagaacaagattcctcaaacaatcaaaatcgctttatatatataggccgttttagcacagagaaacagattgatcatattattagagcttatcacaagtttttgcaaagtggttaccaaacagaattacatttatttggtagagatgaagataatcaaattccattgatgaatactttgatttcagaattaaaattatcggataaagttaaaatatttaaatataccaatcaacctttacaaaaatttaagaattctaaagcctctctacttacaagtcaatatgagggatttggcttaacacttatggaaagtatagaaatggggtgtccagtcctatcttataacgttcgttacggtccaagtgaaattattcaaaacgggataaatggctatctcattgaaaaaaatgatattgatagtttatcaaaacatatgattaacatcattgagcacccactacaaaaagtgaaaaataaagacactttaaaatataacgccgcagtgaataattacaaacaacttatgcaaagcttagacttattaaaatag

SEQ ID NO: 2866 - DNA, 399 bp, Staphylococcus epidermidis
aaaaaggaggaaattatgaagaatgtaagcccgtttatttacgttaaggacgtagataaatctttatgttattacaaagatgtatttaatgctcaaacagaaatacttatgggtaaagatggtcgaacttatcatgcccaacttattattggtgatgaaacgttcgtacatttctccgatacgtttcataagcatcccgtttctaaaaatcctcatcttattattgaatgtgattcattagaagagttggagcgtgtctataaaaggttaattgatgatggtggtcatgctaaagtaaaactcaataaaactttttttaatgcctatcatgcagaggtaaaagaccgtctcaatggtatcatttgggtatttaattactttttagatgaacatatataa

SEQ ID NO: 2867 - DNA, 135 bp, Staphylococcus epidermidis
cgagccatactaatgtgtcatagtcacatatcattattatcacagttagacacattactaagtacaattatgaatcgtgtaggtcatacagaccataaaactatcctacaaatatataggcatgttactgaataa

SEQ ID NO: 2868 - DNA, 387 bp, Staphylococcus epidermidis
atgattaaatgtgtttgcttggttgaagaaaagaatcatcagttactacttgtacaagttcgacatagagataagtattatttcccgggtggtaaaattgatgagggtgagagccttgtggaagctttacagagagaattgaaggaagaattgcgcttagaattagctaaagatgaattagaatttattggaactattgtcggagaagcctatccacaacctaatatgttgactgaacttaatggatttaaagttaatcgagctatagattggtcaaaagttgaaaccgatcatgaaattactgacatgaaatggttcgatatcaatgacagtgaaaatatagcgcctgcagtgaatacgtggattaaggaatttatcaatgattaa

SEQ ID NO: 2869 - DNA, 261 bp, Staphylococcus epidermidis
ataaaggagtgtagaaatatgaaacgtacatttttattaacttatacaaccgtatcaggaaaaacatatacggaatttaaaacatttgaaaatggtcccgattacgatacatgtgtatcacgaattatagatgaatttgatgaattggcatacttatatattaaaaaagatgttgtacattatattaatgttgatcacattgaaagtctagacattgaagaagtgacagagggacaacacattacttatgattttgaataa

SEQ ID NO: 2870 - DNA, 393 bp, Staphylococcus epidermidis
tcaagaaataggagtcgtccagttatgaaaaagacgaaaggtatttatgaatctgaaattagtaaagccattacacaatgggagaaagattttttaggaagaggttctttgtctgtaaaaacagatattcttcgtgatatggttattgttagtttacaaggtattttgacacctgctgaatatcgcgtgtgtaaaacgaatgaagggcttttaaatattaaacgtacacgttctgaacttgtagagtctggtgaagaggacttgagtcgcattattaaagatttgactggacttaatgtgaaaagttttcatagtgatttaagtactattaccggtgaacgcgtaatgatttttaagttggaagatcgttttgataaagcattacatgagtaa

SEQ ID NO: 2871 - DNA, 141 bp, Staphylococcus epidermidis
acactatacagacttattctcgttttaacaacagtaaaaattacactatcaaaaacaattcaaattactccggaggaaaaaccgaactttttttgtatgaaatttaattataaacgtgttatacagaaaaatggttgctaa

SEQ ID NO: 2872 - DNA, 354 bp, Staphylococcus epidermidis
tttcatatgagttatgaaaatgcttgtgatgtgatctgtgtacatgaggataaagttaacaatgctttaagttttttagaagatgataaatctaagaaattacttaacattttagaaaaaatttgtgatgagaagaaattgaaaattatattatctttgattaaagaagatgagttgtgtgtttgtgatatttctttgatattgaaaatgagtgttgcttcaacttcacatcatttaagacttttatataaaaatgaggtacttgatttttataaagagggaaagatggcatattattttattaaagacgatgaaataagagaatttttctctaaaaatcaggagggtttttga

SEQ ID NO: 2873 - DNA, 135 bp, Staphylococcus epidermidis; identical to SEQ ID NO: 2475

SEQ ID NO: 2874 - DNA, 135 bp, Staphylococcus epidermidis
accgtgagtggtactatggctgctgttgtgccgatagatgtgccaactagcaatttagtaaaaggcactatggctattaataaaataatgaacggaattgatcttaaaatattaatgataggatttaatacttga

SEQ ID NO: 2875 - DNA, 993 bp, Staphylococcus epidermidis
agtagaggaggatttcaagtgcaaaaaaaatatattactgccattattggaacaactgcccttagcgcattggcatcaactcatgcacaagctgcaacaacgcatacagtaaaaagtggagaatctgtatggtcaatttctcacaaatatgggattagtattgctaaattaaaatcacttaatggattgacttccaatttaatattccctaatcaagtattgaaagtatcaggctcatcttcaagagcaacgtcaacaaatagtggcacagtttatacagttaaagctggagattcattatcttctattgctgcaaaatacggtacaacttatcaaaaaatcatgcaacttaatgggttaaataactatcttattttccctggacaaaagttgaaagtttctggtaaagcgacgagttccagtcgtgcaaaagctagtgggtctagtggtcgtactgcaatatatactgttaagtatggagactcactatctgcaattgctagtaaatatgggacaacgtatcaaaaaattatgcaattaaatggattaactaatttctttatctatcctggacagaagttaaaagtgcctggaggtagttctagtagctcatcttctaataatactagatcaaacggtggctattattcaccaacttttaaccatcaaaacttgtatacttggggacaatgcacatggcacgtatttaatagacgtgctgaaataggaaaaggtatcagtacatactggtggaatgcaaataattgggacaatgcatcagctgctgatggatatactattgattatcgtcctacagtaggctcaattgcacaaactgacgctggttactatggtcacgtagcgtttgtagagcgcgtgaatagcgatggaagtattttagtttcagaaatgaactggagtgcagctcctggaaatatgacatatagaacaattccagcttatcaagtgagaaattacaaatttattcattaa

SEQ ID NO: 2876 - DNA, 1050 bp, Staphylococcus epidermidis
gtgttatggggagtgtttgatatggatttgcttataggtactttatttttaattttagttttagttatttttactctatttacatacaaagcacctagtgggatgagggcgatgggagctttagcgaatgcggcgattgcatcgtttttagttgaagctttcaataaatatgtgggtggtcaagtatttgggattaaattcttagaagaactgggagatgctgctggaggtttaggtggtgtggctgcggctggattaactgcattagcgattggggtatctccagtttatgcactagttattggggcagcttgtggaggtatggacttgttaccaggatttttcgctgggtatattgtaggctacatgatgaagtataccgagaaatatgtgccagacggtattgatttaattggttcaatcattcttctcgcacctatagctaggttaattgctactggattgacgccagtggttaataacacgttaattaaaattggggatattatacaaagtagtacagatgctaacccgttgattatgggaattgtattgggaggtattattacagtagtaggtactgctccattaagttcaatggctctcactgcattgcttggtttaacgggtgcgcctatggctataggtgccatggccgcatttagttccgcgtttatgaatagtgcattgttccatcgtttgaaattgggagaccgtaaatcaaccatttcagtcggaatcgaaccgctttctcaagctgatattgtttccgctaatcctattcctatttatgtcactaatttctttggtggggcaattgccggtattataattgcttggtcaggtatgattaataatgcaactggcactgctacacctattgcaggttttttagtgatgtttggttttaatagtttaacgaaagtgattatctatggtgtggttatggcgattataggaactattgctggtattgtagggtctattgttttcaaaaagtaccccattattactaaaaagcaaatgttagaacgggacacaacgacataa

SEQ ID NO: 2877 - DNA, 867 bp, Staphylococcus epidermidis
atatttagggggaattcatttatgaaaaagattttaagttttttaatcgttgcaattttagttttatcagcatgtggcggtaataatggtaaaaaggtaaccataggtgttgcatccaacgacacgaaggcttgggaaaaagttaaagaattagctaaaaaagatgatattgatttagaaatcaagcacttttcagattacaatgttccaaacaaagcacttagtgacggggatattgatttaaatgccttccaacactttgcttttttagatcaatataaaaaagctcataaagataccaatattgaagcacttagcactacagtattagctccattaggtatttattcagataaagttaagaacattaaagatgttaaaaaaggtgcgcaagttgctattccgaatgatgtatctaaccaagctcgagcacttaagttattagaatctgcaggtttaattaagcttaagaagaactttggattaaacggaacaacaaaagatattgaaagtaatcctaaagatttaaaaattaaagctgttgatgcacaacaaacagcgcgtgcactttctgatgtggatatatcagttatcaataacggtgttgcaacaaaagcaggaaaagacgctaaaaaggatcctatttatttagaaaaagcaagttcagatgcagtaaaaccatatattaatgttgtagctgtcaactctaaagacaaagataataaaacctacaaaaaaattatagaactttatcattcaaaagaagctcaaaaagcattaaaagaagacactaaagacggtgaaaaaccagtagatctttctaaaaaggaaatcgaagaaatcgaaaatgagttggcaaaaaaataa

SEQ ID NO: 2878 - DNA, 627 bp, Staphylococcus epidermidis
ggtgtaattatgattcagactattgtaactgctgctattctgtatattgcgacagcagtagatttattagtgattttgttaatattttttgctaaagcaaagactaaaaaggaatatcgagatatttatattggtcaatatgtaggatctgtgacattgattgtcgtaagtttattctttgcctttgtcttaaattatgttcctgaaaaatggatattaggattattagggttaataccgatttatttaggaattaaagtggctatttatgatgattgtgaaggagaaaagagagctaaaaaagaattgaatgaaaaaggattgtctaaattagttggtacggttgcaattgttacgatagcaagttgtggtgctgataatattggtttatttgttccgtattttgtgacattaagtgttactaatttattcattactttgtttgtctttttaattttaattttcttcttggtatttactgcacaaaaattagctaatattccaggagttggagaaattgttgagaaatttagccgttggattatggctgttatttatatagctttaggtttatttattattatagaaaatgacactattcaaacaattttaggatttatattttaa

SEQ ID NO: 2879 - DNA, 126 bp, Staphylococcus epidermidis
gttaaaattatgataacagaaattatcacttcaattttcaatagtatattaaagcaagaagaaatttatttaaataataatattgaacaattaagtgagttcagaaaagacattatcctaaaatga

SEQ ID NO: 2880 - DNA, 123 bp, Staphylococcus epidermidis
tattatgttatcataaataagttactacatgatttaactaaactacatttaattgaaaatatgacaattaaccatacttattttaatcttcaaaataagtatggtatacggagggaatcataa

SEQ ID NO: 2881 - DNA, 675 bp, Staphylococcus epidermidis
ggaggttatataaatatgtttggttcaagtttagattcatctcaattattacaagctctatacgaaacattgtatatggtgactgtatcacttgtaatcggtgctttaataggtatacctcttggcatcttgttagtggtaactagaaaaaacggtatatggtcgaatacaatattgcatcaagtattaaatcctatcattaatattttaagatcaattccgttcattattttattaatagccatagtgccttttactaaattgctagttggcacatctatcggcacaacagcagccatagtaccactcacggtttatgtagcaccttatatcgcacgcttagtagaaaactcattactggaagtcgatgacgggattattgaggcagctaaagcaatgggtgcatcacctcttcaaattatacgttattttttattgccagaagcacttggttcattaattctagctataactacagctattattggtctcataggtagtacagcaatggctggtgctgttggtggtggcggtataggtgatttggctttagtgtatggttatcaacgattcgatacaattgtaattgtgattacagtcattgtacttattattattgttcaaattatacaaacgttaggtaactttatcgctagggttatccgtagaaattaa

SEQ ID NO: 2882 - DNA, 702 bp, Staphylococcus epidermidis
gtgaaccatattaaagaaataggtgttgatatgaattttaaatatatgaatatagcaaaagggataattccaattttaataagcatgattattcttttaagctttatctctactcatgtgttagcgcaaaatcagtggttgagaatggttgatcttagcgtacaagagtggtttagtaatcaatttggggatcccaatagagtgtttggacatggtttcatcaacaatataatgacgttttgcgctacctttggtgatgttaagaccattttaattgtggctaccattattgcagtgctactcatgttttacaagaaggttccacaagcaatatggctaatcataacgatgactagtggcgcattgattaattatttaattaagcaaacgattgaaaggtcaaggcccgagaatcatttaattgttgatacaggatggtcttttcctagtgggcattctaatattaatacattattctttttaatgattatgatcattattatcccgttaatccgacagcgtgcttttaaatttataatcacaattttaagtattgtattttggattagcgttttaataagtagactgtattttcatgcacactacttttctgacgttgtaggaggcgtaagtttagctattatttgggtgtcgttatttatattagtgtcacctttattaaatttttggggagaaaagtaa

SEQ ID NO: 2883 - DNA, 135 bp, Staphylococcus epidermidis
ttcaaaaatattaatccactcagtatagcaatgacaagtgtaataaaaaacataaacaaaattaactctgaacttaacattgcgtatcctccatctcaaaaaatatctaaaacaataataaaaagcctacaatag

SEQ ID NO: 2884 - DNA, 1473 bp, Staphylococcus epidermidis
gggattatcatgggcgaatttaaaggatttatgaaatatgataaacagtcgctatcagaattgtctttggtagaccgtctttcgaatcatgaagcgtttcaacaacgcttcactaaagaagatgcttcgattcagggtgcgcgctgtatggattgtggaacacctttttgtcaaactgggcaatcttatggaagagaaacaataggatgccctattggtaattatatacctgagtggaacgacttagtctatcatcaagattttaaagctgcttacgaaagattgagagagacgaataattttcctgaatttacaggaagagtttgtcctgcaccatgtgagcaatcatgtgttatgaaaattaatagagaatccgtggcgattaaaggtattgaacgtacaattattgatgaagcatatgagaatgagtgggttcatcccgcatatcctgaagatcataaagaccaacgagttgctatcgtaggtagtggtccagcgggacttacagcagctgaagaattaaactttaaaggctataaagttactgtttatgaaaaggcgcatgaaccaggcggcttgctaatgtatggtataccaaatatgaaactagataaagacgtaatacgtcgacgtgtatcacttatgaaagatgctggggttttatttaaaacaggtgttgaaattggcgtcgatgtgagccgtgaaacacttgaagaaaattatgatgctattattttatgcacaggtgctcaaaatgcgagagatttaccattggaaggacgaatgggctctggtattcattttgcaatggactatcttactgaacaaacacagtatctaaatggtgagattgaaagtttgagcattactgctaaagataagaatgtaattattataggtgctggtgatactggtgcagactgtgtagcgacagcattacgtgaaaactgtaaatctattgttcaatttaataaatatacgaaacagcctgaagagattacttttgaaagtaatacttcctggccattagcaatgcctgttttcaaaatggattatgcgcataaggaatatgaagctaaatttggtcaagaaccaagagcctatggtgtacaaacaatgcgctatgatgttgacgagttaggaaatgttaaaggcttatatacacaaatattaaaagaaacgcctgatggcatggtgatggaagatggaccagaacgattttggccggctgatttagtcttattatctatagggtttgttggtactgaaaccactgttccgcatgcgtttgatatacacaccgagcgtaataaaattgtagctaatgatacaaattatcaaactaatcacgctaaaatatttgctgcaggagatgcaagacgaggtcagagtttggttgtttgggcaataaaagaaggtcgtgaagtagcacattctgttgatcaatacttaagtaaagaagttctagtgtaa

SEQ ID NO: 2885 - DNA, 141 bp, Staphylococcus epidermidis
cgtcaaatcatcatgccccttatgatttgggctacacacgtgctacaatggacaatacaaagggtagctaaaccgcgaggtcaagcaaatcccataaagttgttctcagttcggattgtagtctgcaactcgactatatga

SEQ ID NO: 2886 - DNA, 252 bp, Staphylococcus epidermidis
catattgtcattcagttttcaatgttcattttcttaccgacaagaattaattatactcttcatggttgtttaagtcaacaactttttgaaattaattttagtcgtttgtttaatgattcgttaagttgtttcgctcaacaaataaacactatacagacttattctcgttttaacaacagtaaaaattacactatcaaaaacaattcaaattactccggaggaaaaaccgaactttttttgtatgaaatttaa

SEQ ID NO: 2887 - DNA, 264 bp, Staphylococcus epidermidis
acatataacatgtcaccttatttaaacattatagacgtaactaagagagtcacaccagacagacaaattgaagttatacagatcacaatgaatggtttaagtgcttttgaaataacttcttttaaaacgatattcaatcctagagcaaccatcgccattaacatacataacgttgtaataacatttataatattcataagtaatgaaggaataggaacaaatgtattgatacaagccattataataaatccaattagaaagtaa

SEQ ID NO: 2888 - DNA, 171 bp, Staphylococcus epidermidis
actcgtggcatgagaaattcaccaaataaacatggtgaaactaaatatcgctattatgagaagtataaagattcactcacaaacaattggcgacgtgttagcatggtatttagaaatgataagcagttacaaaaagtggctcagaaacgcttaaataagatgagcgtatag

SEQ ID NO: 2889 - DNA, 144 bp, Staphylococcus epidermidis
agctttctaataaaactaatggagtttgtcctatcaaatcgtatgcaatcattatttttggttcagatgacaacaatgagtatcactgaacttaacccactttctttatttatgttagcgctaattcttacttatcagatatga

SEQ ID NO: 2890 - DNA, 486 bp, Staphylococcus epidermidis
aatgttctaattgatggaaagtttataaatttataccaaagtaacattgaaaaggttaatgataatcgtcatagcaatgaaactagcattcataatgatgattataaaaaaattttaaataaagttttaaaatcagatattataattttctcaacgcctctctattggtattccatgagtgcgtctttaaaactctttattgatagatggactgaatcattgcgagatacgcaaatagataacttcaaagaaattatgtcacaaaaaaagtacttaattttaatcataggcggtgacagtccacgtattaaagcacaacctttagtccaccaatttaaattaatatttgaatttatgaatattactcattttagatttttaataggcgaaggtaataaaccattcgatgttttaaatgactcacaatttatggaagaactcgcaaatacaaatcttgctttgaaaaaaggtgatatttatgattga

SEQ ID NO: 2891 - DNA, 132 bp, Staphylococcus epidermidis
ggggttgtttttgtacttctgaagttggaaaagacggtgtgtgaagtttgtttttatttgaacgcaaaaaatagagataaccatatagattatctcgctaccaggatatatcatttaaataataaaacatag

SEQ ID NO: 2892 - DNA, 1122 bp, Staphylococcus epidermidis
ggttttaagatgcaatccaagaatttttttaaaacaccttttacttggatgatgataatctttagttgcctgtttttaggtacgttaatattcacgttttttaacgatagattttataatatgcctataggacaaatcactcaaattactgatatccaatcacaaaaggtaacagacgagcacaaaaataaagatattaagtacaaagagaagataacattcaagattctaaatggtgaattcaaggggcaaacaacgacgattccccaccaatatgtgaaatctcaagctgattcagaatcattttccaaaaatgacaaggttcttttacatatttctaaaaatcctaaagacgcaactattatagagaaaaaacgagatactattgttgtcataataaccggcttatttttacttactgttttagttgtaggaaaaaaagtaggacttcaatctatattatctcttatcgttaataccattgccgttatgggagctattttaatacatgatcaatatggggctataagtttattctttttgatgacttgtgctattatcatttccacttctttcactttactacttgtaacaggttggcatagccgaaccttaattactattgtaagtacgctgattggtacgttcttatgtgttggaattaccgaagtcatcatcaaatttaccgggggaaatggaataaaatacgaaacaatcactttccttactctccctcctaaggatgtctttctagcttccgtactaataggtacacttggagcagtgatggatgtttctattactattgcaagtgggatgtacgaaattttaaaacgtagccctcaaatttccatgaaacgttgggctcttgccggaagacatatcggtcaggatataatgggaacaatgactaatatacttctcttttcatatctatctggtagcttacctatgtttctaatttatttaaaaaatgctaacactattacttatactatttcgatgaattggtcattagaagttgctcgagcattaactggtgggataggtatcgttttaactattcctataacaattgctttaatggaactatggtttaaactgcgaggtgttaatcaatga

SEQ ID NO: 2893 - DNA, 267 bp, Staphylococcus epidermidis
tattttaggattcaatatttaagcgggcaagcgtctctgaattcagaggcacttgcctattttatttttcacgtgaaacagcacagtatattcattcatattacattttcatttaaagtactgaatcaaacaattacattcgtcgatcataagtccattggtacggactatctagtaatcgccaatcttcatcaatctcactactatgaattaagcatgcatctaattcccgggaaattttttcttgatctaaatccgtaccaataa

SEQ ID NO: 2894 - DNA, 189 bp, Staphylococcus epidermidis
ataaattttgttatatatcctttattatgtggtttattttgtgctttactagaagtaatcgatttatggtatgcaaagaaaataactaaaactcattcaaaagattggagatttaatccacatttaatttggatgatgtttatattcagtgcagttatggggattatctatgttttattatttaaatga

SEQ ID NO: 2895 - DNA, 153 bp, Staphylococcus epidermidis
ttaagcaatgtcgttttgcccgaccctaaatatccacttaatacagttacaggtattttcgccatttcaagaaccctctcttttgtaaatagtaattattacgttttacattctatagaaagttccttcttttatcaatactcaattttttaa

SEQ ID NO: 2896 - DNA, 123 bp, Staphylococcus epidermidis
aaaataaatgtaagcgtgatttataaacacaaaagtagatgtttaacatttacaattatagttttcttaaagataatgaacgtatctactgaaatgtactactcaaaattgagtatcctttaa

SEQ ID NO: 2897 - DNA, 189 bp, Staphylococcus epidermidis
aattatttcgttctacaaaggttcttttggaaactccgtaaaaaagtgtcctaccaacccccaacaaagcaagcttggtgggttgggccttctccccgttttggtttggccgctattaagggaaatggattttttttcttcttcctccgggtaattagatgtttcagttctccggggtttgctttctga

SEQ ID NO: 2898 - DNA, 135 bp, Staphylococcus epidermidis
gtacatagctttcattcctcagatttggggagtgataatatcccacatattaaaattttcattttaagctgcgtagccaaattgactacgcacatctataagttagataaccgatatttcggttttccaaagtaa

SEQ ID NO: 2899 - DNA, 174 bp, Staphylococcus epidermidis
ctcgaggtagttgctagcactcattctgaccttttagcatctataattttaattataatcttgttaggagtggtaaagatgagcgatagtaaaactctcagacaaatatgtacaccaattttacaaaacagtattagtgattgttttgagtgcatagcctctgcctttagctaa

SEQ ID NO: 2900 - DNA, 132 bp, Staphylococcus epidermidis
gacttgccagtattgatgaaaataatagttggaaagactggtaggaaatactcggtgagattaacaattaaagattcattagaagaaattaagttttttgattatttcagtttaatgttaaactataagtaa

SEQ ID NO: 2901 - DNA, 924 bp, Staphylococcus epidermidis
aataagacagtatttattttattgaatggagggaaatcaactatggatataaaacaacttagatactttgtagaggttgcacgtcgagagcatatttcagatgcggcattagaactaaacattgcacagtctgcgattagtcgtcaaatcactcaacttgaaaaagaattgggggtgacattatttaaaagaagtgggagaaatatcatattaactgttgaaggtagacagttactctcacaggcaactcaaatactagaattaatggataaaaccattcactcatttcaacaacacgtatcacataaccaacagacaatttatattggatatgaagaaagtgatgcctctcaaatgattcttcccctaattcaaacatttgaacaacaaagtaacagtaccatgattccgcaacttacaaaacatgataaattattagatcaaatcctttccaatcaattggatcttgcaatcactgaatttactcctgtgttagaacgggaaacacatttacgcgtcatgcctttatttgaagaaaattattatatgtatgtgcccaaatcacatccactagctatgactgtacatcccccgctatctcaatttacaaatcaatcactatactgtctcgaaccaatgacaagctcaataaaaagtaaattgattgaaaagactaaggcacaagtacgaatgatttcagatatgaaactcgctcaacatattttgagtcataataagggatttattatttctagtcaaaattctttactatatgatcacgtaaattggactaaaatccctttaaatcatacagaattaaaacgaatgctatgtgtagttatgcgaaaagataacaagaaaaacgacattaatatagcatggaatttaatttgcacattattaaataaatcgactatatattaa

SEQ ID NO: 2902 - DNA, 189 bp, Staphylococcus epidermidis
ttggacaaagttaattactttttaaaagctttagtattggtaattatgcttcgttgtaccatgaattatttacttccatcacctgatacaataacttttgaaattttagatgggcttgcttttggtgttttaactgtatttttaattaattggattattggaatttttaagaagtattcacaaaaataa

SEQ ID NO: 2903 - DNA, 144 bp, Staphylococcus epidermidis
aaattccaatttagtaatctgtctatttatttaaggtatcaacaaaacacaaaacctttaaccacattgctaaatcaacaagctgataaatgctgcaatcctaatttaggactacacccgtgtattaacatatgcttaaattga

SEQ ID NO: 2904 - DNA, 1026 bp, Staphylococcus epidermidis
gtgattgaattcaaaaatgttaacaaagtttttcgcaaaaaaagagaaactattcaagctttgaaaaatgtatcatttaagattgaccaacatgatatttttggtgttattggttatagtggtgctggtaaaagtacattagttcggttagtcaatcaacttgagacagtatcagatggtcaagttattgttgatggtcatgagattgatacatataaagaaaaagatttacgtgatattaaaaaagatatcggtatgatctttcaacatttcaatttgcttaattctaaatcagtctataaaaatgttgcaatgccacttattttaagtaagacaaataagaaagaaattaaggaaaaagttgacgaaatgttagaatttgtggggcttgctgataaaaaagatcaatttccagatgaattatcaggtggacaaaaacaacgtgttgccatcgcaagagcattagtaacgcatcctaaaatattattatgtgatgaagcgacaagtgctctggatccagctactacaagctcaattttaaatttattaagtaatgtgaatcgaacatttggtgtgacgattatgatgattacacatgaaatgagcgtaattcaaaaaatttgtcatcgtgtagctgtcatggaaaatggcgaagtgatagaaatggggacagttaaagatgtctttagtcatccacaaacgaacactgcaaaaaatttcgtttcgacggtgattaacactgagccttcaaaagagttacgggcctcttttaactcgagaaaagattcaaatttcacagattataaactgtttttagactctgaacaaattcaattgccaatattgaacgagcttatcaacgagcatcatcttaacgttaacgtattattttcttctatgtcagaaattcaagatgaaacggtttgttatttgtggttgagatttgagcatgatgagtcatttaatgattttaaacttactgattacctttcaaaacgacatattcggtatgaggaggttatataa

SEQ ID NO: 2905 - DNA, 135 bp, Staphylococcus epidermidis
atacccatctctttctctaaattttttgatttgattgctaacattcattgctttaaactccttaattatgatttgaaatcatttaatattattattaaatcaaatcaggttttctctataaaagctatcaaatag

SEQ ID NO: 2906 - DNA, 192 bp, Staphylococcus epidermidis
aagaaatactcatgtctatacaaacggggtagtctaaccgtcccacttaacacaagtcatctttataagatttccttaacatctactattatatctacgatgatttacatttctaaattttattatgcaatcaatacttactttcctttatatttgtcacccatgcttcataatagaagcaacgtaatctaa

SEQ ID NO: 2907 - DNA, 198 bp, Staphylococcus epidermidis
gaaattgactcagatttttctgagttagatacacttcctgattctgacaagaactcgcttgtagacgtactttttgattcaatttccgatttgctatttgtattactttcggatgttattgagttagactcggacagagatgaactcattgaatcatttgctgattcagattggttcaaacttgctgtagtgctttga

SEQ ID NO: 2908 - DNA, 978 bp, Staphylococcus epidermidis
ttatttttatccacctatgttatttctgtgtataagtctaaaattttaagaaagatggagttatttatgtcagagaaagaaatttgggataaagttttagaaattgcccaggaaagaatttcaaacactagttatcaaacgttcataaaagatacgcaactctactcacttaaaaatgacgaagccattatattagtaagtctgcctttcaatgcgagttggcttaatcagcgatattcagaaattatgcaggctattatttatgatgtcatcggttatgaagtgaaaccacattttatttctgaagatgaacttgcatcctacaacaatgtaaatacacaagaagttcaagaaccccaagtacaacattcttctatagatgataagacttggggaaaagaacaatttaatatgcacaatacattcgatacatttgtcattggacctggtaaccgtttcccacatgctgcaagtttagctgttgcagaagcaccggcagaagcttataatccattatttatatatggaggcgtaggtctaggtaaaacacatttaatgcatgcaattgggcaccatgttcttagcaacaaacctaatgctaaagtcatttacacttctagtgagaaattcacaaacgaatttattaaatcaatacgtgataatgaaactgaagcatttcgtgaaaagtatcgtaaaattgatgttttattaattgatgatattcaattcattcaaaataaagaacaaacgcaagaagagttcttccatacttttaatgaattacatcaaaataataaacaaatcgttatttcaagtgatcgtccaccaaaagaaattgctaagctggaagaccgtctacgttctcgttttgagtggggactaatagttgatatcacaccacctgattacaaaacaagaatggcaatattacaaaagaaattgaagaagaaaatcttgatattccgccagaagctttga

SEQ ID NO: 2909 - DNA, 174 bp, Staphylococcus epidermidis
ttattgttatcgttcgtatttgagcatgctgcaagtgttaaagacaacgctagtatcaagtatgtaatgactctctttttcatagaattgagtaactccttttacgtctctatcattaaacagtgttttaaatttatacatctattagagtatcatttatcgaaaaatatttga

SEQ ID NO: 2910 - DNA, 990 bp, Staphylococcus epidermidis
aaggtgttatcatcttttttaatgttaagtataatcagttcattgctcacgatatgtgtaatttttttagtgagaatgctctatataaaatatactcaaaatattatgtcacataagatttggttattagtgctcgtctccacgttaattccattaataccattttacaaaatatcgaattttacattttcaaaagatatgatgaatcgaaatgtatctgacacgacttcttcggttagtcatatgttagatggtcaacaatcatctgttacgaaagacttagcaattaatgttaatcagtttgagacctcaaatataacgtatatgattcttttgatatgggtatttggtagtttgttgtgcttattttatatgattaaggcattccgacaaattgatgttattaaaagttcgtcattggaatcgtcatatcttaatgaacgacttaaagtatgtcaaagtaagatgcagttctacaaaaagcatataacaattagttatagttcaaacattgataatccgatggtatttggtttagtgaaatcccaaattgtactaccaactgtcgtagtcgaaaccatgaatgacaaagaaattgaatatattattctacatgaactatcacatgtgaaaagtcatgacttaatattcaaccagctttatgttgtttttaaaatgatattctggtttaatcctgcactatatataagtaaaacaatgatggacaatgactgtgaaaaagtatgtgatagaaacgttttaaaaattttgaatcgccatgaacatatacgttatggtgaatcgatattaaaatgctctattttaaaatctcagcacataaataatgtggcagcacaatatttactaggttttaattcaaatattaaagaacgtgttaagtatattgcactttatgattcaatgcctaaacctaatcgaaacaagcgtattgttgcgtatattgtatgtagtatatcgagcttcacatga

SEQ ID NO: 2911 - DNA, 141 bp, Staphylococcus epidermidis
accaacatatcaacaatgaaaaatgtactaaaacaagaaaacaaatacgtctcaaaagaactaaaatcaaaaaatacaaaaagcaaatcaatgattattttgagcgaaagtatcgatacgaatttcaaaaatctattttaa

SEQ ID NO: 2912 - DNA, 153 bp, Staphylococcus epidermidis
tattactcatcatattactcctttcatatatcgatggtattactaaaaatacccattaaaaaggtagcatatgcattaaagataaaagttatcacaagttttagtttaaatttaatgtatatggatcttctcttttttaatctgttcctttaa

SEQ ID NO: 2913 - DNA, 966 bp, Staphylococcus epidermidis
ttagtgtcatctattgacactaaaaggagaataataatgaaaaaatctgttagattatataatatgattgaatattgtaatgaaaataggaacttcaaattaaatgatttaatgtcagaatttaatatttctcgtagtaccgctttaagggatataaaagaaattgaagcattaggagtacctttatatagtaatccagggaaaaatggtggttatacgatcataggtaatcgagaccaaacgaaaatagcaatcacagatgaagagttgaaagctttagtatttacactttcgagtatttcaaatgtgagtaatctaccttttcaaacagaatatcaagaaatattaaaaaaattatataataactcgaataaaaaagagttaataaaccaatataatgatctatttcaatattttaatgaagataagtatcagttcaaaagttataagttatttaatgaaatcattagattgataattgagaataagtcttttgaaacctgttattcacaaaactatattaaagaacaatataaaggtattggcattatgtataaaaatcatcaatggtattttgttgtagctaatatagaatcaaagttagtgaatctattaaatatttcgaaaataaaagaactatatgaaatgggagagactcaagagtgtaatgatataactatgcagaattttcaacagttcatggttaaaaatgaaactgctattgatattcttattagaagcaatgttatgggattgaatatcttgaaaggctacctgtggagtgactatatgattgaaaatattgacgaagagacatatttatttaaatcaaaagtgaacgcgaaagatatagattttatagctaagttaattgtcacaggtggtgtcaatgtaaaagtagagacccctaatagtttgaaaaatgctgttaaagttgaattaactaaaataataaacatgtattaa

SEQ ID NO: 2914 - DNA, 411 bp, Staphylococcus epidermidis
attggaggattaaaaatgaagttagcaattattaaattttcagttggtggtttagctgttttaattagttatattgtttctgtcgtgcttccatggaaggaatttggaggtatatttgcaacctttcccgcagtgtttttagtttcaatgtgtattactggtatgcaatttggcaatgaggtagctatgcatgtgagcagaggcgcagtcttcggtatgataggagttttatgtagtatactagcaacctggggattactacaagctacacatatgtggctattgagtattattggtggttttgtagcttggtttgtaagtgcattgattatttttgaaattgtggaattcatagcacataaaagaagggataaacatggctggaagaccaaaagatccaacaatcaataa

SEQ ID NO: 2915 - DNA, 270 bp, Staphylococcus epidermidis
aggagacaatcaattatgtttggattaataggtatgattattgtcggcggtatcattggatggatcgcaggtttaattttaggtaaagacgtaccaggaggtattctaggaaatattattgctggtattgtaggatcatgggttggtactatgattttaggtgaatggggaccacaattaggtaaaattcacatctttccagcattattaggttcaattattttaatctttattatttcattaattttaaaagcactaagaaaaaaataa

SEQ ID NO: 2916 - DNA, 1242 bp, Staphylococcus epidermidis
gtaaagtttttagcttctcaactattcaaaggaggtttttttatcgattacttaggtgttgatattagtaaaaggagtagtgtagttgcacattataaaaatggaaaattccaaaaagagtttttcatccaaaataataaaaatggctacaattatttactcaagtatttgaatgacttagaccacccacaactcatttttgaatctacaggtatctattcaagaggtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgctcaaacaaacaggcagcttacctatacatgagttaatattctttgaattaagagaacgtgcccgttttcatctagaaatcgagaatgaacaaaatcgacttaaatttcagattcttgaattactccatcaaacattccctggtttagaaagattatttagtagtcgatattcaatcattgcactcaacatcgcagaaatttttactcatccagacgtggttcttgatatcgacaaggatgtacttattacacatatattcaattctacagataagggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaacgcttttgtaggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 2917 - DNA, 1017 bp, Staphylococcus epidermidis
  modified_base (995)..(995): a, c, g, t, unknown or other
  modified_base (1000)..(1000): a, c, g, t, unknown or other
  modified_base (1014)..(1014): a, c, g, t, unknown or other
gtaaagtttttagcttctcaattattcaaaggaggtttttttatcgattacttaggtgttgatattagtaaaagaagtagtgtagttgcacattataaaaatggaaaattccaaaaagagtttttcatccaaaataataaaaatggttacaattatttactcaagtatttgaatgacttagaccacccacaactcatttttgaatctacaggtatctattcaagaggtatggaacgattttgttgtgtaaatcaaattaactatattcaaatgaatccgttagaagccaaatttaaaacgagcactctaagatcatggaaaactgatcaggcagatgctcataagcttgcttgtttaggaccgacgcttaaacaaacagacaacttacctatacatgagttaatattctttgaattaagagaacgcgtccgttttcatctagaaatcgagaatgaacaaaatcgacttaaatttcagatccttgaattattccatcaaacattccctggtttagaaagattattcagtagtcgatattcaatcattgcactcaacatcgcagaaatctttactcatccagacatggttcttgatatcgacaaggaggtactgattacacatatattcaattctacagataaaggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaatgcttttgttggcattgatatcaaacgagatccaggcacgtcatacacatttangattnaagtccggcagcgntaa

SEQ ID NO: 2918 - DNA, 546 bp, Staphylococcus epidermidis
tttagtacttttaacttttttttactatccgcttgtacaattaatattgagcgtgatgaggaaaatagtgagaaaaataaacagaaagaaaacactcatactgattcaaacaatacaagttcgaatgaatcaaatacttctaaacaatcatctcaagaaaatactataaatcaaacagaacaaaatcaaccgactgagaataattcaagttcacaacaagatttgcaactaataacagaaaatgaagctattcaaaaagtaaaagatgagtttccacctatacgaacaggaaatgactatcgtatagatactactagaactgataataatgtgtacgctatcaaatttacttctcaagatgcagaaggttatcctatgaaagctgctgtcactattgataagcgaacaggagaatttattgattatattgatgatagaagcgatgaagataaagagcgtcatgtccaacatgctaaagaaagtactctttataaaggtccatacgatgctttcagaaaagattttagtcataaaataaatgaatga

SEQ ID NO: 2919 - DNA, 243 bp, Staphylococcus epidermidis
aggagtactttaatgacattattaactaaagttttagatactttaacaggcatatgtgttgctttattgtttaccaagtattttgtaaattatgcaaatgatatgtttgactggcacttaagatggtatttcctagaaaatgtacctcatttagcgctcattttgtttattctagtatttatctttgctgttccttctgaaatgattaaagataaaaataagaaaaagcataatgattcataa

SEQ ID NO: 2920 - DNA, 168 bp, Staphylococcus epidermidis
attttaactttatatttaagtttttatgagactcttaatattttatttattcatatttttacaacattacttttttatcaactagaaaatattaggaagtgtaatataaatcacaaagcgtgtaagacatcgtttgccctcgaccatgatgcgctttcatttcattaa

SEQ ID NO: 2921 - DNA, 555 bp, Staphylococcus epidermidis
ttttgtatgtttagttatcaaataaataaaaatattaaattaaaaatattagaagaacgagaagccgaacagttatttaaattagtagatagcaatcgtgactatttagctgaatttctaccttttgttgaacatacgaagaaagttgaagatagtaaacactttatccattcggcgttgcaacaatttatcgatggtaatggatttcattgtggaatatggagtaataaagaattgattggagtcataggattgcattacttagatttagttaataaaacaacttcaattggttattatttagctgaagactttcaaaagaaaggtattatgactaaatgtactaaagcgttaattcgctatgtatatgaagtgtatgatattaatcgtatagaaatacgaatgtctactaaaaataagaaaagcagagctataccaattagacttgggttcacgcaagaaggtatattgagaagtaatgaacgattacaaggggaattctcagatagttatgtttttagcttgttgagggaagaatgtacgtatactagataa

SEQ ID NO: 2922 - DNA, 327 bp, Staphylococcus epidermidis
aagtgcatacctttttattttcaaaagtcttcctcctccataataaagatatcttcaacaggttcaccaaagattcttgcaatttttattgcggttaatatagatggtgtaaaatcgttgcgttctattaaagacaccgtttgtcgtgatattccagcttttttagcaagctctgtttggttatatccatcacgggctcgtaattctttaagtctattgcgcaaattgtatcacttccttacatataaactatataatatatttgtcattatgacaagtatattagtcaaaatgacaaaaataatagactttttagggattgtataa

SEQ ID NO: 2923 - DNA, 198 bp, Staphylococcus epidermidis
tttccgtcaccattagctgaattggttaataaatatagttattcattaatacctaataaactttcatccaccgcccttttccaacttcggaaatacaaaaacaaccctctaaccattgctgttaaagggttgttgcattattatattatattctattcccactcaattgtacttggtggcttagaggtaatgtcatag

SEQ ID NO: 2924 - DNA, 126 bp, Staphylococcus epidermidis
aatttgtcgttcatttatttattagaagtatatattttacagacttctaaattaattgttacaacaattattattatcttgctgtcctttttcattcttctctgttttttcttcaatttctactga

SEQ ID NO: 2925 - DNA, 579 bp, Staphylococcus epidermidis
gtggagtcgttaggacgaaaagtcaaagaagatggcgttgtcatcgatgagaaaattttgaaggtagatggatttttaaatcatcaaattgatgcaaagttgatgaatgatgtaggtaaaacattttatgagtctttcaaagacgctggtattactaaaattttaactattgaagcttctggtattgcgcctgctattatggcttcttttcattttgatgttccttgtctatttgctaaaaaagctaaacctagtactttgaaagatggcttttatagcacggatattcattcatttacaaaaaataaaacgagtacagtcattgtatctgaagaatttttaggtgcagacgataaagtacttatcattgatgactttttagctaatggtgatgcttcgctaggtcttaatgacattgtaaaacaagcaaatgcgacgacagttggcgtgggtattgtggttgaaaaaagtttccaaaatggtcgccaacgtttagaagatgcaggcttatatgtatcttcactttgtaaggtagcttcattaaaaggcaataaggtaactcttttaggtgaagcgtaa

SEQ ID NO: 2926 - DNA, 123 bp, Staphylococcus epidermidis
ctatatttttttactttgcaacagaacccttcatttattcaatgttctgaaggtgttttgaaaaatagtctccagtctgccatatttgttcttgatccacttctgacaatgagggattcgtga

SEQ ID NO: 2927 - DNA, 123 bp, Staphylococcus epidermidis; identical to SEQ ID NO: 2819

SEQ ID NO: 2928 - DNA, 1101 bp, Staphylococcus epidermidis
ataatggctttaacagcaggtatcgtaggtttgcctaacgtaggtaagtctaccctatttaatgcaattactaaagctggcgcattagcagcaaactatcccttcgcaacgattgatcccaatgttggtatcgttgaagtgccagattcacgtttaataaaattagaagaaatggttcaacctaaaaaaacaattcctacaacttttgagtttactgatattgcaggtattgttaaaggtgcatctaagggcgaaggtttaggaaataaattcctttcacatattcgtgaagtagatgctatatgtcaggtggttcgtgcgtttgacgatgagaatgtaacacatgtatcagggcgtgttaatccgcttgatgacatagaagtcattaatatggaacttgttttagcagatttagaatctgttgaaaaacgtttaccgaaaatagagaagatggctcgtcaaaaagataaaacagctgagatggaattacgtatattaacacaaattaaagaagcgttagaagacggtaaaccagtacgcagtattgatttcaatgaggatgatcaaaagtgggttaatcaagctcagttattaacatctaagaaaatgttatacattgctaatgttggtgaagatgaaattggagataaagataatgataaagtgaaagcaattcgtgaatatgcagcaaacgaagattcagaagttatcgttattagtgcaaaaatcgaggaagaaatcgctacattagatgatgaagataaagaaatgttcttagaagatttagacatcgaagaaccaggtttagacagactcattagaacaacatatgatttgttaggtttatctacttactttactgccggtgtgcaagaagtgcgcgcttggacatttaaacaaggaatgactgcaccacaatgtgctggaattattcacactgattttgaacgtggttttattcgtgcagaggtaacaagctatgaagattatgtacaacatggtggcgaaaatggtgctaaagaagcgggaagacaacgtttagaaggtaaagattacatcatgcaagatggggatattgttcatttccgttttaatgtttaa

SEQ ID NO: 2929 - DNA, 171 bp, Staphylococcus epidermidis
cgagctattacaacagttataagagaaacttacaataatgaaagtattccactagaccttcaaatcttactttggcacatggtagaagaaaaagataaccagcctcaaaagctttatcacttattattgataattttgactgcatcattaataatattttttgttaattga

SEQ ID NO: 2930 - DNA, 162 bp, Staphylococcus epidermidis
gctatttctacagactctctatttttaataattaaaccattatgtgcaccaattgaagtagaacgtgcagtgactaaaggtattgccaatcctaaagcatgtggacaagcaatgactaacacagttacaagacgttcgagtgcaaaatcaacatcattttga

SEQ ID NO: 2931 - DNA, 564 bp, Staphylococcus epidermidis
actgccgagttacctaaaaagacgacaagaataggtaaaccgtattataaaacggacaatttattacaaagacaatttaaagcgagttgtccaatggaagtattaacaaccgatattacttatttaccatttggtcattctatgttgtatttatcttcgataatggatatttataacggagaaattgtggcgtataaaatagatgataaacaagaccaaagtttagttaatgatacattaaatcaaatcgatatacctgagggttgtatattacatagtgatcaaggcagcgtttatacatcttatgcttattatcaattgtacgaagaaaaaggcattatcagaagtatgtcccgaaagggaacacccgccgataacgccccgatagaaagtttccattcctcgctaaagtctgaaactttttacatcaataatgagcttaatcgctctaatcatattgtaatagatattgtcgaaaagtacattaaaaactataataataatcgaattcaacaaaaactaggctacttatcccctgtgaaatacagagaattaatagcctag

SEQ ID NO: 2932 - DNA, 444 bp, Staphylococcus epidermidis
ttggtttatacgttacacttattgtattttaaaaaagaggtgtcaatgatgacaaagaaaataatttattttatatgtacaggtaattcatgccgtagccaaatggctgaaggctggggtaaaaaaatcttaggagatgaatggcaagtatattctggaggtattgaggcacacggtgtaaatccaaaagcaatcgaagctatgaaagaagttggaattgatatatcaaatcatacttctaatttaattgacaaaaatatactaaaccaatccgatttagtagtaactttatgtagtgatgctgacaataattgtcctatattgccgccgaatgtaaaaaaagaacactggggatttgatgatccagcaggcaaaccttggtcagagttccaacgtgttagagatgaaatcaaaaccgccattgaatcatttaaaactagataa

SEQ ID NO: 2933 - DNA, 1278 bp, Staphylococcus epidermidis
gttatggagtttaatggaattttagaagattatgctacttatatttacagaggaaagcaacccaagtattcgactaatggaataccagttatcaatcaaaaagcaattcaatggagtggattaaataaagaatttttaaaatttcataataatgaaataaaagttgattcaagacactttgttaaaaaaaatgacttactaattaattcgactggtactggcaccgttggacgagtttatcatttcaaatttcaacccgaaaagatgtttgttgactctcatataactattataagaactgatgaaaataaattaagaagtcgttttttatattatcaaatgagaacaaataaatttcaaaatatgatcttaaatgagtttttagctgggtctactggacaagtagaatttaataaatcgatggtaaaaaaattaccaatctctattccagaagttaactatcaagatgtagttatcaaagttttagatgaactagaagataaaatagaaataaataaaaaaatcatagcaaacctagaggaactatcacaaacattgtttaaacgttggtttgtagattttgaatttccaaatgaagagggtaatccctataaatctagtggtggagaaatgattgatagtgagttaggtaagataccaagtaattggaaaatctataaattaaaagatatagcaagtcataaaaaggaaacttttaatcctaaaaagagtgaagaagtaacagttaaacattttagtttacctgcttatgataatgaagaacaagctatagaggaagaagtcaataaaataaaaagtaataaatggattattaataacaattgcgtattattttcaaaaatgaatcctgatactaaaaggatttggttacctgtaatagataataaaaaattaaatgttgcttcatcagaatttgttgtaatggaatctcctaataataaaattaattcattcatatataatatatgtcttaattctcaatttatagattatttaaaagctaatactaccggttcaacaaatagtagacaaagagtaaaaccaacaatagctgttaattataaattagcaattgaagatagtattgtaaaaaaatattctgaaataatcactccatatatggaagaaatgaaaatattaagatcagaaattggtaaattaactcaattacgagatactcttcttcctaaactaatgtctggagaactagaaatatctgatgatattgaggtgaatagtgatgaactttcaatttaa

SEQ ID NO: 2934 - DNA, 384 bp, Staphylococcus epidermidis
tcaagcaatacaagaactcaaacaaaaatagaaataactatatataagagaggtgattattcaatggaatttattaagtccagctctaatggaacagaggaagaacaattagaattttatgaacagatatttaatgcgctcgctgataaaattagacttaaaatcttgcattctatacgtcaaagcaatacaaagtctttgtgtgtatgtgatttggaagaattgctagaattaaaacagtctaaactttcttatcatttaaaaaaattagtagatgcaaatatcctcattgcagaaaaacatggcacatggaattattataaaattaatgaacaacaaatacaggtagtattaaatgaagatacttgttgtaagatactgtaa

SEQ ID NO: 2935 - DNA, 1695 bp, Staphylococcus epidermidis
ctattatgtacaagatgtagcatcgttagatgcgtttggaggcgtattatcatgaatcatatattacaaatgttatctaagctattaagtgtggctaaggaggcaatcgaccgtcaaggtctgattgctatcctaactattcctgttaataatgacgatgaaatagaagaaacggctcaaggtgaaaccgtgtataacgaacttatcgatcagttacgacttaatatcccaaaagatacggattatcgacctaacatctatagttattttggtattaagaagaatcctaatgacaccgtactcatggaaatgatgataaaggtttttcatatcaaacgctttaattcagaactgtttgttttcaaagctaacgggtggcaaaagataaatggagatgaattacaagggttgatatctaaaatgatacaagtattgcttgtagattataagccttcactaagcactctaaaaaatgtcgtagatggattgcaaaaatcaacagatgtagaagaacttgttgaaaatgagcactatattggttgtggtgaaaatatgttcgatcttaatacgtttcaagtcgttaaaaattcaatcgatatctttcctaaaacacgattgaatttatcattaagtacaaatgatgtaattactgataagataccgccttattttaagcaatatatgttacaacttgcgaattatgacgatgatttacaatactttcttttccaacatacagcagtattacttacagctgatactaaataccgtagaggtctcattttgtatggtggagctaagaatggtaaatctgtatatattgaactagttaaatcatttttctatagtaaagatattgtgtctaagccacttaatgagcttgaaggtcgttttgacaaagaaagtttaattgacaaaagtctaatggcaagtcatgaaattgggcaatctaagattcaagaaaagattgtaaatgacttcaaaaagttattatctgtagaatcaatgcatgttgatcgtaaaggaaaaactcaagtggaagtcattttggatttgaaacttatttttagtacaaatgcgatacttaattttcctcctgaacatgcgaaagctttggagcgtcgaattaatattattccatgtgagtattatgttgaaaaagcggacacttcattaattgataagctccagagtgagaagaaagaaatctttctttacttgatgtatgtgtatcaacagattgtaaaagcagatatcgagtaccttgaaaatagccgtgtcactgaaattactcacgattggttaaattttggatatgaatttgtttctagcaggtccgtaagtattgcaaatcagaaagcatgtattaatttactcagaaaacttatagaaatcaaatcaggatcacgaatcaaagtatccgagttaaataaagttattaatgaagaaataaaggtgagttctcaggttattaatcagttaattcaagcaaactttgatactcaaaccaaactatacaatggctacgattattggattgatttaggttggaaagaagccaataaaaaagagattcatgatatttcggaaaaagataatattatttcattagataaaaatgaaaatataacagacgatgaggcattagatgaagagaatttggactttgattgggaggactgtgacgatgaataa

SEQ ID NO: 2936 - DNA, 225 bp, Staphylococcus epidermidis
aaaggtgtcaccggaaatggtaaaagttacatcgcttttactttagtaaatcatgcgattgataatcggtatagtgtattattctatagattgacagatttattaagtaagctacaacaagctgattataatagcatagataaactattaaaagtgattagcagaacggatattttagtaaatgatgattttttattgccgtatacaactgaacaagaacaatag

SEQ ID NO: 2937 - DNA, 1143 bp, Staphylococcus epidermidis
atctattacacaaggagaatatatatgaataagaaactattgtggagcatcattggtattgtaattattgtcgtattaatcattgctgcttttatattaaaacaagttaatggttcaggtagtaaagatagtaaggcatacgatacatatacagtaagaaaagaaacacctattagtttagaaggcaaagcgtctccagaatctgtgaaaacttataataataatcaatctgtgggtaacttcttaagtgtttcagtacaagatggccaaacagttaaacagggtgaacgtatcatcaattatgatacaaatgggaataaacgccaacaactagtgaacaaagtgaatcaagcacaatctcaagttaatgatgattatcaaaaagtaaatcaaagtcctaacaatcatcaattacaagttaaattgactcaagatcaaagtgctttaaatgaagctcagcagtcattgtcacaatatgacagacaactcaatgacagcatgaatgcatcatttgatggtaaaattaatattaaaaatgattcagatgtaggtgaagggcaacctattttgcaattaatttcttcaaatcctcaaattaacgcaactatcacagagtttgatattaataaaattaaagaaggcgatgaagtagatgtcactgtaaatagcacaggtaaaaaaggaaaaggaaaaattcttaaaatagatgaacttcctacaagctatgatacaagtgacgatagtacagcatcatcggcacaagcaggggcacaaggtgatagtgaagaaggaactgaaatgacgacatctaatcctacaattaatcagccaacaggtggtaaaagtggcgaaacatcaaaatataaagttatcattggtgatttagatatacccgtgagatcaggcttctctatggatgctaaaatccctcttaaaactaaaaagttaccaaataacgtattaacaaaagataataacgtatttgtcgttgataaaaataataaagttcacaaacgtgaaattaaaattgaacgtaataatggtgaaatcattgtgaaaaaaggattgaaatctggcgataaagtccttaaaagtccaaaaggtaatttaaatgatggagaaaaagtagaggtgtcatcatga

SEQ ID NO: 2938 - DNA, 342 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattcccgagactgaattcgatgaattcagacatcatcgaggtgcaacatcataccatccaaaaatgatgttaaaagtagttttatatgcctacacccaatctgtgttttcaggacgtaagatagaaaaattactcaatgatagtatccgaatgatgtggctatcacaaaatcaaaagctttcaaataagccgtgtaatccgcagggttgcccccaa

SEQ ID NO: 2939 - DNA, 273 bp, Staphylococcus epidermidis
gcaccttcaacgaaggtcgcaatggctaaagtcattaaagcttttaaacttaaacctgactgtcattgtacatcgaaatatctgaataacctcattgagcaagatcaccgtcatattaaagtaagaaagacaagatatcaaagtatcaatacggcaaagaatactttaaaaggtattgaatgtatttacggtctatataaaaagaaccgcaagtctcttcagatctgcggattttcgccatgccatgaaattagcatcatgctaacaagttaa

SEQ ID NO: 2940 - DNA, 192 bp, Staphylococcus epidermidis
actattgcaactttccagcccaataaaacccatagcataaacaccattaatggattcattaatggtgaagcaattaagaaactcaccgctggaccaaaaggtactttagaatttaatagacctgcaagtattggaattgttgaacaagaacaaaagggagtaatcgcaccaaatatcatcccaaaaaaataa

SEQ ID NO: 2941 - DNA, 132 bp, Staphylococcus epidermidis
ccctttcaaactagacgatgtacaaatcgaaactataagggagtaatatatcaagattctgtcccagccttttattttaagaatatctatttatgtctcataatctttcatatagcgatcaaacttaaataa

SEQ ID NO: 2942 - DNA, 330 bp, Staphylococcus epidermidis
atggctagaacgtataatgtgattaaatatgtcattaagaaaaataaggatgatcttaaaatacatggattaagattatatgaatttaatataaaagatgaaaaagctataaatattagccaacccatttttgtgaacagagcaactttgattgagaaaatacaaaatgatgaagcatttacgcacgcctttagagtaaatcacaatacttattatgcaggccaattaatttctttatcattgaataaaaatggttatattaataacaactttgaggcctcacgagatattattagaaacgttgaagtaagtattttagactatgaataa

SEQ ID NO: 2943 - DNA, 300 bp, Staphylococcus epidermidis
actatgagaacatatgaaattatgtatatcgtacgtcctaacattgaagaggatgctaaaaaagcgttagttgaacgtttcaatggtatcttagcttcagaaggatcagaagttttagaagaaaaagactggggtaaacgtcgcctagcttatgaaatcaatgatttcaaagaaggtttctataacatcgtacgtattaaaactgataacaataaatcaactgacgaattccaacgtttagctaagattaatgatgatatcattcgttacatcgttattcgtgaagaccaagataagtaa

SEQ ID NO: 2944 - DNA, 216 bp, Staphylococcus epidermidis
ataataatgacagcaaatgttgtagtcatcacaatgacatttgaattttcagaaccgaatttgaatgttagaggaaacataatggagaaagtccctgcgccaccaatggcaacacatagtgaaatgaataccatacttaaactttgtgtgattagaccgacactaggtacacctgcaagtatcccaactaatgcacacaagagaaaaatagtataa

SEQ ID NO: 2945 - DNA, 444 bp, Staphylococcus epidermidis
ccatgtaagacaacatttttaaaaggggcgataatcatggcaaaaattactgtagtgaataaccaagatgaattatataaagtcatcaatcaaataaaatctgaaggttatttagagacagaattagctgttatcagtaaaagtaagttgcacttagatgatttacacaactctcaaatctcgttaatggctacaagtggctcatttagtgaccgtatgtctcgtttacttacaggtgaagatggagaagaaacagtattatctcgttatgatttaactgacaatgaactagaaggatataaacaagatattttaaacgataaaatgctcgttgttgctaacagtgaccgttcttctcatgatgaagttgaagataataatgctgcatataaagaagtggatattactcattatgccgcagagtctgaagggcctaaagcataa

SEQ ID NO: 2946 - DNA, 1395 bp, Staphylococcus epidermidis
ggaggcgagactcttatggattttgatacgattacaagtatttcaacaccgatgggtgaaggtgctattggaattgtgagattatctgggccacaagctattgaaatcggagatatcttatataaaggaaagaaaaagttatctgaagttgagacgcatacaataaattacggtcatattattgatccagaaacaaatgaaacagttgaagaagtcatggtgtctgtattacgtgcccctaaaactttcacacgagaagatattattgagataaattgccatggtggtattttaacaattaatcgtatattagagttaactatgacttatggtgcacgtatggcagaaccaggtgaatatacaaaacgtgcatttttaaatggtcgtatagatttatctcaagcagaagcggttatggattttatacgttccaaaactgatcgagcttctaaggttgcgatgaatcaaatagaaggacgtttaagtgacttaatcaagaaacaacgtcaatccatattagagatactcgcccaagttgaagttaacattgattatccagagtatgatgatgtagaagacgcaacgacggacttcttactagaacagtctaagcgtattaaagaagaaatcaatcagttacttgaaacaggagcacaaggtaaaataatgagagaagggttatctacagttattgtaggacgtcctaatgttgggaagtcttcgatgctaaataaccttattcaagataataaagcaattgtgactgaggtcgctggtacaacaagagacgtgttagaagaatatgtcaatgttagaggtgtcccgttacgacttgtagatactgcgggtattagggatactgaagatatcgtagagaagattggtgtagaacgttctaggaaagctctaagtgaagcagatttaattttatttgtgcttaataacaatgaacctctgacggaagatgatcaaactttattcgaagtcattaaaaatgaggatgttattgtaatcattaataaaacagatttagaacagcgattagatgttagcgaactaagagagatgattggtgatatgccacttatacaaacatcgatgcttaaacaagaaggtattgatgaattagaaatacaaattaaagatttattctttggtggcgaagtacaaaatcaagatatgacttatgtatctaattcacgtcacatttcattgttgaaacaagcgagacaatcaattcaagatgcgattgatgctgctgagtctggtatcccaatggatatggtacagattgatttaacacgtacttgggaaattctaggagaaattattggagaatcagcgagtgatgaattaatagatcaactatttagtcaattttgtttaggaaaataa

SEQ ID NO: 2947 - DNA, 444 bp, Staphylococcus epidermidis
gaaagagagacatatatgaaatacgatgattttatagtaggagaaacattcaaaacaaaaagccttcatattacagaagaagaaattatccaatttgcaacaacttttgatcctcaatatatgcatatagataaagaaaaagcagaacaaagtagatttaaaggtatcattgcatctggcatgcatacactttcaatatcatttaaattatgggtagaagaaggtaaatacggagaagaagttgtagcaggaacacaaatgaataacgttaaatttattaaacctgtatacccaggtaatacattgtacgttatcgctgaaattacaaataagaaatccataaaaaaagaaaatggactcgttacagtgtcactttcaacatacaatgaaaatgaagaaattgtatttaagggagaagtaacagcacttattaataattcataa

SEQ ID NO: 2948 - DNA, 489 bp, Staphylococcus epidermidis
atggaatttgcatattatgaagcgaaatctttaaatgattttgaaaatgaactaaaaacacttgctttaaataaaaaatatacatttagtaaagaaaccgaagtccttaaagaagaagaaattcttgaaaaatcgaatagccatgagcgcgaactattaaaagtatttaaagataatgcgcagataacaacgtatcattttaagagtcataaaagtaattatttaattattattggagagacaaaaacacctaatatcattggtctaacagtgatatttgataaaaaaccttttaaacaaatagggaaagttgcgttaggatggctaattgctttgacttcaggtggaagtatattagccattggagcagtatttggaatacttacctcagttgcaagacgtacacttgtaatcaaaggaccattaggaaaagaaatttcacaaattatagaaaatgaattaggagaaccgatagaaattaaaaaataa

SEQ ID NO: 2949 - DNA, 729 bp, Staphylococcus epidermidis
ttttattattttattggagagactggggctgataatatgactcaccttacgtttaaacaaggtgtgaaagagtgtattcccacgttacttggttatgctggtgtaggactatcgtttggaattgtggcagcctcccaaaatttcagtgttttagaaattattttattgtgtctgattatttatgctggtgcagcccaatttattatttgtacattagtgattgcaggcacccctatttctgcaattgtgcttacaacacttatcgttaactctcgaatgttcttattaagtatgactttagcacccaattataagcaatatggattttggaatagggtagggcttggaacgttattaacagatgaaacttttggagttgctataacgccatatgtcaaaggtgaaaaaattaacgatcgatggctacacggactaaatattactgcttacttattttggactgtttcatgtgtaatcggtgccattttcggagagtatatttcaaatcctgatgcgcttggcctagactttgccattaccgcaatgtttatttttttatgtatatctcaatttgaagggattaagaaatcacgattgagaatatatattgtactcattgtatgtgtgattgtgatgatgcttcttctaagttcaattctaccttcatacgtagcaattttaatagccgcaattgttgctgcattgttaggggtggtgatggaaaaatga

SEQ ID NO: 2950 - DNA, 270 bp, Staphylococcus epidermidis
gagagtgctgctgagaataaactgctcgctttggcgtcagatttaaatattttagaaataactagaaagattaaaaatacaacaacaacactaaagattgttcctatgaaagcacctatagttgtagtcatacgtaacatattttcatccatttggctattagctatcgattggttatctaatagttcattgctagtattatatgtgatgaaagcgctaataatagctaatactatcactatgattgatttaagtatccattttggctga

SEQ ID NO: 2951 - DNA, 198 bp, Staphylococcus epidermidis
ctcccatatgcaaatacaacagcaactcccaatattgcaactaataaaataacacctaagcttgcaaaaattttcttcacattgctaaccccattctatatttattttaattttatattaatctattttgctacgcttttctatatttattctaaaataattgaaaaagaacacattttgaaatcaatgtgtctttga

SEQ ID NO: 2952 - DNA, 135 bp, Staphylococcus epidermidis
gggttcagtgcctctaacaaaaagcattctttttttgtgaaaataatatctcttaaattgtttaaatcattatatccttatctattaagatcaaattttaaaataagtatattgatatcgtttacctgtaaatag

SEQ ID NO: 2953 - DNA, 147 bp, Staphylococcus epidermidis
cacggctattttcaaggtactcgatatctgcttttacaatctgttgatacacatacatcaagtaaagaaagatttctttcttctcactctggagcttatcaattaatgaagtgtccgctttttcaacataatactcacatggaataa

SEQ ID NO: 2954 - DNA, 141 bp, Staphylococcus epidermidis
aggctcgacgcttacaacgcggtccggttccaccgtcaaccgtacggacttaccggtgccgtgacaaggcgaagcgatgtggaccgtccggccgatgagtgctgggaacataagtgtgtcaagggcgcaccatgcatatag

SEQ ID NO: 2955 - DNA, 147 bp, Staphylococcus epidermidis
aaaatatatttaagaattatgaatttagttcttattaatgttaaagatcatcaattattttgtcacattatcttgagaggattaccttatgaggtagccttttatttgtcacctaatattgctctaaggctaataatacatatataa

SEQ ID NO: 2956 - DNA, 1116 bp, Staphylococcus epidermidis
gaggagctagctatgaaggatacagatttagctcaaattgctttaacacaagatcacactggcgcaattgccaatccaatatatttatctactgcatatcagcatcctcacctaggtgaatcaacaggctatgattatacacgaacgaaaaatccaacaagaacagcctttgaagaagcttttgcacaacttgaaaaaggcattgcttcatttgctacttccagtggtatggcggcgattcagttaatatgtaatatattcaaaccaggtgatgaaattctcgttgcatttgacctatatggtggaacatttcggttattcgatttttacgaaaaacaatatggtttgaagtttaaatatgtagactttttaaattatgaagaagtggaaaaaaacatcactccacaaactagagcattatttattgaaccaatctcaaatccacaaatgattgaaattgatgtagaaccatattatatccttagcaaaaaacatcaactattaacaattatcgacaacacttttttaacaccttatctttcgacaccactcgaagaaggtgcagatatcgttctgcattcagcaacaaaatatattggcggacataacgatgtgttagctggagttgtaactgttaaggatgctcaattagctgaacaattgaatcaattccataatatgattggagcaactctatcacctcttgatagttatcttttacaaagaggtctaaagacattacatcttcgcatagagcgttcccaagaaaatgctcaaaaacttgcacaacgatgtcgccagtcagattcaattgatgaagttttatatagtggacgaacaggcatgcttagtttaagactgaaccaagcatatagcgtcgctaaatttttagaaaatttagaaatttgtatatttgcagaaagcttaggtggtacagaaacatttatcaccttcccttatacacaaacacacgttgatatgccagatgaggaaaaagacaaacgtggcattgatgaatatctcatcagattgtccgtaggtatagaagattataacgatatagaagctgacataattcaagcattagagaattctaaagtaggagtgatttcatga

SEQ ID NO: 2957 - DNA, 510 bp, Staphylococcus epidermidis
aataaaaaagcactaactacaattgcgataattataatttttggcatattagcacctgttgtttttttgttacaacaaatatcaagaagtagaattagaaaaaataaattacaggctaagcaaaaagaaaataatggaagtaactctcaaattattagtgaaacatctaataatatgaatccagagaatgaaagttcaagtaataatcaagaaaaaacacaaactacaacccacgaagctacaatgaatcaacaaaaggtaactagagataacatatttgattatgctattgctgctataaataaagtaggaaatgcagatttattaaaatttcaacaacctgaacacaatggttcagaatggacaattaatgcaaataataaatcaggtactggggctaacaccatcgtagttaaagatgatgaaacagttcaaatatggatggacctaaaacatctatggatcatgaaactaaacaatcagattggcgaacggttgctagttgtttag

SEQ ID NO: 2958 - DNA, 216 bp, Staphylococcus epidermidis
gaagctcttttcatagaaaaaaaacacctccgtatgattcattttaatatgaattcaacgaaagtgtttttatataattcccactattggggtcagtctaaaattaaaattgataacttttttaataaaatagatacactaattttaaaacaaggtaaaaaaatagaattattaaaacaacgcaaacaaggcttactacaaaaaatgtttgtgtaa

SEQ ID NO: 2959 - DNA, 693 bp, Staphylococcus epidermidis
caaaaaggagccttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgcaccaattttatatcgaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctggctgtcattgtacatcgaaatatctgaataacctcattgagcaagatcaccgtcatattaaagtaagaaagacaaggtatcaaagtatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 2960 - DNA, 693 bp, Staphylococcus epidermidis
caaaaaggagccttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgcaccaattttatatcgaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctgactgtcattgtacatcgaaatatctgaataacctcattgagcaagatcaccgtcatattaaagtaagaaagacaaggtatcaaagtatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 2961 - DNA, 306 bp, Staphylococcus epidermidis
acgttacaggcaataaaagaagatatgcacctcatcctttttgacggtaccattacccttgaaggtgaacatgctgtccgtattgatgaacacaaaattcggggggatcgtatggtcgtaccatttgatacgtttaaacaaataggaaaacctagaaaccaaaacgacatccattttaaaaacgatccttttcaaagagttacgaatgatttatggatcacgaatccctcattgtcagaagtggatcaagaacaaatatggcagactggagactatttttcaaaacaccttcagaacattgaataa

SEQ ID NO: 2962 - DNA, 144 bp, Staphylococcus epidermidis
ctacacgaggcttatattgaaattgctaaagaacatcccacgatgattttttatcgggaaaggaatgggatttgcagattagaagaagcagaaggattgtgcaagcacaatcccaaaatcccgttattctttataaataaataa

SEQ ID NO: 2963 - DNA, 129 bp, Staphylococcus epidermidis
aaattaaatttttatgcaggccaatcgatttctttatcgattaataaaaatggttatattaataacagttttgatgcttcgcgagatgtcattagaaacatcgaagtaagcatcttagactataaataa

SEQ ID NO: 2964 - DNA, 129 bp, Staphylococcus epidermidis
gcatttttttatgcttttttacatacaacattgtaccttcactttactaatctttctgattcacattacctactttatttaacatgcaatgaaaacttaatattcctatacatgcttatatttctataa

SEQ ID NO: 2965 - DNA, 765 bp, Staphylococcus epidermidis
agatatctttattatggaggaggaagacttttgaaaataaaaaggtatgcacttctatgtttattaggaggattagttggaggcatcatcggatacatcataggagctattaactgggagaagttatttaattatgcacagttcgctaactttaaagttgtgctttatacaaccatcgtagcatcattaataaatgttatacttactgtgtatttatttatagtccaaaacgcgtcacttcactataaagctaaaattgacgcaaatatttcagatgatttagcagatacatatgaaaataaatcatacatcaaatcattgaaagtaagatttatttacacaatgcaattaattgtcgcttttattgcaattttaatacccgtcataggaaattcatctgagaatcacattgctctaataatgattcctttctttattacaatcatttcatccataatgattgggatattttatagaaaatttgatgctcgataccctaaattaggagagaaacattacactgaaaaagcatttaatattatggacgaaggagagcgatacatcacactcgtttccttgtataaagtgcaccagcagaatattgtattactttttataggaattatgatgttgggaatattctcaataactacaggcatgaatcaatcgctaggcataattttgtttatcattttatttatctataattcattgggatatttactgaaagtcagtaatttttataaatcagaacagaaatcctaa

SEQ ID NO: 2966 - DNA, 201 bp, Staphylococcus epidermidis
ttaacatttcttcctttgtgctttaaattacttatttccgcaataaaagtgaaagcaactggactatccattccaatagcaaaccccattatacaacgacatattattagaataattacatttggtgcgagtgccgcaccaagagaggttacagtaagtgttagtaaggcaattgataaaatacgcttgcgtccaaactga

SEQ ID NO: 2967 - DNA, 162 bp, Staphylococcus epidermidis
caaacctcttatctgcaattttacttagaactgcttttaacaaacctcttatctgcaattttacttagaattgcttttactattcctcttattagtataatctcagtaagaatgcgtataaaaatgaaaattacaaccgattttgtaagtgctgacgcctga

SEQ ID NO: 2968 - DNA, 342 bp, Staphylococcus epidermidis
gagataacttacattatgattagtaaacaaataaaggatttacgaaagcaacataattatactcaagaagagctagctgaaaaattaaatacttcaagacaaacaatttctaaatgggaacaaggtatttcagaaccagacttaattatgcttatgcaattgtcacaattattttctgttagtacagactatctcattacaggaagtgacaatattattaaaaaagataataaaagctattatgaaatgaatttttgggcatttatgtctgaaaaatggtgggtaattattattatagtaatcataatttgtggaacaataggacaaattttttcaaactaa

SEQ ID NO: 2969 - DNA, 474 bp, Staphylococcus epidermidis
aaagctaattacaaatggcgtattgatgagacgtacatcaaaataaaaggaaaatggagctatttatatcgtgccattgatgcagagggatatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctgactgttattgtacatcgaaatatctgaataacctcattgagcaagatcactgtcatattaaaataagaaagacaaggtatcaaaatatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 2970 - DNA, 1203 bp, Staphylococcus epidermidis
aaggataattatatgaaaaaacatgcatataaacaacttttattaggtatgatagcaatgttaatcgttatgtctatcagtaggtttgcttatacacctatattaccatttatgcaacaagatacatctatggacaatcaagaagcggggtttttagctacatggaattatttagggtatttagttggcgctgttattccaatattttatatttataaaactaaagtaatagatttgaaaatttaccttgctttaaatattatttctactatcttaatgggatttacagaacaatatttaatttggtcaatttttcgattgatttccgggataacaagcgggacggtatttgtattaacttcaaacatagtactagattcattaaagaaaatacaaagagaggggatatcaggtgtattatatagtgctgttggattaggtatttttttaagtagtatttatctttatttttttgccagtgtggattcatggaaaatggtttggtttgttttaggaatagtttcactggttttgggcttaattgtattggtttttatgaaagaaaatacaaatacaataataaattttaaagaagaaaaaatgaaaattaataatagactaaacaaaaagtttgttatctttttttctattgcttacttctttgaaggggcaggttatattattactggtacttttctagttgctatagttaaatcaattccttctgttgctgaatatgcgactttaagctggatgtttgttggattaggtgcaattccttctacattaatttggtcacttatagctgaaaaaatcagttataaaaaagccatttatggtgcatttattttacaaattataagcgtttgtctacctgtttttactcatgaaatttttagtttagttattagttcagttctatttggagggacttttttaggtttaactacattatttatttctaaagggcaaagtttaatgtacaaaacagatgaccccttaaatttagtctcattactgactgtaatatacagtttaggacaaatgttagctcctatgtttgcgggaatcttaattggtaaatcgaataattataacattgctttaatatttgcaactgttttattaatactgggtcttatttctacaatatttagctataaacaaaacgaaagtattggtgaaaaatatgaacttaaatga

SEQ ID NO: 2971 - DNA, 567 bp, Staphylococcus epidermidis
ttcaattgttatactaagagggaattgtgtgaacaagtgtataacttgtggataactcgaataaatcatgtacttttggaggataaaatgaagattactatcttatcagtcggaaaactaaaagaaaaatattggaagcaagccattgcagaatatgaaaaaagattaggaccttacacgaaaatcgaattaatagaagtaccagatgaaaaagcacctgaaaatatgagcgacaaagaaatcgaacaagtcaaagaaaaagaaggccaacgcctactcaataagattaaaccccaatctacagtaattacgttggaaatcaaagggaaaatgttgtcttcagaaggactcgctaaagagctacaaacacgcatgacacaaggtcaaagcgactttacatttgtcataggtggctccaatggtttacatcaagacgtcttacaacgcagcaattacgctctatcattcagcactatgaccttcccgcaccaaatgatgcgcgtcatattgatagaacaaatttatcgctcatttaagataatgagaggcgaagcatatcataaatga

SEQ ID NO: 2972 - DNA, 129 bp, Staphylococcus epidermidis
ttcttaagttatataaaatatgtaaatttatgtgccacatcttctattcatgatgaaagtatctacgttgacatcaagatgtcattttatcaattagtatacctatggggttatactttgaagttgtag

SEQ ID NO: 2973 - DNA, 156 bp, Staphylococcus epidermidis
accccaagctatacttattactatcgtaatgttagctgtcgcttttttattgataatgatacaaaattacattttcttaaaaaaacacagcattttagctttgatgaaagacaattataccccggaagctacccaaaaacggataactacgtttga

SEQ ID NO: 2974 - DNA, 174 bp, Staphylococcus epidermidis
ctttatctatatcataaattgcgatatctatatttttcatttgttccccttattaaattaatattttatttaataattcctgttttcgcgcctttatttttttattttattagtttattagtttgtctggaattgtgtcaagaaatcggacaaaaatccatgtataatgaatga

SEQ ID NO: 2975 - DNA, 168 bp, Staphylococcus epidermidis
acaattgtatatataatcattactatgaatataggtgacattgagacatttcctagaagtttcataaatgcaagtgctgcaaataatgcatgtaataaagcaatgagaagcggtaatccaaaattaaatgcaatttttaatagtaaacctttagacatatcagtgtag

SEQ ID NO: 2976 - DNA, 1200 bp, Staphylococcus epidermidis
ggagatgaatatgacatgtcacgcatagtattagctgaagcatatcgaacacctataggcgtgtttggtggtgtatttaaggatatacctgcctatgaactaggtgcaacagttattcgtcaaattttagaacatagtcaaatagatcctaatgaaatcaatgaagttattctaggaaacgtattacaggcaggtcaaggacaaaatcctgctcgtattgctgcgattcatggtggtgtgccagaagcggtaccttcttttactgtaaataaagtttgcggttctggattaaaagcgattcaacttgcctatcaatctattgtagcgggagataatgagattgttatcgctggaggcatggaaagtatgtctcaatctccaatgcttcttaaaaatagtcgtttcggttttaaaatgggaaatcaaactttagaagatagtatgatagctgatggtttaactgataagtttaatgattaccatatgggtatcacagccgaaaatctagttgaacagtatcagattagtcgtaaagaacaagatcaatttgcattcgattctcaacaaaaagcatcacgtgcacaacaagctggtgtatttgatgctgaaattgtacctgtagaggtaccacaacgtaaaggcgaccccctaattatttctcaagatgaaggcattagacctcaaacgacaattgataagttagcacaactccgtccagcatttaaaaaagatggatcagtaactgctggtaatgcatccggtatcaatgacggtgctgctgctatgctcgttatgacggaggacaaagcgaaagcattgggcttacaacctatagctgtattagatagttttggtgcgagtggtgtggcgccttcaattatgggtattggtccagttgaagcgatacataaagctttaaaacgttctaataaagtgataaatgatgttgatatttttgaattaaacgaagcttttgcagcgcaatcaattgctgtaaaccgtgagttgcaattaccgcaagataaagtcaatgttaatggtggtgcgattgcactaggacatccgataggggcttcgggtgcgcgtactttagtttcattattacatcaattaagtgatgctaagccaacaggtgtggcatctttatgtatcggtggcggtcaaggtatcgctacggttgtatctaaatatgaagtttaa

SEQ ID NO: 2977 - DNA, 252 bp, Staphylococcus epidermidis
gttcaagaatatgccccgattttatatcaaatttggaagaaaaagcataaaaaagcttattacaaatggcgtattgatgagacgtacatcaaaataaaaggaaaatggaactatttatatcgtgccattgatgcagagggacatacattagatatttggttgcgtaagcaacgagataatcattcagcatatgtatttatcaaacgtctcattaaacaatttggtaaacctcaaaaggtaattacagattag

SEQ ID NO: 2978 - DNA, 348 bp, Staphylococcus epidermidis
gagaaaagatatagaattggatattttaaaaaagtacaaggcattggagaggaagtggtaccaacagtagtcgtagatttagtggatcaattaaaagtaaaatattcaatcaaattgatactagaagtattaaacatacctaaatcaacatattaccgatggaaaaacaaaacccataaaaatgataccgtaacacaaaaagttattgaattatgtaaagctaaccactatacctacggttatcgtaagattacagcattgattaatcaatgttatacatcaccaattaatcataagagagtacagagaatgatgcagaagcatcatttgaactgccgagttacctaa

SEQ ID NO: 2979 - DNA, 906 bp, Staphylococcus epidermidis
gagaaaagatatagaattggatattttaaaaaagtacaaggtattggaaaggaagtggtaccaacagtagtcatagatttagtggatcaattaaaagtaaaatattcaatcaaattgctactaaaagtattaaacatacctaaatcaacatattaccgatggaaaaacaaaacccataaaaatgataccgtaacacaaaaagttattgaattatgtaaagctaaccactatacctacggttatcgtaagattacagcattgattaatcaatgttatacatcaccaattaatcataagagagtacagagaatgatgcagaagcatcatttgaactgccgagttagacctaaaaagatgacaaaaataggtaaaccgtattataaaacggacaatttattacaaagacaatttaaagcgagttgtccaatggaagtattaacaaccgatattacttatttaccatttggtcattctatgttgtatttatcttcgataatggatatttataacggagaaattgtggcgtataaaatagatgataaacaagaccaaagtttagttaatgatacattaaatcaaatcgatatacctgagggttgtatattacatagtgatcaaggcagcgtttatacatcttatgcttattatcaattgtgcgaagaaaaaggcattatcagaagtatgtcccgaaagggaacacctgccgataacgccccgatagaaagtttccattcctcgctaaagtctgaaactttttacatcaataatgagcttaatcactctaatcacattgtaatagatattgtcgaaaagtacattaaaaacaataataataataataataatcgaattcaacaaaaactaggctacttatcccctgtaaaatacagagaattaatagcctag

SEQ ID NO: 2980 - DNA, 1692 bp, Staphylococcus epidermidis
aaggagcggtatgatatgaagggtaaaattgcactttattcacgtgttagtacgtctgagcagtcagaacatggttattctgtaaaggagcaggaacaagtactcatcaaagaagttgtgaaaaatttcccgggttatgactatgagacatatactgactcaggcatttcaggtaaaaatattgaagatcgaccagcaatgaaacgtctattacaagatgttaaggataataaaatcgaaatggtgttaagttggaaattgaatcgtatctcacgatcaatgagagacgtgtttaatattattcatgaattcaaagaacatgacgtagggtataaatcgatttctgagaatattgatacatccaatgcttctggagaagtactcgttacaatgtttgggttaataggatctatagaacgccagactttgatttcgaatgtgaaactttctatgaatgctaaggcaaggagcggagaggcaatcaccggtcgtgttttaggctacaaattatcacttaatccattgacacagaaaaatgatttagttattgatgaaaatgaagctcatattgtacgtgaaattttcgatttatatttgaatcataataaaggcctcaaagccattacaaccgtacttaatcaaaaggggtatcgtactattaatcaaaagccattttcagtgtatggtgttaaatacattttgaataatccagtctataaaggctatgtcagattcaataaccatcaaaattgggctgttcagcgaagaagtggtaaaagtgataaaaatgatgtgatattggtcaaaggtaagcatgaagccattataagtgaagatgtatttgatcaagttcatgagaaactagcttctaaaagttttaaaccgggtagacctattggtggagatttctacttacgtggccttattaaatgcccagaatgcggaaataatatggtatgtcgacggacgtattataaaacgaaaaagtccaaagaacggacaatcaagcggtattacatttgttccttattcaatcgttcagggagttctgcatgtcacagtaattccatcaatgctgaagtcgtcgagcgtgtaattaatgttcatttgaatcgtattctgtctcaaccagatattatcaagcagattgcgtcaaatgtgatcgaagaactgaaacaaaagcatagtaaccaaacagaaattaaatatgacattgatagtttagaaaaacaaaaagctaagcttaaaagacaacaagaacgattgttagaattgttcttagatgatcaaatggatagcggaatgttaaaagctaaacaaagtgaaatgaatcaacagttggaagtattagaccaacaaattaaagaagcaaaacaagcaaatcaatcacaggatgaaatacctaattttgataaattaaaaggacgactcattttgatgataacacgattcagcgtgtacttaagaaaggctacacccgaagctaaaaatcaactcatgaaaatgttaattgattcaattgaaattacgacagataaacaagtaaaacttgtaaggtataaaattgacgaaagtcttatccctcaatctttgaaaaaagattgggggtctttttttatgcccaaatttcaatttgaaatatatggtcaaaatgattatttcatcgaccaaattaccacttttaccacttag

SEQ ID NO: 2981 - DNA, 189 bp, Staphylococcus epidermidis
ggtgcatatcttcttttattgcctgtaacgttcacggcatacccgaatcgcgctcaatcaattcttgaaaagttcttaaaaagtcctttaatctgttatccacgttctgttcatccgcaagtgccgtccttatgccgtatgaagtcaaatgaaaggcaagagaaacctccggcaccccggcaccaataa

SEQ ID NO: 2982 - DNA, 870 bp, Staphylococcus epidermidis
tgtaagtatctctcaaatattttgggaggttttattatgaaaatcaaaaaattattaaagacattattaattattttattatgttttgtattgtctgttattgtgcaaaatatttcaatgctatggcatattgtgagcatttggagtgttgaatatattttacatgcattaacttatatagtactttcatacttttcagtaaaatggttcattgaaattgtgcttaaaagcaatatgaaagattatagaataataccggtgaaatttttcaagtcttgttttcttataggattaattttgatattagtaattgatttaatatatctattatttattcctggtaaattgataatacctcattattcaacaagcgttggatttatggagatgttctttagcgcatttttaattactggtattgctgcgcctatatttgaagagatggtatttcgaggaatactaatgagatactttgaaaaacaatatggaattttatttggaattataataccctcgattttattttctcttgttcatctatttaatggagagttaaagggagaaaatttattattactacttataggtggctcaattgctggaataatgtatgcagtgactgcatggacgtttaatagtatatgggcctctgctatattacatatgctttggaatataaatggtttattaaatatcacaactcaagatgatcattggggagtatatcagtacatattagaaacaaaaaatgtactgattacaggtggggattatggtatggatacatcattactttcaatatgtagttatattgcagttattatagttatgattgttactaaaagacactttaactttttactaaagtaa

SEQ ID NO: 2983 - DNA, 138 bp, Staphylococcus epidermidis
ttcatccatcttgagtccttttcacgtttgaagttatccgtaataggagatattaaaaaaatgatagcaagaaagctgttcatcgttggatttaaaaatgagaaaacgactgcagcaataattccgactactaaatag

SEQ ID NO: 2984 - DNA, 2073 bp, Staphylococcus epidermidis
gggaaaaatcttatagaggtgatttctttgacaaataataatagaataaaaagatttagcattagaaagtacgcagtgggagtagtatcaattattacaggtgtaacaattttcatcggagggcaacaagctcaagcagctgaaacttcagtgcaacatgcggatgcacacccagaagactcgcaaacaacacaacaattaaaaaatgataaggtagaagaaacgttaaaagcttcaaaacaaggtaatgctgatagtcaacaagtacaaacaattgatcaatctaaaacaaatcaaaacaaccaacattctgtagctgaaagtgcacaactgaaaagtgatgagacagctaatcagccaaaaaaagaagaaagtagctcagtaaaacaagacgtccaaccgtctaaaaatgtaaatcaacaagacgcagctactcaatcaaatgagagagaaaataatgacataaaaggtgaaggtcaaacttcaaagacgagcaatcaacatattcagagttctaacagtcataatcaatcaacaggaacaaaagacagcgactcagaagaaatcgaccaaccattagtgaaattacaaaagccgtctaatgattctacatatcaaacacaatcaaaaacaaaacaagatagttctaaacaactccctcaagaaaaaacaacaaaacgtcaaattcaaacaactgaaaatgaacagacaactaaagttgattctaaaaaagctaatgacactcaaaatgttgaaaaacatactcaagagcctaaaaatgatacatcaacatcacaaaaaaatcatcatcaagtagctacaaaagaacaatctaatagaagtacaacaaggaagacgcaaaagcaatcatcaaatgctaatcaaaatcatcagtttacacatcaagcacagttcaaaaaccaatatccagtagtatttgtccatggtttcctaggctttgcaggtgataatcaatttagtttagctccaaaatattggggtggtacaaaatacaatattgacagaaatttaactaatgagggttacaatgtacatgaagcaaatattggtgcttttagtagtaactatgatcgcgcagtagaattgtattactatgtcaaaggaggacgtgttgattacggtgcagcgcatgcagctaaatatggtcatcatcgctatggtcgaacatacaagggcatcatgcgtgattgggaacctggcaaaaaaattcattttataggtcacagtatgggtggtcaaaccattcgtcaaatggaagaattcttaagaaatggtaaccaagaagaaatagaatatcaacgtcaacatgggggcactatatccgatttatttacaggtggtaaagataatatggttgcttcaattactacacttggcacaccacataatggtacacctgctgcagataaaattggcacacgtaaacttgtaaaagaaacgattaatcgtattggtagattaagtggtggtaaagatgtagatatagatttaggtttttctcaatggggattaaaacaacaaccaaatgaaagttacattgattacgcggaacgtgtatccaaaagtaagatttggaatactgaagatcaagctgttaatgatctgacaacgcaaggtgctgaaaaaattaatcaacaaacaagtctaaatcctaatattgtctacactacttatacagggtcagcgactcacacaggacctcttggtaatgaattacctaattctagtgaaattcttttattgaacttaaccagtcgtattattggtaaagatgtaaacaaagaaattagaccgaatgatggtgtagttccagttatatcatcacaacatccttctaatcaagcctttaaaaaagttgatgatcatacaccagctactgataaaggtgtttggcaagtgagacccgttcaacatgattgggaccatttagatttagtaggtatggatgcatttgatttaacacatacaggtagagaattaggtcaattctatctaggtattatggataatatcatgagaatcgaagaagcagacggtattacaaataaataa

SEQ ID NO: 2985 - DNA, 897 bp, Staphylococcus epidermidis
ttgatacttcattttagttataataacatcaaaattatatttcatataattgcacttaatattaaattcattataaaggagtcgtttatgttaaagaaattttcttactcaatcatttcactttcaattttcgctactagccttaattttatagatactcaagcacaagcgtcttcatcttctgtaagcgaaaaaggtacaatggggtatggctatcaacaatacttaaaagaccatcctaaaaagcaaactcataaaacacaaaatcgttctactttctctgctgaatctaatattactgaaacaaataatggtgaaagagtcttagatatttctgaatggcaaggacttttaactaatgaacaaataaaacaactaaagaaaaattatgattttattattttaagagcacagtacggttcagaatacgttgataagacttttgaaaaaaatgcagaattattagaacaaaataaaatgaaatacggcgtgtactcttatagcatgtacgaaagtccaaaagatgcacgttatgaagctaaaactttatctcaacgtgctcccaaagccgccttttacattaatgattatgaagaacaaaccgttaaatccggagatgatgaaacagcgacacaagcatgggcaaacgaaatgagaaagcttgctggaaacaagaagatccttttttattcatatgaaaatttcatgttaaatcatgcatcaaatgctgtcagttcatatgatggctactggttagcagcatatcaagctgaggaaccaaaacgagagaaagtgctatggcaatatacagatagttactactctcctgaattaaatcaaaatgtcgatgcaaattatattgacgaaaatgtgaattcgtcttggttcacttcataa

SEQ ID NO: 2986 - DNA, 354 bp, Staphylococcus epidermidis
gttttaattcaaatattaaagaacgtgttaagtatattgcactttatgattcaatgcctaaacctaatcgaaacaagcgtattgttgcgtatattgtatgtagtatatcgagcttcacatgaaacagctaaagaagctttgggcgataaagagttaagagccattgcacatgagttaactaaaacagttaaggataacatgagtgttgattggtctaaacgagacagtgctaaagctaaaatgagagttcaagttagacgcctattaaagaaatatggctatccaccagatcttcaaaaaatggctgtggaacaagttgtagagcaagcagaattaatggcaagtcagcaataa

SEQ ID NO: 2987 - DNA, 129 bp, Staphylococcus epidermidis
aaagatgttcacaagaataaaaacgaaaatgaaaagtgtcttcgtaagtttccagttcatttattcaagcctcccatctttataggcataccaattgccatcgtattctacaaaccaacgtggtattaa

SEQ ID NO: 2988 - DNA, 273 bp, Staphylococcus epidermidis
ttagtctatcaaaataaaggggttgggactgttatgagtgataatttgtcattattcattgactatatcaatgataatataatctatggtagtgaaatcaaacgggagaaattagagaatttatttaatcaatttgctataaaaaatgttgaaaagaacattgtctatgatgaactgaaatctttagatattacaatcattgagtcacaggattcatataaaaataaattgaagagattattttcggttctgttgcaaagtaaaaaaatatag

SEQ ID NO: 2989 - DNA, 1017 bp, Staphylococcus epidermidis
tcacaccatcaaatgaaacgaggtgtaacaatattgaattggcaacgtaaatgtatactaactactttattggttttaagtagtttatttttagtattttcgactatcacatatgcgagtgaacgtgattctaaagacagtcttaaaatcactacacataacgtgtatttcttacctactgctatctaccctaattggggacaatctcagcgcgctgatttaatttcaaaagcagattacattcaaaatcaagatgtcgtgattctaaatgaattatttgataaaaaagcttcaaatagattgttaacacgtctacattcacagtacccttatcaaacacctatcgttggtaaaggtacagaaggttggcaaaatacttctggtacttatagaaaaattaaaaaagtaagtggtggcgttggtattgtgagtaaatggcctatcgtacaacaagaacaacacatttataaaaaaggctgtggggctgatatggcaggtaataaaggctttgcctacattaaaattaataagaatggcaaataccaccatattatcggaacacatctacaagctgaagatccaacatgctttaaaggaaaagataaagacattagacagagtcaaatgaatgaaattaaacagtttatcaaagacaagaatatccctaaaaatgaacccgtctatatcgggggtgacttaaatgtcattaaagattcagatgaatatcaacaaatggcaaataacttaaatgtttcattacctactcaattcgatggtaatgcatatagttgggatactagcagtaatagtattgcgaaatataattatcctaaattagaacctcaacacttagattatattttattagatcgtgaccatgcacaaccaagctcatggcataatgatacacatagagtgaagtcaccagaatggtccgtaaaatcttggggaaaaacatacaaatacaatgattactcagatcattacccactctctggctatgcatcaaatgaatag

SEQ ID NO: 2990 - DNA, 171 bp, Staphylococcus epidermidis
atctgtcgtcatttttccatcaccacccctaacaatgcagcaacaattgcggctattaaaattgctacgtatgaaggtagaattgaacttagaagaagcatcatcacaatcacacatacaatgagtacaatatatattctcaatcgtgatttcttaatcccttcaaattga

SEQ ID NO: 2991 - DNA, 180 bp, Staphylococcus epidermidis
ccgcttgaccaaggagccgttcttaagcacaagatagattatagcatagctctacttttgatgacaagatattttttacataaatttaataatatttttgtttcgttaatcaaccaacacaaacatgctatgaagcttactgtggagaagaataaaaccattgatttcattcaaaactaa

SEQ ID NO: 2992 - DNA, 1470 bp, Staphylococcus epidermidis
ttaatacgtctgtcttttattaaaaatataattgaaggagagagtatggaaatggaattcaatgagaacaatatcgacttagagacgattatcagagatgaagttaataaatatttatctagagatattggagacttacctgcgacacaacaggcaccgctcgagttgagagagaaatatgaaaagatggaagtgccgaataaagggcgagatatctatgaagtactcaaagatttaaataatgaagtgctgaattatttatatcgtccgaaccatccacgttcattctcatttataccaggtccagcatcacgtctatcatggcttggagacattttaacaacagcaaataatatccatgcctctaattttgccaatgcgacgctgccaattaatattgagcgtaatttaattaactacttggtaggaaaaatcggttatgagatcaaaccggccggtggtgtctttgtatctggcggttcaatggccaatttaacagctatcgttgcggctagagatgcacaggtagaaatggaagatattaaaaaagcaaccgtttatcttacatctcaaacgcatcattctgtaggcaaagccttgcatgttgcaggcttccttaaaaataatatccgcagaattgagtacaacgatgactttacaatgaatacagatagcttaaaagccgcaattgataaagatattgaagaaggttacaaacctgctatggtgattgcgactgcaggcacgactaatacaggttctgtcgatgatttcaccacacttggagatatttgtgatcactacaatctatggctccatgtagacggtgcttatggactatcacatatcttatccgataaagcacaacacttatttaaaggcattgaacgttcagatagtgccagttgggatgctcacaaattactgttccaaacatatagttgcgctatggtaatcgtgaaagaaaagaatcatctgctgcaaagctttggcgaagatgctgagtacttggatgatattgcttcagatgatgatgtgattgatccagaaatgttaggcattgaacttacacgccctgcacgtgctttaaaattatggattactctgcaagtcattggtgaagatgaaattatcgagcgcattaaatacggcgaaggtttagcagaatatgcagaagaatacgtgtcaagtctcgataactggcgtattatctcacacgctaatctttccattgtgaacttcagatatgaaaacagtgatttaactgaagcacaaaataatcaactcaatagcatggctgcgcaaaaaattgcagattctggttatgccattgcttataccacagtattgaataaccaacgtgtcattcgtttatgtacaacgaatccattaacgacacatgatgatatcagagaaacaataaatcgccttgatcagtatattggtgattacgatatgaaagatgcttaa

SEQ ID NO: 2993 - DNA, 1845 bp, Staphylococcus epidermidis
agggagcgtcttatgaagtggcttaaacaactacaatcccttcacacgaaactcgttattgtttatgtactactcattattattggtatgcaaatcatcggtttgtattttacgaatagtttagaaaaggaattactcgataacttcaagaagaacataacacaatatgcgaagcaattagacgtcaatattgaaaaggtttataaggataaagataaaggttcagtcaacgctcaaaaggatatccaagaccttttgaatgaatatgcgaatcgtcaagaaataggagaaatacgctttattgataaagaccaaatcatcatggcaacaaccaagcagtctaaccgtggtcttatcaatcaaaaggttaacgacgggtcagttcaaaaggcgctctccttagggcaaacgaatgatcatatggttcttaaggattacggaagtggtaaagagcgtgtttgggtatacaatataccggttaaagtcgataaacagacaatcggtgatatatacatagaatcgaaaattaatgatgtatacaatcagctgaacaacattaatcagatattcatcgtagggacagcgatatcactattcattacagtgatactaggattcttcattgcacgaacgattactaagccgataaccgatatgcgtaaccaaaccgtcgagatgtctaaaggtaactacacgcaacgagtgaagatatacggtaacgatgaaatcggtgagctcgcacttgccttcaataacttatcgaaacgtgtccaagaagcacaagcgaatacagaaagtgagaaacgtcgtctagattccgttatcacgcatatgagcgatggtattcttgcgacagatcgccgtggacgtgtacgtattgcaaacgacatggcgctgaaaatgctcggtctcgcgaaagaagatgtcatcggctactacatgcttggtgtccttaacttagaaaatgaattctcattagaggaaattcaagaaaatagtgattccttcttgttagatattaacgaagaagaaggcattattgcacgcgtaaactttagtacgattgtacaagaaacaggtttcgtgacaggttacattgccgtattacatgatgtcactgaacaacaacaagtcgaacgtgaacgtcgcgaattcgttgcgaatgtttcacacgaattacgtacaccgctgacatctatgaatagttatatcgaagcacttgaagaaggtgcttggcaagataaagaattggcaccatcattcctatctgtcacacgcgaagagactgaacgtatgattcgtttagtgaatgatttacttcaattatctaaaatggataatgaatcagatcaaattacgaaagaaattatcgacttcaatatgtttatcaacaaaattattaaccgtcatgaaatggcagcgaaagatacgacattcgtgcgcgaaattccgcaacaaaccatctttgctgaaatcgatccagacaagatgacacaagtatttgataatgtcattaccaatgcaatgaaatattcacgtggcgagaaacgtgttgagtttcatgtgaaacaaaatgcactttacaatagaatgacgattcgtattaaagataatggtattggaataccgattaacaaggtagataaaatatttgatagattctatcgtgtagataaagcacgtacacgtaagatgggtggtacaggacttggtctagctatttccaaagagattgtcgaagcacataacggtcgaatttgggctaacagtgtagaaggacaaggtacgtcaatctttattacgcttccttgcgaaatcattgaagacggtgattgggatgaataa

SEQ ID NO: 2994 - DNA, 135 bp, Staphylococcus epidermidis
acgttgttacagaaggccgaccgaaccgaggccatttcatctggtgtaacaatcgagacaacggctgttgaaggctcgacgcttacaacgcggtccggttccaccgtcaaccgtacggacttaccggtgccgtga

SEQ ID NO: 2995 - DNA, 141 bp, Staphylococcus epidermidis
atgtcgctacacttacgcctgagggtgtggttctgtattctggatctttcgttagacgacctactaatacaactcgatttaacatttaaacgcccccatgtaaattattacttatcttggtcttcacgaataacgatgtaa

SEQ ID NO: 2996 - DNA, 321 bp, Staphylococcus epidermidis
aaaagaacacattttgaaatcaatgtgtctttgaaaatagttactttctattattttttaatttctatcggttctcctaattcattttctataatttgtgaaatttcttttcctaatggtcctttgattacaagtgtacgtcttgcaactgaggtaagtattccaaatactgctccaatggctaatatacttccacctgaagtcaaagcaattagccatcctaacgcaactttccctatttgtttaaaaggttttttatcaaatatcactgttagaccaatgatattaggtgtttttgtctctccaataataattaaataa

SEQ ID NO: 2997 - DNA, 126 bp, Staphylococcus epidermidis
aacttagaacagttagaaacagaattatttgattatgtaaattggtacaacaattttagaccacattcttcgttacagtatttaacgccaatggcgtataaagatatacacatgaaaagtgtctaa

SEQ ID NO: 2998 - DNA, 231 bp, Staphylococcus epidermidis
gaattaagacatatattatatatgaatgaattaattttattattaggagattccattacaacaaattctgatgaagcaacatttaattttttattatctattacaggtaaccaaatccttttagtatcaggattcatttttgaaaataatacgcaattgttattaataatccatttattactttttattttattgacttcttcctctatagcttgttcttcattatcataa

SEQ ID NO: 2999 - DNA, 168 bp, Staphylococcus epidermidis
ttggaactgcaacatcagtcgaagaagcagttgaaaatggaaaatgctggtatggatatagttgtagcccagggctatgaagcaggtggccacagaggatcatttacaacaatcaatggtgaatttccattggtcggtactttatctttagttaccacaaattgttga

SEQ ID NO: 3000 - DNA, 135 bp, Staphylococcus epidermidis
aagatgtggcacataaatttacatattttatataacttaagaactaaaagacatatagagattgaagaattaactactcaacttaacaagaaaaatggcacgcataacaaacctcttcaaatttgggaatggtaa

SEQ ID NO: 3001 - DNA, 1407 bp, Staphylococcus epidermidis
atagggtggcaacgcgtagaccacgtcccttgtctgggatgtggtctttttttattgttttatcacacgaagtcatccataaaattgaatatattttatttgggaaaggatgaaggttacatgttagacattcgtttatttagaaatgaacctgagaaagtgaagagcaaaattgaattaagaggcgacgatcctaaagttgtcgaccaagttttagaattagatgaacaacgccgtgaattaatcagtaaaactgaagagatgaaggcgaaaagaaataaagtgagcgaagaaatagctcaaaagaaacgtaataaagaagacgctgatgacgtcattgctgagatgcgtcatttaggtgatgaaattaaagatatcgataatcaacttaatgaagtagataataaaattagagatatcttaattcgtattcctaacttaattaatgaagatgtacctcaaggtgattctgacgaagaaaacgttgaagttaaaaaatggggtacgccacgtgattttgaatttgaacctaaagcgcactgggatttagttgaagaattaaaaatggctgactttgaacgtgctgctaaagtatctggtgctcgtttcgtatacttaactaaagatggcgcattacttgaacgtgctttaatgaactacatgttgacaaaacatacaacgcaacatggttatactgaaatgatgacacctcaattagtgaatgctgatacgatgtttggaacaggtcaattacctaaatttgaagaagatttatttaaagttgaaaaagaaggcttatatacgattccaactgcagaagtacctttaacaaacttctatagagatgaaattattcaaccaggtgtactacctgaattatttacagctcaaactgcatgtttccgtagtgaagcaggatcagctggtagagatactagagggttaattcgtttacatcaatttgataaagttgaaatggtacgtattgtacaacctgaagattcttggaatgctttagaagaaatgacacaaaatgctgaagctattcttgaagaattaggtttaccataccgtcgtgttatcttatgtactggcgatattggtttcagtgctagtaaaacatatgatttagaagtttggttaccaagttacaatgattataaagaaatcagttcttgctctaactgtactgatttccaagcacgtcgcgcaaatatcagattcaaacgtgatgctgcttctaaaccagaattagtacacacattaaatggtagtggtttagctgtaggtcgtacatttgcagccatcgttgaaaactatcaaaacgaagatggtacattaacaattcctgaagcattagttccatttatgggtggcaaaactaaaattgaaaaaccaatcaaataa

SEQ ID NO: 3002 - DNA, 714 bp, Staphylococcus epidermidis
gtaatttttaaggggtttatagttatgtatgaagaaaatatttatattaaaaattcagaatatgaatttgataataatcttaaacaattagcatcatacttaaatattcctgttagtattgttagaccttataaagaggatttaacactttatcaatataaaaaaggacaagtcatatatcattcaactgatcaaataaaatttgtatactttttagtaaatggttgtattttacatgaatcttctaatattactggtgacaattatttaagattaagtaaagacgaaaatatatttccaatgaacttcatatttaatgaaacccctgcaccatatgaaatatgtacagctttgacagattgtaaaatattaactttaccgaaagatttacttgagtatttatgtagaaagcataatgaaatatttgaaagtctcttcaagaaacttaatgagactattcaatttcaagtagaatatattatggcgttaagagctaattcagctaaagaaagaattgaaagaatactacaaattttatgcctttcaattggggatgataatggagaattctatgaattaaaacaaattatgactgttcaattaataagtaatttatctggacttaacagaaaaactactggtgaaataatcagagaattaaaaatagaaaatattatatatcaagataaaagaaattggattataaaaaaataa

SEQ ID NO: 3003 - DNA, 255 bp, Staphylococcus epidermidis
ctaccttttaattctttgattaccatcggattcgtgtcatttttggctgattttattctattttctttccagtgcataagttctcccctctactgtttatatattttagatgaaacaactttctcaagttactctatatttcattatttaaatgcaatttttgcgaatgcgttcattcgtaatttctttcttaaattaacaatatctattctcatagaatttgtccaattaagtgtagacgattcatttacttag

SEQ ID NO: 3004 - DNA, 258 bp, Staphylococcus epidermidis
cttcattttaaagggattaatgctatcaatctgtcctcaaattgtagcattcttgaactatattgttgcaatttgattgtaattatttacattttagtttacaaagctatagttcagcattatcgtaagttaactacattttattggagatactatatacttaaccaatttcaaaataagttatatacaacttattttttagttttatttgtgatacgcttctgcgtatcggttaagagtgcggttttttataattaa

SEQ ID NO: 3005 - DNA, 495 bp, Staphylococcus epidermidis
ggagattttaatatggtgaaaaaagataaagacactaatgaccaaaaaagtgagagccatatgaagcataatgatgaaagtaaagttcctgaagatatgacatcgactaatgagggtgaatttaaagtaggagataaagtaacgattacagcagggcatatgccaggtatgaaaggtgcagaagctactgtaaaaggtgcgtataaaacatatgcctatgttgtaagttataaacccacaaatggaaatgaaaaagtaaacaatcataaatgggtcgtaaacgaagaaatcaaagatgcacctaaagatggatttagtaagggcgatactgttaaattagaagcaaatcatatgtctggtatgaaaggtgctacagccattatagataacgtgaaaaagactactgtttacgtagttgattacaaatccaaagataatggtaaaatcattaaaaatcataaatggatgacaggaaatgagctgaaagcacgataa

SEQ ID NO: 3006 - DNA, 144 bp, Staphylococcus epidermidis
ttctatttcctaactacaaatgattgcatcattagtaattatcattgtagtatgctgactaatttatctcctaattttcaattttattatcaaaaaaacaccctaaaactagaatttgcttctaattttagagtgcctcattaa

SEQ ID NO: 3007 - DNA, 1527 bp, Staphylococcus epidermidis
aatatgcttaatgctgatttaaagcaacaattacaacaattacttgagcttatggaaggcgacgttgaattcgttgccagcctaggctctgatgataaatcaaacgaactcaaagaattattaaatgagattgctgagatgtcagcacacataacaataactgaaaaatctttaaaacgtacaccaagtttttcagttaatcgccctggtgaagaaacaggtattacattcgctggcatacctttaggccatgaattcaactctttagtattagctatactacaagtgagtggtcgcgcacctaaagaaaagcaatccattatcgatcaaattaaagggctcgaaggtccatttcatttcgaaacctttgtaagtcttacttgtcaaaagtgtcctgacgtcgttcaagcattaaacctaatgagtgttattaatcctaacattactcatactatgattgatggcgctgttttccgtgaagaatctgaaaacattatggcagttcctgccgtcttcttagatggtcaagaatttggtaatggacgcatgacagttcaagatattttaactaaattaggaagcacgcaagatgcctctgaattcaacgataaagatccttatgacgtgttaatcgttggtggcggacctgcaagtggtagtgctgcaatttatacagcacgtaaagggctacgtacaggtattgtcgctgatcgaattggtggtcaagttaatgatactgctggtatcgagaacttcatcactgttaaagaaacgacaggttcagagttctcatcaaatcttgcagaacatattgcacaatatgatattgatacaatgactggtattcgtgctacaaatatcgaaaaaacagattcagctattcgcgtaactttagaaaatgatgctgttttagaaagtaaaactgtcatcatttccacaggtgcaagttggcgtaaactaaacatcccaggcgaagaccgtctaatcaataaaggcgtggctttctgccctcactgtgacggacctttatttgaaaataaagatgttgctgtcatcggtggtggtaactctggtgtagaagcaactattgatttagccggcatcgttaaacacgtaacattatttgaatacgcttctgaattaaaagctgatagcgtattacaagaacgtttacgctcactacctaatgttgatattaaaacgagtgctaaaacaacagaagtaattggtgacgattacgttacaggtattagctatgaagatatgactaccggagagtcacaagtagttaatttagatggaatatttgtacagattggattagttcctaatacatcttggttgcaaaatgctgtcgaattaaatgaacgtggcgaggttatgattaatcgcgataacgcaacaaacgttcctggtatctttgcagctggtgacgttaccgatcaaaaaaataagcaaattattatttctatgggtgctggtgctaatgccgcacttaatgcattcgattatataattagaaattaa

SEQ ID NO: 3008 - DNA, 132 bp, Staphylococcus epidermidis
aattttattaaaaaaataagtgacttatatatcaacttattaagggagttctatactcccttttttaatgcaattgtttttataaacaatgactttatttatagtctaagatgcttacttcgatgtttctaa

SEQ ID NO: 3009 - DNA, 2709 bp, Staphylococcus epidermidis
actgaacttttgaaggaggatctcttgatggctgaattacctcaatcaagaattaatgaacgaaatataaccagtgaaatgcgtgaatcattcttagactatgctatgagtgttatcgtttctcgtgcattacctgatgttagagacggattaaagccagtacatcgtcgtattctttatggtttaaatgaacaaggtatgacgcccgataaaccttataagaaatctgcacgtatagtcggggatgtcatgggtaaatatcaccctcatggtgattcttcaatttatgaagcaatggtaagaatggcccaagactttagttatcgttatccacttgtagatggtcaaggtaactttggctctatggatggtgacggtgcagctgcaatgcgttataccgaagcacgtatgactaaaataacattagaacttttacgtgatattaacaaagacacaattgattttattgacaactatgatggtaatgaaagagagccgtcagtcttacctgcacgtttccctaatttactagtaaatggtgcggcaggaattgccgtaggtatggctacaaatattcctccccacaatttaactgaagttattgatggtgtgctcagtttaagtaagaatccagacatcacaattaatgagctgatggaagacatacaaggtcctgattttcctacagctggtttagtactagggaaaagtggtattcgtcgagcttatgaaacaggtcgtgggtcaattcaaatgcgttctcgtgctgaaatagaagaacgtggtggtggccgtcaacgtattgtcgtaacggaaatacctttccaagtcaataaagcgcgtatgattgaaaaaatcgcagagttagttagagataagaaaatcgacggtattacagatttacgtgatgaaacaagtttgcgtacaggtgtaagagtagttattgatgtacgtaaagatgcaaatgcgagtgttattttaaataatttatataaacaaacgccattacaaacctcatttggtgtgaatatgattgctttagtgaatggtagacctaaactaatcaatttaaaagaagcacttattcattacttagaacaccaaaaaacagtggttagacgacgtactgaatataatcttaaaaaagcaagagaccgtgcacatattctagaaggtttacgaatagcactagatcatattgatgaaattatcacaacaattcgtgaatcggacactgataaaattgcgatggcaagtttacaagagcgttttaaactaactgaacgtcaagctcaagcaattttagatatgcgtttaagacgtttaactggattagaaagagataaaatagaatctgagtataatgaacttctagaatatattaaagagttagaagagattttagctgatgaagaagtactattacaattagttcgtgatgaattgactgaaattaaagagcgtttcggcgatgaacgtcgcactgaaattcaattaggtggtctagaagatcttgaagatgaagacttaatccctgaagaacaaattgttattacattaagtcataataactatattaaacgtttaccagtatctacatatcgttctcaaaatcgtggtggtcgtggcatacaaggtatgaacacgttggatgaggacttcgttagtcaattggtaacaatgagtacacatgatcatgttctgttctttacgaataaaggtcgtgtatataaactcaaaggttatgaagttcctgagttgtcacgtcaatccaaaggcatacctattattaatgcgattgaactcgaaaatgacgaaacaataagtacgatgattgcagttaaagaccttgaaagtgaagaagattatctcgtattcgcgacaaaacaaggtatcgttaaacgttcatcattaagtaacttctcccgtattaacaaaaacggtaaaattgcaattaactttaaagaagatgatgaattaattgcagtacgtctaacaacaggtaatgaagatattcttattggaactgcacatgcatcattaattagattttctgaatctacattacgcccattaggccgtacagcagcaggtgtgaaaggtatttctctacgtgaaggggatactgtcgttggtcttgatgttgcagattcagaaagtgaagatgaagtattagtagttactgaaaatggttacggtaaacgtacacctgttagcgaatatcgtttatcaaatcgtggtggtaaaggaatcaaaactgcgacaattaccgagcgtaatggtaacatcgtttgtatcacaactgtaaccggtgaagaggatttaatggttgtaactaacgctggtgttattattcgtcttgacgttcatgatatttctcaaaatggacgtgcagcacaaggtgtacgccttatgaaactcggagatggtcaatttgtttctactgttgctaaagtaaacgaagaagacgataatgaggaaaatgcagatgaagcgcaacaatctactactactgaaacagcagatgtagaagaggtagtggatgatcagacaccaggcaatgcgattcatacagaaggtgatgcagaaatggaatctgtagaatctcctgaaaatgatgatcgtattgatatcagacaagattttatggatagagtgaatgaagatatcgagagtgcttcagataatgaagaagatagtgatgaataa

SEQ ID NO: 3010 - DNA, 138 bp, Staphylococcus epidermidis
tacatacctaaatatcttcaacttataaactactttttatttcaatgcctttttccaaacttcttttatgagatattgtggttattacctgacatttacaatttacacatttcgctattattacgcaaattattttga

SEQ ID NO: 3011 - DNA, 309 bp, Staphylococcus epidermidis
ataacacctaaaccgccttgtcgagccatagcaattgccatttttgattcagttactgtatccatacctgctgagataacaggaatgtttaacttgatcttatctgataatttgacacttaagtcaacatcgcttggtaaaacatctgatgcagctggaatgagtaacacgtcgtcgaatgttaaagattctttagcaaatttattttcccacattaaaaacagcctccaattttatttatacttagttacattatttcacattttcttcagtttgtttatactttataccattaaaaaagaaatttaa

SEQ ID NO: 3012 - DNA, 324 bp, Staphylococcus epidermidis
atgatgactaatgtacaaaggatgatccaaatgaataaaaagagtctccactttttattgttaaaacgcaaggttttaggtattgcattcaatttacctgaaggagaagaatttacatttcatgacttgaacagtcgtgcaaatgtaacgtgttctaaagaagtacaacaaaatgttggacgttggttcgcatattttgtaaaacatgcgccacgtgttccatttattattatcggtaaggatactcacggtcatttagtttatcttaaaacaggtcctaatccacaccataacagcaacccttcgaaaggaggtgttcgctaa

SEQ ID NO: 3013 - DNA, 156 bp, Staphylococcus epidermidis
tttgctgctaatgcgccagctttagtaattgcattaaatagggtagacttacctacgttaggcaaacctacgatacctgctgttaaagccattattcattctcctaactttctttgtcttgatgagattcaagaacttttttcattttcttattaa

SEQ ID NO: 3014 - DNA, 216 bp, Staphylococcus epidermidis
gtatattgtttaccaacttgttgtgaaaatctatatgctagttttggtaaaactgaggaaggacgctggatagctaagaatgcccataattatggatttattataagatatcctaaaaacaaagaaagcatcacaggatatcaatatgaaccttggcatttacgttatttaggaaaaagaaggcgacaaaagtgtacaaatctggtgaaacattag

SEQ ID NO: 3015 - DNA, 126 bp, Staphylococcus epidermidis
tataatcataattgtaataacaaaaagatgacaacattaaacaatttaaatttatacaaaaaaacattatcaaatttaaaatttggtagtggtagtgctacagcatacataagtagttataattaa

SEQ ID NO: 3016 - DNA, 855 bp, Staphylococcus epidermidis
atgaatcataattttatcaagctgattggagaggttaaaatgcattatataaaatttattgagtcaaaagataatacaaaactttatatgaaagtgaatgatattcaagatgcaaaagcgaatatcattatagctcatggtgtggcagaacatttagatcgttatgatgagataacagcatatttaaatgaagcgggttttagtgttattagatatgatcaaagagggcatggtcgttctgaaggcaagcgtgccttttatagcaatagtaatgaaattgtcgaagatttagatgcgataataaattatgtgaagtcaaactttgaaggtaaagtttacttaatcggtcatagtatgggtggttatacagtcactttatatggaacgaaacatccaaatacagtgaatggtattataacttctggagcattaacacgttataataataaactatttggcaatcctgatagaaacatatcacctgatacttatatagaaaacaatttaagtgagggggtatgttctgatttagaggtaatggaaaaatataaacttgatgatttgaatgcgaaacaaatctctatggggctcgtcttttcaataatggatggtgttaggtatttgaaagacaatgctcaacaatttacagataatattttgatattgcatggcaaggaagatgggctagtaagctatgtagattctttacagctttatcaagaaataggatcagcacataaatcattacacatctatgatcgtttggagcatgaaatatttaatgaaagttcttataatagaactatttttaacgaagttattgaatggcttgaaacggaattaacttataactaa

SEQ ID NO: 3017 - DNA, 144 bp, Staphylococcus epidermidis
accgtccataagaaacctcctcgatgtcgttttacaattcattattacatatcaccaatggcgaatgaaaccgaacagatgcctttaaatcaaagtaataattttctcaattttgttggaaattttaaaaatcaaaacctttaa

SEQ ID NO: 3018 - DNA, 1323 bp, Staphylococcus epidermidis
aatataaataagtacatattgaagaaaatgagacataatatattttataataggagggaatttcaaatgatagacaactttatgcaggtccttaaattaattaaacaccaacgtaccaataatgtagttaaaaaatctgattgggataaaggtgatctatataaaactttagtccatgataagttacccaagcagttaaaagtgcatataaaagaagataaatattcagttgtagggaaggttgctactgggaactatagtaaagttccttggatttcaatatatgatgagaatataacaaaagaaacaaaggatggatattatttggtatatctttttcatccggaaggagaaggcatatacttatctttgaatcaaggatggtcaaagataagtgatatgtttccgcgggataaaaatgctgcaaaacaaagagcattaactttatcttccgaactcaataaatatattacatcaaatgaatttaatactggaagattttattacgcagaaaataaagattcatcttatgatttaaaaaatgattatccatcaggatattctcatggatcaataagattcaaatattatgatttgaatgaaggattcacagaagaagatatgctagaggatttaaagaaatttttagaactatttaatgaattagcttcaaaagttacaaaaacatcctatgatagcttggtcaatagcatagacgaaatacaggaagacagcgaaattgaagaaattagaacagcacaaaaagataagacactcaaggaagtggaagcacctaaaggaataattccaaaatataaaaaaggtgtatcaaagactactaaaaatgattcagaaattgaaaaatcaaataaagagaataaattaaccggtaaagttggagaaaaattagcgctaaattactttaatgagctaattgataataaaatagacgaagataagaaagaacagtttaggaatattttaaatgataatccaggctctcaacacggtcatggctatgatttagtagcttttgatccaacaaatacagataaagctgtagaaaaatttattgaaattaaaacatctacatcttctagtattgaggaaccattttttatgtcgctaaatgaaatgtttgctatgaaagaatataagcagaaatatttaatattaagaatatttaatgtttccggtaaagaaccacaattttattttatagatccatatgcaaattattctgaatttaaagatgtagatgatctcattgacaaagtatttaatgtagaagctattcagtataaagtttttggcgaaaaatga

SEQ ID NO: 3019 - DNA, 183 bp, Staphylococcus epidermidis
gctgaaaataatacgaaaatttataaaaaaaaagacaatttctatattatatcaatagaaattgtcttttttcatttatttagaaatgttatatctacagaattttttagtaaaatcactggtagggagaaggtagacgtatcacaccagcaaaacctgctaaagatgctaagttacacttag

SEQ ID NO: 3020 - DNA, 375 bp, Staphylococcus epidermidis
acaatgaataatgatagaggaaaaagtcttcaaattccccaaagtacatcgttaaaagaaggatctatatacgttgctacattacattctgtgactgagacagattactcaggcgacataaaacatcaatttacgtatgaaatagagatagatcaacaaatattctatgtgaaccgtagtgttgtggtcaatgtgacacatcaacaattatcaattaatgactggctcgaacgtcatagtaactatagcgcaagtcatgaaaactatgagccttatattgatcagaaacatttaattctattaggtcaatataacggtaactattatgtacaagatgtagcatcgttagatgcgtttggaggcgtattatcatga

SEQ ID NO: 3021 - DNA, 1200 bp, Staphylococcus epidermidis
cacgtgaataacttttcaaatgtcatatcagttgctattcgttccattttaaaaaacaaacgacgtaatatctttacgatgattggaataattattggtattgcatcagtaattactatcatgtcgttggggaacggttttaagaagtcaacgactgagcaattcaatgatgctggtgctggtaaaaatcaagcttcaatttcttacatgacagaaaatatggaagcgcctaaaaataatccatttaagcaagaggatatgagtgttgttgaacaggttaatggtgttaagagtgctaaagtaaaagaggataaggatagcacatattcagtcaaaattacgaatacacatggcagtagtgatgctagtttaaaaaaggttgataaactgacagatgtagatgaaggaaaaggatttacgaatgatgataatgaagtgctagaaaaagtagccgttatagataaaaaaattgctaaaaaagtattcaataatcatgcaatggggcaatccatctatataaatggagaagggtttaaagtcgtaggcgtctctgatagctcagaagttgatgaaagtgggatgcctattgagtcattaattcaaatacctacaaaatcatttaataaatatatgggcaatttgacacaaggtatgcctcaattattagttacagttgaaaaaggttcagataagaaagacgtaggtaaaaaggtcgaaaaagcgttgaataaaaaaggaactggtgtatctgaaggtcaatatagttatgaagataatgaagcagtaatgaaaacgataggttcagtcttagacacgattacttactttgtctctgctgttgcgggaatatcactctttattgcaggtattggtgtaatgaatgtcatgtatatttcagtcactgaacgaacagaagagattgcaattcgtcgtgcatttggcgctaaaggtcgagatattgaaatacaattcttagtagaaagtgttgtgttatgtctcataggtggtatcatcggattaattctaggtattattattgctacattgattgatctcgtgacacctgaaatggttaagagttccgtcagtctaggttccgtcatcctagctgtaggtgtatcaacattgataggcatcattttcggttggatacctgcacgttcagcttctaaaaaagaattaattgatattattaaataa

SEQ ID NO: 3022 - DNA, 138 bp, Staphylococcus epidermidis
ataacgaataagtcattattcactatgaataaatctattttaacaattcactacatactaattctcattttcttattattctctaatatctctgatttattactcagtgaaagatgccctatttttatcagtatatag

SEQ ID NO: 3023 - DNA, 375 bp, Staphylococcus epidermidis
ccaaagaataaaatttttttagaaagagtggtgagaatgatggatgagaatcgctcgaaaggtaaccgctggggtgtttgggcctttttcggaatattattggttcctttattggttcctttactttgttgcgcaggaccgattctccttgttgcattagggagcacaggtattggtgccctctttgctggtgcgacaggaaattggtggttgaccggcatttttgcagcattggccattgttatgattgctctgatcctcagcaagttgttgaagaacaaatacaattctcctgaaggcaatggaaaaacaaaaaataaaacggattgctgtacgcctccagagagcgtggatcggaaacatgagacaagataa

SEQ ID NO: 3024 - DNA, 1269 bp, Staphylococcus epidermidis
tgtgaatgtaataaagcaaaggaggaatttgaaatggtacaaggacccattcaagtaaatagtgaaataggcaaattgaaaactgtgttgttaaaaagaccaggaaaagaattagaaaatttagtacctgatcatttaagtggtttattattcgatgatattccctacttaaaagttgcacaagaagagcatgacaaatttgctcaaactttgagagatgaaggaatcgaagtagtttatttagaaaaacttgcagcagaatctattactgagccagaagtacgcgagaacttcataaacgacatattaacagaatctaaaaagacaatattaggtcatgaaactgaaattaaagaattcttttcaaagttatctgaccaagaacttgtaaataaaatcatggctggcgtacgtaaagaagaaattcaacttgaaacaacccatttagtagaatatatggatgatagatatccattttacttagatccaatgcccaacctttattttacaagagatccccaagcttcaattggtagaggaatgacaattaacagaatgtattggagagcacgacgtagagaatctatttttatgacatatatactgaaacatcatccaagatttaaagataaagatgtaccagtatggttagatcgtaactcaccatttaatattgaaggtggagatgaattagtattatcgaaagatgttttagctattggtatatcagaacgtacatcagctcaagcaatagaaaagttagcacgtaatattttcaaagatgcaaacacaagttttaaaaaaatcgtagctattgaaatacctaatacacgtacatttatgcacctagatacagtactaactatgattgactacgataagtttacagtacatgcagcaatatttaaagaagaaaataatatgaatatatttaccatagaacaaaatgatggtaaggacgatataaaaattactcgttctagcaagttacgtgaaacacttgctgaagttttagaagtagaaaaagtggactttattccaacaggtaatggcgacgttattgatggtgcacgtgaacaatggaatgatggctcaaacacattatgtattcgaccaggggttgtggtgacatacgatcgcaactatgtatcaaaccaacttttacgcgacaaaggaattaaagtgattgaaattactggtagtgaacttgtacgtggacgcggaggcccaagatgtatgagtcagccgttatttagagaagatatttaa

SEQ ID NO: 3025 - DNA, 135 bp, Staphylococcus epidermidis
ttatttagtaactacaaagtcttttatattcatgaacataatactcctggatggcgtaacccagcgccatccttttttatgttttataacatgaaaaaagcacccacaccatttttattggtttggatgctttga

SEQ ID NO: 3026 - DNA, 267 bp, Staphylococcus epidermidis
attcatagtaatagtagtaggcactgtggattggtggataagtctaaaaaacttacgaatagcacagttatacacatgtggataaactgtgtatgttgtgtattattttttcacattatccacaattgctattttttattcagagggacaactccccatctttttaagtgtttaggaattgatttacatagtaattattccctaaaagacagtttacaatctgctaattttcaatttattcaatatggatttatttcccattactga

SEQ ID NO: 3027 - DNA, 162 bp, Staphylococcus epidermidis
cagttattcaaaggatatataggtaaaatacatacacatacttccaacattttcaaaagagaaaaacaaaataaaaaccgtacaatagatagtttaaaacaattattgtacggaaaaatattttttatgacatatctgcatgagcataatcaatgtctgtaa

SEQ ID NO: 3028 - DNA, 603 bp, Staphylococcus epidermidis
aaacatatcaagggagccataataatgaagaaagaaataatagaatggattgtagccataatcgttgcaattgttatcgtcacacttgtgcaaaagtttttatttgcttcttatacagtcaaaggagcgtctatgcatccaacatttgaaaatagagaaaaagtgatagtaagtcgtatagcaaaaacgcttgatcatattgatacaggagatgtagtgatttttcatgctaacgcgaagcaagattatattaagcgacttattggtaaaccaggtgattcagtagaatataaaaaagatcaactatatttaaacggtaaaaaagtagatgagccttatttaagtgaaaataaaaaacacaaagttggagaatatctaacggaaaactttaagtctaaagatcttaagggtacgaatggcaatatgaaaattcctagtggtaaatacttggttttaggtgataatcgtcaaaacagtattgacagtcgcatggatgaagtaggtcttttagataaaaatcaagttgttggaaaagtagttttgagatactggccatttaatcggtggggcggtagttttaatcctggaacatttcctaactaa

SEQ ID NO: 3029 - DNA, 159 bp, Staphylococcus epidermidis
cgaacaatcaactcattatttataagtattgatgatagggtggggtctctgcttccttatatatattatttatttataaagaataacgggattttgggattgtgcttgcacaatccttctgcttcttctaatctgcaaatcccattcctttcccgataa

SEQ ID NO: 3030 - DNA, 171 bp, Staphylococcus epidermidis
atagtagccaacggctacagtgataacatccttgttaaattgtttatatctgaaatagttcatacagaagactcctttttgttaaaattatactataaattcaactttgcaacagaaccgtattatggaatagagatgttggtaacatttatacaggatcattatacttaa

SEQ ID NO: 3031 - DNA, 153 bp, Staphylococcus epidermidis
atagtagccaacggctacagtgataacatccttgttaaattgtttatatctgaaatagttcatacagaaggctcctttttgttaaaattatactataaattcaactttgcaacagaaccatttgcgatacaacgaggcgacattagccgttaa

SEQ ID NO: 3032 - DNA, 132 bp, Staphylococcus epidermidis
atagtagccaacggctacagtgataacatccttgttaaattgtttatatctgaaatagttcatacagaaggctcctttttgttaaaattatactataaattcaactttgcaacagaaccaactaaaaaatag

SEQ ID NO: 3033 - DNA, 210 bp, Staphylococcus epidermidis
atagtagccaacggctacagtgataacatccttgttaaattgtttatatctgaaatagttcatacaaaagactcctttttattaaaattatactataaattcaactttgcaacagaaccacttaaagacatgtttgtcatacatatttgtaaaaatcaaaaaatcatggttatatacatcattatttttgataataattatcttaaataa

SEQ ID NO: 3034 - DNA, 141 bp, Staphylococcus epidermidis
atagtagccaacggctacagtgataacatccttgttaaattgtttatatctgaaatagttcatacagaagactcctttttgttaaaattatactatagattcaactttgcaacagaacctatattttgctataattattaa

SEQ ID NO: 3035 - DNA, 129 bp, Staphylococcus epidermidis
aaagttaacaaaaatttaaccaaattagttaaaaaaattaatagcttttatgttattttgaatttagcagttattttttcattctttataagggaaaaatcttatagaggtgatttctttgacaaataa

SEQ ID NO: 3036 - DNA, 516 bp, Staphylococcus epidermidis
ttacaaaacaagaatggcaatattacaaaagaaattgaagaagaaaatcttgatattccgccagaagctttgaattacatcgccaaccaaatccaatcaaatattcgtgaacttgaaggcgcattaactcgacttttagcgtactccaaattacaaggaaaacctattacaaccgaactcactgcagaagcgttaaaagatatcattcagtcacctaagtctaaaaagattacaattcaagatatccaaaagatagttggtcaatattatagtgtaagaattgaagattttagtgccaaaaaacgtacaaagtcaattgcttacccacgacaaatagctatgtatctatctagagaattaactgatttttcattacctaagataggtgaagaatttggaggtcgcgatcatacaacagttatccatgcccatgaaaagattgcaaatgatatcaagtctgatcctacatttaagcaagaagtagaaaacttagaaaaagaaattagaaatcagtaa

SEQ ID NO: 3037 - DNA, 339 bp, Staphylococcus epidermidis
aagaaaagcaaaatggaggaaaatagtatgaaaatcaatcgatacatcacaagaggcattagtgaacaactatctctagaccttcaaatcttactttggaacatggtaaaagatcgagacaatcaacttaatacagattacctacacattttcaaactacaagaagatgataatatgttgtcaattacacatgaacaagaacaacccgcatacaaattggaatatcactatacaaactatataaaaaatcaaaatgcattacctaagaaagtctacgtcatccgagaagatgatgtagacgctttttattatgtgatgcttttgccagaagaatactaa

SEQ ID NO: 3038 - DNA, 132 bp, Staphylococcus epidermidis
tattatggcaatttacgtacaaacggtagcgagctatattttcaagcacattttgttggaagtgtacaaagcacagtgcgaacaaaaaacgttcaagattatagtgccgatacacgatgcgattatgattga

SEQ ID NO: 3039 - DNA, 285 bp, Staphylococcus epidermidis
aaatatttaaagcaggtattttacatgcaacataaaaataaatttcaacgtattaaccaaattatacaagttataggtttcctttcatttttagcaattctcactatcattacacttaacttttttataaaaggacacttacaaggtcattttgaaataggttttaatattcaaagtaatcaagtctatgtagtaacgacactaatcatagttacaatcatctgtactatattatcagctattctaaacatgctttctaataaaaaacaaaattacaaacattaa

SEQ ID NO: 3040 - DNA, 222 bp, Staphylococcus epidermidis
aaacttctaaagccatattctctagattatatgagtcatataaattattttatgataatagcaaatttttgttgtattttcaatataattaaagagatgttcacgattcaaaaagcatcaaaattcagtgtaagcgttatattaaaggatgaattatcattgaaatgttttaatacaaaattatataattatctgtgtaatagttttattaaattagactag

SEQ ID NO: 3041 - DNA, 225 bp, Staphylococcus epidermidis
tattttataaaggagttcgattttatgaaaataaatcatgcaggtacattatctgttgattattttgttagctacttaaatctaattatgatatcaagagaagtttctttaaaagaagctgtatcatatatgaaaaatgagttctttaaaggaaaaactgacttgtatggtaaagtaacagaaactcattttaatcaagcaatacaagaactcaaacaaaaatag

SEQ ID NO: 3042 - DNA, 159 bp, Staphylococcus epidermidis
aaaagcataaaaaaatgcctaccctattgggtaggcaatacggtcccgacgggaatcgaacccgcgatctcctgcgtgacaggcaggcgtgttaaccgctacactacgggacctagaatggtgactcctacgggactcgaacccgtgttaccgccgtga

SEQ ID NO: 3043 - DNA, 141 bp, Staphylococcus epidermidis
aaactaataaattttattaaaacttgtattactaaaaatcaattttatacaatccctaaaaagtctattatttttgtcattttgactaatatacttgtcataatgacaaatatattatatagtttatatgtaaggaagtga

SEQ ID NO: 3044 - DNA, 384 bp, Staphylococcus epidermidis
agaaaagtaaagaaggtgaaaaaagtggaaaatacaaatagtaatatgcataaaaatgacaatagttacgttttatcagcattgagttatttaagtatctttttcgcacctgtcattttacctttatttgtatggatacttgctgatgaaccaacatcagaacatggcaaaaaagcattcattaatcatattatgacttgggttagtttttttataggtagattggcatttattttttctaaagaagtctttgataaacctttggatcatcaattattaatatttagcattcttttaattattactattatattctttttaattgctttaatattatatatcttgaacattaacagaggaattaaaattctattaaaaaaataa

SEQ ID NO: 3045 - DNA, 384 bp, Staphylococcus epidermidis
agaaaagtaaagaaggtgaaaaaagtggaaaatacaaatagtaatatgcataaaaatgacaatagttacgttttatcagcattgagttatttaagtatctttttcgcacctgtcattttacctttatttgtatggatacttgctgatgagccaacatcaggacatggtaaaaaagcattagggaatcatattatgacatggattagtttttgtgtaggcagaggaatttttattttttcaaaaggagtctttgataaaccgtttgatcatcaattattaatatttgttattgctttaatcattgctattgtattctttttaattgctttaatattatatattctcaacattatcagaggaattaaaattttattaaaaaaataa

SEQ ID NO: 3046 - DNA, 141 bp, Staphylococcus epidermidis
ttactttcaaataatcaagcaacacattttctacctaaattaaacttaatctatacttattatttttttcttagtgcttttaaaattaatgaaataataaagattaaaataattgaacctaataatgctggaaagatgtga

SEQ ID NO: 3047 - DNA, 255 bp, Staphylococcus epidermidis
aacagttcaaatatggatggacctaaaacatctatggatcatgaaactaaacaatcagattggcgaacggttgctagttgtttagcatcgcaaaattatatatcgctcgtaaaaggattagtacattatttcacagcgattgaagatgaagaaatacttgataaaatctatgatgattttatgaatgatgactctataacaacggtacttaacaatgatttacagacaatcattaaccattatctatcaaaataa

SEQ ID NO: 3048 - DNA, 180 bp, Staphylococcus epidermidis
agagctacaaacacgcatgacacaaggtcaaagcgactttacatttgtcataggtggctccaatggtttacatcaagacgtcttacaacgcagcaattacgctctatcattcagcactatgaccttcccgcaccaaatgatgcgcgtcatattgatagaacaaatttatcgctcatttaa

SEQ ID NO: 3049 - DNA, 129 bp, Staphylococcus epidermidis
cgtcacacaaacgtatgtctaaaaacaatgaatatttattgtcatagattgagttataaaatcatgaaaataatacatgaagtaacaagtatttatcttttagagaacgcctgtaaaaatataaaatag

SEQ ID NO: 3050 - DNA, 1125 bp, Staphylococcus epidermidis
aaggagcaaaacactatgtatcaaacaaatacacgtgatttaattacaaaattgcctcaaagcaataaaacagaacactttttaatgaacaaattttcaaatcaagataaagttcagcagctacaaagacaaattagccaacagctagatcaacaatataatgagcttttgtctaatgaaaaagctaagctagaccaatatgtggaagtacaccataatttagaaccattaaagaaagagattgaatcagaatctattaaccttgataccgataaattacctgatatcaaagcgacaatgcttgaaaaggctaagaacgatgaacattctgataaaatcgaacacctatttgatagattagatcagtcattaaatggtacgaatcgattatatacgcaattatcgttgattggcacacgaacacatcggataacaacgaaaagatttaatgttcaaggcttacctaaattagtccaacaaacgattttaccttcgcaatttaaaaaggtttatacaatagattttaaatcattcgaaccatcagttgctgcgtatatgacacaagacgaacaactgattgactacttgaatcttgaagaagggttatacgatgcattactgagagacttatctttgtcaaaagagaagcgcgtgagtgtgaaacgtgcatttatagggtcatttctttttggcggtcgttatagtagctctaaattcaaaatcaatcaagaggttagtgaaattaactggctacaagtaatgagcaaattcaagaagatcattgaatttaaagagcaagtcgaaaaatataaaacaatgcctacgccttacggcattgaacatgatatgagcgcatttcaaggtagtagtattatggcaatttacgtacaaacggtagcgagctatattttcaagcacattttgttggaagtgtacaaagcacagtgcgaacaaaaaacgttcaagattatagtgccgatacacgatgcgattatgattgaatgtaatgataaggagattgcacaaagtgtagcacagctcatgaaagatacagctaatcgactgtttaatggtgaatttgcacatgtgacagtggaagctttaggaggtatagacaatgaataa

SEQ ID NO: 3051 - DNA, 135 bp, Staphylococcus epidermidis
caatttaaaaaacattttacacactgtaaaaaggaaagtaaaacttacactgcttatacagagagtcttcacacgctgagagaaggcattgaaagaaagtttgaaaatggccttggagtgttgatgccaatatga

SEQ ID NO: 3052 - DNA, 186 bp, Staphylococcus epidermidis
gagtttaaaaagaaagaggtacgcttttcctatactaatctcgaactactttataaacattcgttactcaatctaaatctttgttcttcatttctatcaaaaaggcctactgcatttgaactaaatttcgagttattagttgaattatcaattaattcgtatatcaatgtttctaatcaactctag

SEQ ID NO: 3053 - DNA, 126 bp, Staphylococcus epidermidis; identical to SEQ ID NO: 1791

SEQ ID NO: 3054 - DNA, 771 bp, Staphylococcus epidermidis
aaaaataaaaatgcaaggagaggtaatatgctaactgtatatggacatagaggattacctagtaaagctccggaaaatacaattgcatcatttaaagctgcttcagaagtagaaggtataaactggttggagttagatgttgcaattacaaaagatgaacaactgattatcattcatgatgattatttagaacggactacaaatatgtccggggaaataactgaattgaattatgatgaaattaaagatgcttctgcaggatcttggtttggtgaaaaattcaaagatgaacatttgccaactttcgatgatgtagtaaaaatagcaaatgaatataatatgaatttaaatgtagaattaaaaggtattactggaccgaatggactagcactttctaaaagtatggttaagcaagtggaagaacaattaacaaacttaaatcagaatcaagaagtgctcatttcaagctttaatgttgtgcttgttaaacttgcagaagaaatcatgccacaatataacagagcagttatattccatacaacttcgtttcgtgaagactggagaacacttttagattactgtaatgctaaaatagtaaacactgaagatgccaaacttactaaagcaaaagtaaaaatggtaaaagaagcgggttatgaattgaacgtatggactgtaaacaaaccagcacgtgcaaaccaacttgctaattggggagttgatggtatctttacagacaatgcagataaaatggtgcatttgtctcaatag

SEQ ID NO: 3055 - DNA, 2013 bp, Staphylococcus epidermidis
gtgaataaaaatattacagctctaaaatctactgaaaatactacatatatgcagtatacggttcatatcgatgatcaaattataaataatataaaagagtgtaccaaaaagtttaaaattttgcctatggaagataaaattccattatcaccgttgttacaaccagaatatgcaggagaggtacaagattttattagtacatatgagcagtttatgattaattttggtaaagtaatattggatagtcaaggcataaaaatacaatttgaaagtgaatcattaagtagtattcaacgaggcattcaagaacattgttacttaaataagcgaacaaatgacattgatgtgactaaagaatggtatttatgcaaattttcaaatcgaacattagaagaggataaaaatcaattgtataatgctttaaagcaactcatgaatgattctaaaaataaaaagcaagcttttcaagaggtgtttaaggttcatattgatatttatctctacaataaagaaaaatctgaatataagtatcaagcatctagttatttctatcttgtaaaagaaaatcctaaaataatttataaaaaaagacatttacaagagaaacaagggatcaagggtacaactttcacgaacaaattaaaattattgaacaaaatgtatggtgtagatgttgcaaaatatcagccattttataattctaataatcctgaatatgaaagaggtcaatttggtgaaagatacatttctcaaagatctaactatgaatttaatagacttcaatatcaaattatatatatattatcgaaaatacttgataagcatccattaccaaagtcagataataattataaacatattccaactattgaaaaagcaatattaagagatgattcccataatttttatgagtattttgaagatataatgaaagaaattatgaatatggataattctcccttacaggaaaaattattgactgattttacatatcaatcccaatgtagatggtactctgaaaataaaaaattaaaattgcaacttgaaagatttatgcataaagttttagagagtaattattatgagggcaacaaattattgagaatgatgtctaacgcaattgaagaaacaatcaatgaggctaaagaagataaggttcatttcaattattttaaagattattttttgacagacggtggggtgaagaattgggagcaaattagcgagaaaattactgaattcaatggtaaagttattaacgatatccaacatgaatataataagatacagtccaagaatacaaatcaaaatcagaaactaaactttgtttatttatatcattgctttgagtttagtaataacatagtaaaagcaaaagataatgaaagtaaaaattatatcttgttttttatagataaatataaaataaagacaccatttttggatcaattattaataaattgtttgaatcaagaaatagatcaggaaagtattaactacaatatgcaaacaatgtttgaaaaagaaagatatgatagaagtagtatcattgaaaaattagtagcaacaagaaaatttaagtatgaaaaagatgattcagatttattcaaacaacttttcaatgatgttgaaaattcaatagacagattaggtatttacttactaaataatggtataaattcgaatgatgaaaatgcaagatactatagatcgtttttaaaggaacttagtagaataaaaagtaaattaacgccattttctcttgaaataagtaagtctagcggaagagagcaacattatcctgatgatgctgttgatgataaagatgagagaagaaaaaataaagaagaaacatatcatgcttttgatgataaaagcgatattgactacaaattaaagaataaaataagtgattatatcgataatttattgtcagttaaaattaggaataatttgtatgatattagtccaaatacaaaaagcaataattataatgagccaactcaaaaatga

SEQ ID NO: 3056 - DNA, 432 bp, Staphylococcus epidermidis
atgttcaaaaatatattattaccctatgatttcgaaaatgattttagtgctatccctgactatttagaaaaagtcaccgatgaagattcagttgttgtaatttatcacgttgtaacagaaaatgatcttgcaattagtgtcaagtattataataagcataaagaagatattattagagaaaaagagaaaaaactcactccatttttacgtgaattagaaaaaagagatattcaatataaaatagatgtagattttgggcatattaaagatacaatcttagaaaaaattacttctggagatataaataatggtgaatttgatttagtaattatgagtaatcatagagtcgatttgaatattaaacatgttttaggagatgttacacataagattgctaaaagaagttctgtcccagtactaattgttaaataa

SEQ ID NO: 3057 - DNA, 180 bp, Staphylococcus epidermidis
aattgcaaaaactttattatacataaggtttacctcttttattttaattttaatgtaaaagcattaatcgctactataactgtacttaaagacattaatattgctcctacagctggtgataatattaacccgataaaagctaatgcgccagctgctaaaggtacagcaacaatattataa

SEQ ID NO: 3058 - DNA, 135 bp, Staphylococcus epidermidis
actttaaaaaatcagtttagtgatatgcttatttatttcgagttaggatttatgtcccaagctcatcaagcacaatcggccactagtttatttctctatcttatatgttctgatatggtcttctatactgtataa

SEQ ID NO: 3059 - DNA, 1287 bp, Staphylococcus epidermidis
tcaagaaaaaagcttactcatttcaaaaataagtgtcttaaatcacttaagagaggattttatgtaatgcttagtaaaaaacaaattaaaaaaactttaaacagcgataaaatgccgtcattaattgttaatgaattagatagagaattgcagaataaattgaaacaacaatatccaagtaaagaagaattaattaaagaattgaagtatgacgcagttaatgagaattctgcagtattaaaaaatgaattgacgagtaaactaaaattcaaacttaaggattatcaagattcaaatgaatttttattttacttaaaaaatagtcaaaagatgattgaaatacatgattataaaatggagcaattttttgaagatatacctcttgaagatagtgatgtttataaatctattgcgaataatgaagatacagaaacatatataataatgaaagctccagaatttaatgaagaagataaactaaatatatcaattaaagttgatgggaaatttaaagaattagattttcacagaatagcatatgatagtaaaaaagaaatgaaatatttatatcagaaccgatatataaagatattcatgttaatagaaaaaaatttagaatatattagttggggatttcatcatctttttaatgaaagtataggggaagtaaatacaattaatataattgatacttataaaatgttaatagcgctagctagtggcgaaatgtatacagcaaataagataaaatttaataacgattcagcaagtaaaaataaagaaatcttagaatctttaaacagagatttaaaattatttgaaattattcatgaatttcaaaattcgttggataaagaatttaagatatccaccccgtttaattctaaagaaattatagaaggagtaaaaacctactttttattatataaacaaaaactaatattggaagaaaagcgtttagaaagtttactaatcaaaacatcttccttcgatttagaagatataaaaggaaaaaaattcaccttaattcaagaggaaaaagtaacaaaaactatttttactcaaaaaatctcttacacacaatatcaatgttattatcaagtaaaatcctcagactatgaaaaattacaagatgatgaatttaaactaaaatttaatcctgaagatgtaattactattattttaaaagcttcattcaacacaaccgaacctatcggattagaaaatattgcttttgaagaagcggaaactttagatacctttattagtaactataaatcaaattaa

SEQ ID NO: 3060 - DNA, 441 bp, Staphylococcus epidermidis
ggaggaaaaaacatgaaatttcaagtaagtccatattttttaatcactcaaaatgcagagggtttaaaaaagttgtatgaagagctgtttggcgctaaaacactgtatattcaacgtattaaagatagacctatagataagcaacttaatattgacgaaaatgatttaaataaaattgatcaatgtgtacttcaatttggagatataaaaattatgatcgcagatgacactgaaggtttgcccataacacaaggtaataatatatctctttgtctcacttttgaccaagtagaagaaactaaacatgtatatgaccagttaatagaaaaaggcagtgaggtattgaaaacatttagtccagaattctatactgaaggttatggttatgtaagagatccttatggtatctctttgcatttatttacaaagagaaaaaattag

SEQ ID NO: 3061 - DNA, 522 bp, Staphylococcus epidermidis
aggagtgaaaatttcatgaaaacaatcaaaagtacattagaaaccgaagccattttcagtgatgaccaacaacatcgctatctacttaagaaaacatggaatagtgaaaaacaaaagatcacaatcatcacaatgtatccaaattatacaggccttcttcgtatagatttaactacccaattgataatgaacaaagtttcagaaatggatacatttggttccatcaattttgtgaatctatactctaatattacaacccctatcaatctcaaacatttagaaaacgcctatgataatcatacagatattcaaattatgaaagccgtgaaagagtcagatgaagtgatactagcttggggtgcttacgctaaaaagcccgttgttgaatcacgcgtcaatgaagtattagagatgttgaaaccacataagaaaaaagtgaaacgactcatgaaccccgcaaccaatgaaatcatgcatccccttaatccgaaagcgagacagaaatggactttgaaagcataa

SEQ ID NO: 3062 - DNA, 681 bp, Staphylococcus epidermidis
agtggagaaaatataaggaggaataagcttatgaaaaatatttcagaattctcagcccaacttaatcaaacttttgatcaaggggaagccgtctctatggagtggttattccgtccgttgctaaaaatgctggcggagggcgatccagtccccgttgaggacatcgcggcggagaccgggaagcccgtcgaggaagttaagcaagtcctacagactctacctagtgtggaacttgatgagcagggccgtgtcgtcggttatggcctcacactggtccctaccccccatcgcttcgaggttgatgggaagcaactatatgcatggtgcgcccttgacacacttatgttcccagcactcatcggccggacggtccacatcgcttcgccttgtcacggcaccggtaagtccgtacggttgacggtggaaccggaccgcgttgtaagcgtcgagccttcaacagccgttgtctcgattgttacaccagatgaaatggcctcggttcggtcggccttctgtaacaacgttcactttttcagttcaccgagtgcagcccaagactggcttaaccaacaccctgagtcgagcgttttgcccgttgaagatgcctttgaactgggtcgccatttgggagcgcgttatgaggagtcaggacctactaatgggtcctgttgtaacatttaa

SEQ ID NO: 3063 - DNA, 846 bp, Staphylococcus epidermidis
attatggaaaacttattagaagttcagcaactcaataaatcatataagaattcagaatttcagcttactgacatcacattctctgttaaacctggcgaggtagtgggtttaattgggaaaaatggttcaggtaagtctaccctcattaatacacttgtaggaaatagacataaagataatggttcactgaaattcttcgataaagaggtgacagagaacgacttcaaatataaagaacatttaggtgtagtttttgatgatttacgtgttccagataaattaactctacaatatatcaataaagtttttactgaaatatatgatgcttggaacagcgatacattcttttctttaatcaaagcatttgaactaccaacaaataatcaaattaagacattctcaagaggaatgcgtatgaaagcagctttaacaattgctttaagccatgatgctaaattattaatcttagatgaagctacagcaggtatggacgtatcaggacgtgaacatgtgttagaaattctagaggattatttaggagacgatcgtgccatattaatttcatcacatatttctgaagatattgaacagctagctactcagctcgtttttatgcgtgatggtcgaattattttaaaagaaagtaaagaagttttattgagccaatacggcatcatcgatcaaccagttgagcatttcaatatttcaaatgagtatctaatcgcaacgcgcagacgtaatgatcgacaaatcagtttagtgaataactatcaaaaagtacctgatgcacaaccactaaagacaatcgatgatgcaactaaaattattatgcgaggtgaagtataa

SEQ ID NO: 3064 - DNA, 969 bp, Staphylococcus epidermidis
aaccaggaaaagaaaaaaactataaaatttgaggttaatcaagattctgctacgttatggtatcacccccacccctctccaaatacagctaaacaagtttataatggcttatcaggattattatatatagaagatagtaaaaagaataattatcctagtaattatggaaaaaatgatttgcctataataatccaagataaaacatttgtatctaaaaaattaaattattcaaaaacgaaagacgaagatggcactcaaggtgatactgttcttgtgaacggaatagtaaaccccaaactgacagcaaaagaagagaaaatacgtttgagacttttaaatggttctaatgctcgagatttaaatcttaagctaagtaataatcaaagttttgagtatattgcttcagatggcggtcaattaaaaaacgctaaaaaattaaaagaaattaatttagctccttcagaaagaaaagaaatagtaatagatttatctaaaatgaaaggcgagaaaatcagtctggttgataatgataaaactgtaattttaccgattagtaacaaagagaaaagttctaacaaaggtaatacaccaaaagtaagtaaaaaaataaaattagaaggtatgaatgatcatgttaccattaatggtaataaattcgatcctaacagaatagattttacacaaaagttaaaccagaaagaagtatgggaaattgaaaatgtcaaagataaaatgggtggtatgaaacatcctttccacatccatggaacgcaatttaaagttttatctgtggatggtgagaaacctccaaaagatatgaggggtaaaaaggatgttatatctttggaacctggacaaaaagctaaaatagaggttgtatttaaaaatactggaacatacatgtttcactgtcatatacttgagcatgaagataatggaatgatgggtcaaataaaagtaacaaactaa

SEQ ID NO: 3065 - DNA, 159 bp, Staphylococcus epidermidis; identical to SEQ ID NO: 1997

SEQ ID NO: 3066 - DNA, 978 bp, Staphylococcus epidermidis
gctgatagaaagatgagtataagcgaatataaaaatagatacttagagtcactatataacacctttaaaactgagttagaaaacgaacgcactcgctattttatattagataccaactatacaaatagtgatgatactgaaaaggagtttacttgggatgtaaaacagaataataagatcagagaaggcgatttgttcatttttagacggccaactaatttatctcaaattgctcaacaattttatttctttggagctgggaaaatagaaaaaattgagcgaaaaaataatgtagcaaccgcttacatttcaaaacccttactttttgtggatcgtgttttaaaagataatattgaaaatttaaaatgggagttcaaagaaagaattaaagaagagtgggagcagtttttctttaaaaataaaatcagtaatattacaaaaaatgattttttaaaactactaagtttgagtagaaatgtagtggaaatagaaagtaattatattaataatgatatttcgctaacttttaaacaaatggctgatatggcaactcgaataaagaaaaatatttactacgtagggaatcatgaagcatttgttcaagctaagggaagtgctcattttgagttttcaaaaaggattaaacaaaattatagttatagatgtgcaattaccgggattaaaactaaagactttttagtcgttacacatattattccttggcatgaaaatgagtttattagactagatccttcaaatggtatttgtttgtctttatttttagcaaaagcatttaagaaaggctttatcactttttctaacagttatagagttgttttatctaaagaagcagagaaagatgctgctttatatgaagaattaaagatttatgaaaatcaaaaaatcgaactaccagattgtcagaaacctaatttgaaatatttagattggcatagagaacatatttttaaaaattaa

SEQ ID NO: 3067 - DNA, 510 bp, Staphylococcus epidermidis
cgatatatgaatacaatcaaaagtacgatacacacagaagcgatatttagcgatgatgaacaacatcgctacttactcaaaaagatatgggatgacaagaaaccggcttgtactgtgataacgatgtatcttcatttagatggtgtattatcactcgatcttactacggttctcatcctcaatcaattagctaattctgagcaatatggcgctgtttatctcgttaatcttttctctaatattaaaacaccagagaaccttaaacatatcaaagagccttatgatgagcacacagatatacacttaatgaaagcaattagtgaaagtgacacagtcattcttgcttatggtgcctatgcgaagcgaccagttgttatcgaccgtgtcgaacaagtgatggaaatgttaaaacctcataaaaagaaagtaaaaaagctcataaatccagtaacgaacgaagttatgcatccactcaaccctaaagcacgtcaaaaatggacactaaagtaa

SEQ ID NO: 3068 - DNA, 453 bp, Staphylococcus epidermidis
agacgcatgaaagtaattttcacacaagatgttaaaggtaaaggtaaaaaaggcgaagttaaagatgtaccagtaggttacgcaaataacttcttacttaaaaataaatatgctgtagaagcaactcctggtaacttaaaacaattagaacaacaaaataaacgtgccgaagcagatagacaacaagaaatcgatgatgcaaaagcacttaaagaacagttaaaagatatcgaagttgaagtatcagctaaaacaggtgaaggcggcaaactatttggttcaatcagtacgaaacaaattgccgaagcactaaaaaaacaacatgatattaaaatcgacaaacgtaaaatggacttaccgcatggtattcatgcactaggatatactaatgttccagtgaaattagacaaagaagtcgaaggtacaatccgtgtgcacactgtagaacaataa

SEQ ID NO: 3069 - DNA, 645 bp, Staphylococcus epidermidis
agtataatgaaaggtcttactcttagtatattttatacagctaaaaaatcatttttcatctatttagtagtcggaattattgctgcagtcgttttctcatttttaaatccaacgatgaacagctttcttgctatcatttttttaatatctcctattacggataacttcaaacgtgaaaaggactcaagatggatgaattacatatccacacttcctgttagaagagctgattatgttaaaagttattatactatttttctcttgtgtgcattagttgggatacttgcaggtgtacctagtgtcggtctaatcacacaaagtttaagtatggtattcatttcactatgtgttgccattggtggcgcagggactttctccattatgtttcctctaacattcaaattcggttctgaaaattcaaatgtcattgtgatgactacaacatttgctgtcattattatctatttcttattctatatcgcatcaatgatattgagtaatcaaacaggaagtggctctatgattacaatgctgagcaacacacaaagctatgttgtatattctatttatggaatacttggattgatttcaattattatctcttatattttatcgattaaaatttttaacaaacaagaactataa

SEQ ID NO: 3070 - DNA, 1275 bp, Staphylococcus epidermidis
agcgtaatgaaaaatttcatattaagtgtgcaacatttgttagcgatgtatgcaggggctattcttgttcctattattgtggggacaagcttaaaattttcagctgaagaaattgcttatctagttactgttgatatatttatgtgcggggtagcgacatttcttcaagcaaataaagtcacagggactggattaccgattgtactaggatgtacgtttactgccgttgcacctatgatactcatcggtcaaacgaaaggacttgatgttttatatggttcgcttttaatatccggtatcttagttgttttaattgcaccttttttctcttatttagttaaattctttccacctgttgtaacaggaagtgttgtgacaattattggaatcaatttaatgccagttgcaatgaattacttggcaggtggtgaaggagcgaaaaactatggcgatactaagaatttaatattaggtggtgttacactactcattattcttattttgcaaagatttacaaagggcttcttgaaatcaattgcgatacttataggattagcaataggtactgctttagctggtatatttggaatggttgatatcaaacaagtgggtgatgcacattggtttggtttccctgtgccattcagattttctggcttcggatttgatgtcagctcaatacttgtatttttcattgttgcagttgtaagtttaattgaatctactggtgtctatcatgcactgagtgaaattactggtagaaaactagaaagaaaagattttcgaaaagggtacactgcggaaggtctagcaatcattttaggttcaatatttaatgcgttcccttacactgcatattcccaaaatgtaggtcttgtttctttatcaggagctaaaaagaacaatgtgatatatggaatggttattcttttactaatttgcggttgtatacctaaattaggtgctttagctaatattattccattgccggttttaggtggggcaatgatagcaatgtttggaatggttatggcatacggcgttagtattttgggtaacattaatttccaaaatcaaaataatttattaattattgcaatttcagtagggttaggtgctggtattagtgcagtacctcaagcatttaaaggattaggagaacaatttgcttggttaactcaaaatggtatagtgcttggcgcaatttctgcaatcatcttaaatttcttttttaatggtataaagtataaacaaactgaagaaaatgtgaaataa

SEQ ID NO: 3071 - DNA, 3126 bp, Staphylococcus epidermidis
atagtgatgaactttcaatttaatgaagatgatttagaacaagtcgcattagaatggttacaatcactaggctatgactataaaaaaggtaatgagattagtatgacaggtctaacgccagaacgtaaaagtgataaagacgttgtccttcatgaacgattagaaaaggcgttaagaaaaattaattcagatattcatcctcgttttattgaaaaagcgatacatgaactaactttagagaagtcgcccaatcttttagaaaataaccttacttttcatgaaaatttgatcaatggtattgaaatcgaagactatgatgacgaaggacaatcggtagtagaaattgttaaaatcgttgattttgaatatccacaaaacaatgattttttagcagtcaatcaattcacggtcgttaatggagactatacaaaacgtcccgatattgtactctttatcaatggcttgcctatcgttgtgattgaacttaaaaattcaaccattgaaaccgtaggcgtcgaagacggctatcgtcaattagaaacatataaaatgcgtattccacaattatttacatttaatgaagttcttgttacaagtgatggtattaatacaaaggcgggctccctaaccgcaaattatgatcgttttatgacttggcgttctaaagatggagaaacggaatcatcatcaagtttagctagtttagatgtgctgattcatgggatgctaaatccagaaaccttacttgatttaattcgatattttgtcttattccaagatgatggtaaaggacatatcagtaaaattctagcagcgtatcatcaatactatgctgttaataaagctgttgatagagctttattagcttcatctgggcagggtgatggtaaaggcggcgttatttggcatactcaagggtctggtaaaagtttaaccatggtctttttctctggaaaattaattcaaatgcttaataatcctaccttagttgtcgtaacagatcgtaatgatttagataaccaactatacagtacgtttgttaaatcgaaaggacggtctggtaaaggtttattaagacaaacaccaaaacaagctgaaacacgtaaagaattaaaatcgttattatctgttgagtcgggcggtattgtatttacaacgatgcaaaaatttgaacctgaacaaaacgaaacgaccatgtctgctctaacagaacgtaaaaatgtgattgttatggcagatgaagcgcatcgtacacaatatggttttaatgcaaaatacgatgataaaggggaaggcattaaatatggttatgcgaagtatttaagagatgctttaccgaatgcgacgtttgtaggatttacgggcacgcccgtagcttcaacggataaaaatacgcaaatggtctttgggaactatatcgatgtttatgatatgacacaagccgtagctgatggaagtacggtgaaaatttactatgaaagtcgcataattccattaaatttacctcaaaatttagacttagacgaagcatataatgacattacagaggatcaagaagaggatgtaaaacagcgtttaaaatcaaaatggtcacgaattgaagccttagcaggcgcaaaacctcgtgtagaagctttagccaaagacatcatccaacattttgaaacacgtcagcaagcgatgaaaggtaaaggaatgatcgtaacgatgagtcgtcgaattgctgttgatttatacgatgaaatcattcgtctaaaaccagaatggcattcagatgatgatgataaaggggtcattaaagtggtgatgactggctcatctatgcacccaatttctttccaaagacatattggtcctaaaaaacgtcgtaatttattagaaaaacgtatgaaagatatgaatgatgaattacaactcgtgattgttcgagatatgtggctcacaggatttgatgtaccttccatgcataccatgtatatcgataaaccgatgaaaggtcataatttaatgcaagcgattgctcgtgtcaatcgagtgtttaaagataaaccgggtggattgattgtcgattatgtgggtatcgctgaaagtttaaaagaggcacttaaagaatatacagaatctgatcaagcacaaacggcgatagatacagataaagcggttgaattgatgttattgaaatatgatgtgattcaagatatgttatataatcttgactattctaagtttaattcagagaaaaagtctgaacgttattatgcgatttcagatacgatggattatgtgattggtttaggcgaagatgaacgccagcgttttattaaaacggtcacagagttagggaaagcttttgcgctttgtgcgactgaacctacagcccaagaactcaatgatgaaattgccttctttaaagcagttaaagcaggacttgttaaattgttacaaccgccaaaagaaggaaaaacacgtaaaacacctgcagaagttgaagcagagattaatcaacttgtgtcacaatctgttgtgacagaagatgtgattgatgtttaccaaacactaggtcttgaacaacccgatttatcaatcctatcagatgacttcctaaaagatgtcgaaggattgaaacaaaaaaatgttgcggtagaattattaaatcgattactcaaagggcaagtaaaatcattaatgaaaacgaacgcgacagtatctaagcgtttctctgaaatgttaggaaattcgattaataaatataatagccgttctattgaaacatcaaaagtgattgaagaactcattcaactcgctaaagatattaaacaagaacaacaacgaggaaatgaattaggcctgaattcagatgagattgcgttttacgatgctttagcttcacatgaaacagcaaaagaagccatgggagataaagaactacgtgcgattgctcatgagctaactaaaacagtgaaagaaaacatgggtgttgattggtctaaacgcgatagcgcaaaagctaaaatgcgcgtagctgttagacgattgcttaaaaaatatggctatccaccagatttacaaaaaatggctgtagagcaggttgtagagcaagcagaacttatggcgagtaatcagtaa

SEQ ID NO: 3072 - DNA, 339 bp, Staphylococcus epidermidis
aagagtcagaacgaaaggaagtctcttatgaatagatatattactcaaggtattgccaataacttacctatcatcttacaacaacaattatggaaaatagtagcacaacgtgaaaacgaacagtccaaggaactagaagcaatagattactttcatatcttccagttcaacatgcataatgatcaattatatatcaaacacaaacaagaacgtcctgagtacatcaaaacacataaagctaattattcaaaagctatcaatataaataaggtctatattatccgagaagatgatgtagacctttcttattacgtcatgttactaccggaagaatactag

SEQ ID NO: 3073 - DNA, 249 bp, Staphylococcus epidermidis
cttattaagaagatggatgaagataaaggtaccggaaaaatattatcttcattgtatataaaagacgatgaattaaaaaaacaatattctacatgtagagaatttctagatgattatttatatacagcatggattattcctgttttgctgaatgaacatgcaacaagtcaattagaggaatatttaggtagatatttaattaaccaaaacgtaccaatccttaatttactttcacatactttcaaataa

SEQ ID NO: 3074 - DNA, 147 bp, Staphylococcus epidermidis
aacgtcaagaaagcatgtgagttttgtttaattagagcattgagagcattgaacgaaatgattaatatcattcttagtccaataaacatgaatgtaaaaaagctttctaactcatatctatcaatatttgcagtgaatcatatttaa

SEQ ID NO: 3075 - DNA, 183 bp, Staphylococcus epidermidis
atagttgagaagctaaaaactttacttaacctttctcatttcattttcctatacacggtttcaagaacccaacatactacaaacgaatttcaaaaggtgagagtaaagctgacttgttttttttacggatttaaaatcctagagtctggacagtctactcctctctataactataaaaaatag

SEQ ID NO: 3076 - DNA, 1947 bp, Staphylococcus epidermidis
agtaacgagaaagtgatggtgaatacattgtcagatgtaaacaacacagataattatggtgctggacagatacaagttttagaaggtctcgaagcggttcgtaaaagaccgggtatgtatattggttcaacttcagaaagagggttgcaccatttagtatgggaaattgttgataatagtattgacgaggcattagcaggttatgctagtcatattgaagttgtaattgagaaagacaattggattaaagttactgacaatggccgtggtattcctgttgatattcaagaaaagatgggacgccctgctgtcgaagttatcttaactgtacttcacgctggaggtaaattcggaggtggcggatacaaagtatctggcggtcttcacggtgttggatcttcagttgttaatgcactctcacaagatcttgaagtttatgtacatcgtaatggcacgatttatcatcaagcctataaacaaggtgtgccacaatttgatcttaaagaaattggcgatacagataaaacaggtacagctattcgattcaaagccgataaagaaatctttacagagacaacagtttataactatgaaacacttcaaaagcgtatacgtgagcttgctttcttaaataaaggtattcaaattactttaaaagatgaaagagaagaggaagttagagaagactcatatcattatgaaggcgggattaaatcctatgtagatttattaaatgagaataaagaacctcttcacgatgaacctatatatatccatcagtctaaagacgatattgaagtggaaattgcacttcaatataacagtggatatgcaaccaacttattaacgtatgcgaataatattcatacatacgagggtggtacgcatgaagatggctttaaacgtgctttaacacgcgttttaaatagctatggtacgcaaagtaagattattaaagaggataaagatagactttcaggtgaagatacacgagaaggtttaacagcagtcgtatcaattaaacatggcgatcctcagtttgaaggacaaacaaaaacaaaattaggaaactctgaagtacgtcaagttgttgatagattattttctgaacactttgaacgtttcttatatgagaatccatctgtaggacgcattattgttgaaaagggtattatggcttcacgcgcacgtgtggctgccaaaaaagcacgtgaagttacgcgtcgtaaatcagcattagacgtttcaagcttaccaggtaaattggcagattgttctagtaagaaccctgaagaaagtgaaattttcttggtagaaggtgactctgccggggggtctactaaatctggtcgtgattcaagaacacaagccattttacctttaagaggtaaaattttgaatgtggaaaaagcacgtttagatcgtatcttaaacaataacgaaattcgtcaaatgattactgcatttggtacgggtattggaggagaattcgatatatcaaaagcacgttatcataaaatcgtaatcatgactgatgccgatgttgatggtgcacatatacgtacgttattacttacattcttctatcgtttcatgagacctttaattgaagcgggctacgtttatattgctcagccgcctttatataaactaacacaaggaaaacaaaaatattatgtatttaacgatagagaactagacaagttgaaacaagaattaaacccgtcaccaaaatggtcaattgcacgttacaaaggtcttggtgaaatgaacgcagaccaattatgggaaacgactatgaatcctgaacatcgctctatgttgcaagtgagacttgaagatgcaattgatgcagaccaaacatttgaaatgttaatgggcgatgtagtagaaaatcgcagacaatttatcgaagacaatgcagtttatgccaacctagatttctag

SEQ ID NO: 3077 - DNA, 153 bp, Staphylococcus epidermidis
tttgtctggaattgtgtcaagaaatcggacaaaaatccatgtataatgaatgatcttactatctataaacaactacaatcaaatatagagtggaatgtcaacagttttttagacacttttcatgtgtatatctttatacgccattggcgttaa

SEQ ID NO: 3078 - DNA, 792 bp, Staphylococcus epidermidis
atgaactggaaacttacgaagacacttttcattttcgtttttattcttgtgaacatctttttagtcatcgtttatattgataaagtgaataaatcacaagttaatgactcggaaaaggtaaacgaggtcaattttcaacaagaagaaattgacgttcccaaggatgtcttgaatcaaagcgtgaaagatactgaacttgaacaaattactgcccgttcaaaaaatttctcaagttatgcgaaagatcattcaagcctgcaaacgtctgattccgataaaacacttgaaggagatattgataaaggcgttcaagtgagtgataagaacttacaagatatcaaagagtacattgcaaagaaaatctttaacggtaaagagtatcaattaagtgatttaactaaagacaaagtcacttacgaacaaacgtataaagattatccaattatgaataatagtaaagcacgcctaacgtttaatttgagcgatggcaaggcgacaagctataagcagacagcgatggatgatatacaagtagctaaaggttcaaatagcacgaagaaacaagtcatcacaccgcgtaaagctattgaagccctttattacaacagatatctaaaacaaaatgatcaagtgctagacgcacgcttaggctattattcagtggtaaaggaaacaaatgttcaattactccaacctaactgggaaattaaagtaaaacataaaggcaaggatgaagttcaaacctattatgtagaagctacaaatcataatccgaaagtgattgattattag

SEQ ID NO: 3079 - DNA, 186 bp, Staphylococcus epidermidis
atccaccgtttagttaagatgatggattttttcaaactgtggatgaggtacagagtttcattagataaaaacagggaaaacttattaaagagtgatttctgtgaggaggataatgatgacaaagaaatacgatcttattgtgattggtacaggttctgcggggtcaatcacagcagcaaaatgtaa

SEQ ID NO: 3080 - DNA, 915 bp, Staphylococcus epidermidis
atgaattatgaaaaaaatgaaagggagggcatattttatatgaatcaacttaaacatattttatcttcattgttcgaacctttaacaaaggttgaaacatatgaaaatttaattactaaagtaataatgattttaatttatatccttgtagcgattgttgttatagcaattttgaataagattattgagcaagcatttaaaattcaaaataaaagcaaaaaaggaaataaaaaacgttcaaaaacactgatttctcttgtacaaaacatagtaaaatatatcgtatggtttgttgttatcacaacaattttaagtaagtttggtattagcgtcgaaggtatcatcgctagtgctggagttgtaggtattgcagttggtttcggtgcgcaaacaatagtaaaagatattattacaggtttctttattatctttgaaaatcaatttgatgtgggtgactatgttaaaatcaatagttcaggaactacggtagcagaaggtactgtgaaatctattggtttaagatcaacgcgaattaatacaatttcgggagaactgactattttacctaatggtagcatgggggaaattacgaacttttcaattacaaatgggactgctattgtagaactaccagtatcagttgatgaaaatatagatcaagttgaaaagaaactcaatcgtttatttgtttctttacgtagtaaatattacttatttgtcagcgatccagttgttgatggcattgatgcgatagaatctaataaggttactatacgaatttcagcggaaacaattcctggtgaaggattttcaggcgctcgtattattcgtaaggaagctcaaaaaatgtttagacaagaaggtattcgcatgccacaaccagtcatttcaaattataatgaagaaaaaagctaa

SEQ ID NO: 3081 - DNA, 213 bp, Staphylococcus epidermidis
aatacatatgaggtgtttttcatgagattaaatttagattggaataaagatttccaagagtttcaagatatcttaaatagtggcattcacccagaatggctatactgcgctaaagcaaatttagttctcgaacccgcatacactggtgaaggcaaacaattttttagtacacaagacatcattaaagcaagcaaaatcattccatttttttaa

SEQ ID NO: 3082 - DNA, 927 bp, Staphylococcus epidermidis
ttaaaatatgaagggactttttcaatgttaactaaagaatttgctcaacgtgtagaactaagtgaaaagcaggtccgaaaaattgtacaacatttagaggaacgaggctatcaccttagtaaaacagaatatcgtggtcgtgaagccacagactttaaagaagatgacatcgaattatttacagatatcgctaacaaagttaaacaaacaaatagttatgatttagcatttgaagagcttgaaaaggaaaaagactttttacaagtcattgttaaagacgaggatagccaattaccaactgatcaaaatgtagcacaactcgttgaagatttacgttctgaaattcaaaaaatgcgagaagaacgtcaaatgttagggcaaatgattaaccaagttcatcagcaacaacaggaactcaaagaattacaaactgatatcacaacaaaattagattcgaatgctcaatctttaaaatcaatccaaaattctcaagaggttattcagtcagcacaagaacaacaatctaaagacatcgctaaagctaacgaattaaaagatagtgaattacgtagtcattttgattcaatgtcaaatagcgcttcaatatctcagagcaacgtcgcaagtcaaagcactacagcaagtttgaaccaatctgaatcagcaaatgattcaatgagttcatctctgtccgagtctaactcaataacatccgaaagtaatacaaatagcaaatcggaaattgaatcaaaaagtacgtctacaagcgagttcttgtcagaatcaggaagtgtatctaactcagaaaaatctgagtcaatttctcattctcaatcaacatcagctacaccttcttctcaatcgacttaccaacaacaacctaaagaagagaagaaaggtttctttgcacgtctatttaacttataa

SEQ ID NO: 3083 - DNA, 126 bp, Staphylococcus epidermidis
aatttccatgatgatgtgcatggccactatgatgattatgtgattcatggttatcatgatgcatgtgattggaatgattcatgtgattttgatgattatgctcttcactattattattcaaattaa

SEQ ID NO: 3084 - DNA, 363 bp, Staphylococcus epidermidis
ggaggcaatgatatgaaaacaactactcaagaactcaaacaatatatgactcgcttattccaattatctaacaatgaaacatgggaatgtgaaacactggaggaagcggcagaaaatattctacccaaacgttttattaatgattccccacttgcacatcttatacttgaaacttatacctactataataatgagctacatgaactaagtatctatccatttctaatgtattctaataaccaactcatcagtattggttatctggatcattttgatatggactttctatacctcacagatactaaaaatacgattatcgatgaacgtcatttactaaaagaaggagggaataaccatgaataa

SEQ ID NO: 3085 - DNA, 777 bp, Staphylococcus epidermidis
ataatgaatgatttgttaaaaatttatgaaaaattgaaaaaagatattgaaaacaggtggttaataccatttcattatgtggtttttggattagcattagttgtatattttctggaaattcctatttataaattggtgaataacttagataaagagcttgttgataaggttttatatgctttttcattagtgtatgatcacattgtattgatatttatattaattataattatcattttgatagtttatttattctttgatgtgtttaatatgaatcgttttgttccatcgcctacaacttatgtagatggtagtgaaagttctataaactatgtaagtgctattaaaagattgataaactttatgatattaattatcacaaagtactggataacttactttattgtaaacttaatatttcataatgataaattactgtatttaaacaatgattcaaaacatttgtataagtgtctcttgtttttaaatatctgtatctttatagtgcatatattaaaatcaatttttataataaaaattatggcagatgattcgctaagacttattaatgaaaatgatttaactgatttttacataacattaaataaaaatgatgaatatcgtatggtaaaacctaaatatagaaaaatagataattttattattattaaaaaaagtgaagatttcactaattcaaatgagtataaagttattaataaaagtaaaaattttgaggaaataatttatcattttgacaatcttacttcaaatcattga

SEQ ID NO: 3086 - DNA, 138 bp, Staphylococcus epidermidis
gaccatcgtgatcgctgtcaccacaattcccataccaagggagtagatgatgaacttgatgatcacggccgttacgctattgtcattcagcgatgcagagaccaccaacataaaggctggcaaggtacaaccaagtga

SEQ ID NO: 3087 - DNA, 177 bp, Staphylococcus epidermidis
tctaacagtgacaattctcggaggtatatttgttattgcttgcttacgtttaatcttttaatctttggaaatcatatcaaatcattgaacttacagaaaaagttagttaaaattaaaataattagaaaatttagactattagagacgaaatgcatttctacatcacaatacaattaa

SEQ ID NO: 3088 - DNA, 1191 bp, Staphylococcus epidermidis
agtaggagtgatttcatgagtttatctaaagaaacagaagtaatattcgatgtgcgtagaggtaatgactacgactcagctaacccgccactttacgattcatctacattccatcaaaaagtgttaggcggtgagactcaatatgattatgcacgaagtggtaaccctaaccgaactttacttgaagagaaacttgcacgtttagaaggtggtaaatatggatttgcttatgcttcaggcattgctgcaatttcagccgttttactcacattaaacgcaggggatcatgttattttacctgatgatgtttacgggggcacatttagattaactgaacaaatactcaatcgattcaatattgaatttactacagttaacgctacacatatagatcatatcactgaagctattcaatcaaacacaaaactcatctatgtagagacgccttcaaatccacttttcaaaattacagatattcatgctgtagcaacgctagcaaaggaacataagatactattagctgttgataatacgtttatgacacctttgggtcaatcacctttagcactaggcgctgacatagttattcatagtgcaactaaatttctaggtggacatagcgatttaattgcaggtgcagcaattactaataatagagaggttgcaaatgcattgtacttattacagaacggcacgggcacagccctttctgcatatgatagttgggcacttgcaaaacatcttaaaacattaccagttcgttttaaacaatctgttcataatgctgaacgccttgttcaatttttgagtcaaagagaggagatttctgaggtgtattacccgggaaataatcttacacatctcaagcaagcttcaactggaggtgcagtgataggtttccgacttaaagatgaatctaaagcacaaaagttcgtcgattctcttactttaccacttgtatcagtgagtctcggtggtgtagaaactatcctatcacatcccgcaacaatgtctcatgcagcagtgccagaagatgtgagacgtgaacgtggcatcactttcgggttattccgtttaagtgtaggtcttgagaattcagaagaactcatcgcagattttaactacgctttaaaggaggctttcaatgagtcatttactgaaccaattaaagagcaacgttttagtagctga

SEQ ID NO: 3089 - DNA, 660 bp, Staphylococcus epidermidis
aagaaaggtgacaaaatgaaacagctattatttaaaacaagttgcgtaataatggtacttctcacgtcttctttaagtattgtcagtacatattctcatgcaacaacgtcaggaggaacgagtagttccagtttggcaagttctagttcaagtagcagtgcagcttctgcatctagaggttcaacttcttcaagtacaagtatgagtcgttctagtgcaataaatgcgtctcgcaatgcacaacaatctagtcagcgtgctgcccaacaagcaacaaaatcaagtcgtgtaacagcaaccaaaaataaaggacaacaaagtgtatcaagacaaaaagcacaatctcgttctttgatgccgtctcaaagaccttatgattcaagtgcaccatactcatctcaatatattgctacaacttattataataattggttattctattatatttttgcacattcgtttttaaatcaacatgaaaagaaaaacagtgtagatgctcagtttaatatgttgaaacaacaaatgaagcctcatgagaaactttatactgttactgtaaagactaaacaaggaaagcgtgtcgttgttgtacctaaaaaacaatatgacaaaattgaaaaaggaaaacacattaaagttaaaaatggtgttgttcagtaa

SEQ ID NO: 3090 - DNA, 129 bp, Staphylococcus epidermidis
cacgggttcgagtcccgtaggagtcaccattctaggtcccgtagtgtagcggttaacacgcctgcctgtcacgcaggagatcgcgggttcgattcccgtcgggaccgtattgcctacccaatagggtag

SEQ ID NO: 3091 - DNA, 129 bp, Staphylococcus epidermidis
aatatcgtcgaaggatatgtatctaaaaatctagctttcaaattcactgctttttctgccctttttaaatattccaaaacacaaaaacaaccccgtaagcctatacttacggggttttacaataaataa

SEQ ID NO: 3092 - DNA, 129 bp, Staphylococcus epidermidis
ttacctttagacatctcgacggtttggttacgcatatcggttatcggcttagtaatcgttcgtgcaatgaagaatcctagtatcactgtaatgaatagtgatatcgctgtccctacgatgaatatctga

SEQ ID NO: 3093 - DNA, 126 bp, Staphylococcus epidermidis
aatatgttagaaaatatcattgattattataaggattacttttatcctagagaaaaaataaagcataataatgttgagtgcaatgtatcattgttttttaaagctgtagatgcttttaagaaatag

SEQ ID NO: 3094 - DNA, 765 bp, Staphylococcus epidermidis
tacgagctagaggtgaggcaaatgtcacagtatccactttggaatcaattaaatactttaaaagaggctcagtgggtcgatttaacacatactttcgacccaaatatccctcgttttagcgaatttgaaaaaggtgaagtctcaacgctattcaatgttaaagatcatgggttttatgtacaacgttggagtatcgtaactcaatatggaacacacattgatgctccaatccatttcgttgaaaatagaagatatttagaagaattagatttaaaagaacttgttttaccattaattgttttagattattctaaagaagctgcacaaaattcagattttatcgtatcacgtaaacatttagaagactgggaacaacaacacggtcgcattgaagcaggtacttttgtcgcattacgtactgattggtcaaaacgttggccagatatagaaaaatttgaaaataaagatgtagatggccatcaacatcttccaggttggggccttgatgcattaaaatttctcattgaagaacgtggtgttaaatccataggtcacgaaacatttgatactgatgcctcaattgatacagctaaaaatggtgatattgttggcgaaagatatatcttaggtcaagacacattccaagtcgaattacttaccaatttagatcaattacctaccagaggtgcaattatctatgcaatcagcccaaaaccaaaagatgcaccaggctttccagttcgtgcattcgcaataaaaccttaa

SEQ ID NO: 3095 - DNA, 870 bp, Staphylococcus epidermidis
attaagatagaaagatgtggaaaagagatggcatatacagatgatcagaggttgaaaatgaataatgatgatagtgtgcaatttattgaactagaattaattagacctaatccttatcagccacgtaagacgtttgaagaagaacgactcaatgatttagcttcatcaattcaacaacatggtatattacagcctattgtattacgtcaaactgttcaaggttactatattgttgtgggtgagcgacgatttagagcatctaagttggcgggattaacagaagtgccagctattattaaagaactatctgatgaagatatgatggaattggcaattattgaaaatttacagagagaagatttaaatgccattgaagaagcagaaagttataaaaaaatgatgacagatttgaatattacacaacaagaggttgcgagacgattaggtaagtcacgtccttatattgccaatatgcttaggttattacagttacctaaaaatgttgctcaaatggttcaacacggggcgttatctagtgctcatgggcgtacgttattaactttgaaagacgccagtaaaataaaaaagacggcaaaacaagccgctcaggagtcttggagtgtaaggtatttagaggagtacgtcaatggtttagtcagtaaagacatctcaaggaaagttgacaaagagactaaggaaagtaaacctaaaatgattcaacagcaggaaagatttttaaaaaagcaatatggtgcgaaagtagatatttcgacatctaaaaatgtcgggaaaatcacgtttgaatttaaatctgaagcagaattcaaacgcttgattcgtcaacttaataaagattataaggaatattaa

SEQ ID NO: 3096 - DNA, 162 bp, Staphylococcus epidermidis
aataggtcagataaaaaaccttatttatcaagtgttcacataagcttttttagaagtttaagaataaagatatctgctcttcacgccaagaagccacattcttccgttgaaaaatgtggctgtcaaaaaagttattttctttttgattctaagatcatataa

SEQ ID NO: 3097 - DNA, 138 bp, Staphylococcus epidermidis
tataaacaagaaattaaaaaatgcatgagacatagctatgtctcatgcattttagcgtattggacgtcgatgactgagttagaacataacctcattacatctctagtccgacttccttatataaacttttgttcataa

SEQ ID NO: 3098 - DNA, 561 bp, Staphylococcus epidermidis
cacataaaagaagggataaacatggctggaagaccaaaagatccaacaatcaataaaaaaatttatactgagattcaacgtttattggaaacgactcattttagagatattactatagatcaaatttctgagaatactggtatttctaaagcaactatttatagacgttggaaggataaatcttcaattatcatgtccgcgtttattgaacaatctcaatatattgtgattcataatcaagataatttatatgatgatttattccagtttttagtgaaaataaaagatatctataaaacaaaactaggtagtgctgtgattgaaatattaattagtcatcaacaaatggaagctagagaaacttttatgactaattactttaatcataatcgcaaagttttaaaagagattgttcgtaagcacatacaagaggaagaacaagatttgtttattgatttaatcttctcacccatctattttaatatattaattaaacctgaaactctggataaaaattacattaaaaagatgttgaatcaagttttacgtatatatcattga

SEQ ID NO: 3099 - DNA, 186 bp, Staphylococcus epidermidis
tatctcatggaggtattcgaaataagaagccgtgaaaaatcattaatactttgttctcaaatgacttccgtagaatggcataagaaattaagtggaaaagtcatcgcttatgcgattttaattcgtgctgtatcaaagtcatttaaaatatttttagaagtagagtcgttgagaaaaattaaataa

SEQ ID NO: 3100 - DNA, 354 bp, Staphylococcus epidermidis
tgtttaatggaaaaagcatatcgtattaagagaaattcagactttcaagcgatatacaagaatgggaagtctgttgcaaatagacaatttgttgtctatacctataaaaatagagatttaaaacattttcgcttaggaataagtgtctcaaaaaaactgggcaacgctgttacaagaaatagaattaaaagagcgataagagagaattttaaagtgcataagcaaaatattatcgctaaagatattatagttattgcgaggcaaccagcaaaagatatgaatacactggagattcaaagcagtttagagcatgtgcttaaaattgcaaaagtgtttaataaaaagattaagtag

SEQ ID NO: 3101 - DNA, 159 bp, Staphylococcus epidermidis
attcagatggaggtgttttgcatggtaaaacgtacttatcaaccaaataaacgtaaacatagtaaagttcatggtttcagaaaacgcatgagcactaaaaatggccgcaaagttttagcgcgtcgtcgtcgtaaaggccgtaaagttttatctgcataa

SEQ ID NO: 3102 - DNA, 144 bp, Staphylococcus epidermidis
catttagtggagcacggtttttatatcataaaagtgtgtattaaaaaagctataaacgaagtcgttttaaaaacttcgtttatagctttttacttagttagaaagagttcattgctattcaaatattatgatgatgaacattga

SEQ ID NO: 3103 - DNA, 651 bp, Staphylococcus epidermidis
tacgtaaaggagatatattacatgagtacacaggaattaaaagaaaatgatattcagaactcaagtattccatttgttaatcattttaacaaactaagacatcagccaaaatggatacttaaatcaatcatagtgatagtattagctattattagcgctttcatcacatataatactagcaatgaactattagataaccaatcgatagctaatagccaaatggatgaaaatatgttacgtatgactacaactataggtgctttcataggaacaatctttagtgttgttgttgtatttttaatctttctagttatttctaaaatatttaaatctgacgccaaagcgagcagtttattctcagcagcactctcttattcaatcattattttaggatttacaattattatttctttaattcaaatagtttttggactaaagataacagactataagcttgatagcttaaacattttttcaaaggataataaaacactcatggctttcagtttaactaatcttttaaaagcctttttaactggtgttgtttattactcaacaagtcgtttatctaaaaaaacatctatgatattaggaatcattgcactcatcatattaataggatcaggtatgctaggtggaatgaatggctaa

SEQ ID NO: 3104 - DNA, 450 bp, Staphylococcus epidermidis
acgatgaaggaaatcaatattgtttcactacaaatgataaaaacagatacattaagttatctaaaaaatcatatttcaaaccctgaggatgcggcagaaatcttgcgttcattcattggaaacagtgaccgagaacatctcattctcatatgtatgaacagtaaaaatgaacctacacatattcaaacactatcgattggatctattaaccaaacagtgattcaccctagagaaatattcaaaacagcgatactcagtaacgcaaatagtataatgctcggtcataatcatccaagtggggatataaccccctctcctgaagatatcaatgtaaccaaacggttaatgctcatcagtgaaatgatgggcattttattttatgatcatattattttttcagatagtaacacctattccattagacaacatgatttagaagtagaggtatag

SEQ ID NO: 3105 - DNA, 186 bp, Staphylococcus epidermidis
tgtagcagttttatttatttaattaaaaatattaatatagaaatagaacgtaaggtgacattacaagcagttaattataataatgttgaaattctctcgcctctcatccgagaaaaattgtatgtatatcgtcacaatgtatctactattacacagaacaaaatatttagtttcaacaagttgtag

SEQ ID NO: 3106 - DNA, 642 bp, Staphylococcus epidermidis
aaggagttactcaattctatgaaaaagagagtcattacatacttgatactagcgttgtctttaacacttgcagcatgctcaaatacgaacgataacaataatcaagagcatcacagcaacgctcatgcacctaaaaacgctaaaactttaaaggaaaaagatatcttttcttcaaacaaaaagggacaaaaaattagcgaaaaagagatgaagcaagctttagaaaaatatttacaagcgaatagcgatgtacttgataataagtatgtcatgcaacataaattagataaacaaagtgatagtaatcctaaaatcacagaatcacaagctgatcgtcttagcaagttatccaatttagcagttaagaacgatttacatttcaaaaaatttataaaaaacaatcacatccctgaagaatataaagatccaacagatcgcataattaattattttcacgctttaaatagtaccatttcaaatgtagatgcagacattgagaaattaaactaccaaccacaaaattcaattaacgttgttgatgtacccacaaaatattcaggtgatgtaaataaaaaacaacaagataaaattactactttccttaagaaaaaaggaatagacacagaagtatttaataaataa

SEQ ID NO: 3107 - DNA, 153 bp, Staphylococcus epidermidis
gaatatgtactgacaatacttaaagaagacgtgagaagtaccattattacgcaacttgttttaaataatagctgtttcattttgtcacctttcttttacttcgtaacttcatctttcgaaacggctttgccttcaacatcatcatcaccataa

SEQ ID NO: 3108 - DNA, 387 bp, Staphylococcus epidermidis
actacatcactattacactatctaggaggcaataatatgaaaaccatcactcaagaactcaaacaatatataacccacctattccaactatctaataacgaagcttgggaatgtgaagcgctggaggaagcagcagaaaatattctaccggaacgttttattaatgattctccactggtacatctcacactcgagacttatacctactataatgatgaactacatgagctaagtatctatccatttctaatgtatgccaataaccaactcatcagtgtcggatacttagaccattttgacatggactttctgtaccttacagatactcaaaatatcattattgatgaacgtcatttactaaaacaaggaggtcaggaccatgaataa

SEQ ID NO: 3109 - DNA, 213 bp, Staphylococcus epidermidis
aaaagagcacttgaaacagataatttgtattatttagcctatgtaacaactttagataattgttttaaatattaccaattaattacacaaaatgaacatttttgctattctcaacaagaagaaagagaaagttatcagcaaaaatttcaaagtatgattaatggtttaaaaattaaaattggcatacaaagttcaaatgatgatgcgcaataa

SEQ ID NO: 3110 - DNA, 159 bp, Staphylococcus epidermidis
cgatttaaactgctcttaatgtattggattgttactcatagtcgtgtcgtttatggcgacacggtagaaacttctaaagccatattctctagattatatgagtcatataaattattttatgataatagcaaatttttgttgtattttcaatataattaa

SEQ ID NO: 3111 - DNA, 123 bp, Staphylococcus epidermidis
agcatcaaactgaataatcgacgtattgaagatagaacaaataacggagtgaaaaacatggatgaacttatcgagatattagccgatttggtaattgaagaaatcaatcaaacaaatgactaa

SEQ ID NO: 3112 - DNA, 1119 bp, Staphylococcus epidermidis
acaatgaaacttaatacactccaattagagaattatcgtaactatgaacaggtgacattagattgtcatcccgaagtgaatatccttattggtgagaacgcacaaggaaagacaaatttacttgaatcaatttataccttagcgcttgctaaaagtcatcgtacgtcaaatgataaggaactcatacgtttcaagtctgattatgctaaaatagagggtgagctaagttatagacatggtacgatgccgcttacgatgtttataactaaaaaaggtaagcaagttaaagtaaatcatcttgagcaaagcagactaactcaatatattggacatttaaatgtcgtcttatttgcacctgaagatttaaatatcgttaaaggttcaccacaaatacgtcgacgattcatagatatggagttaggacaaatatctgctgtctatttgaatgatttagctcaatatcagcgtattctaaagcaaaagaacaattaccttaaacagttacaaattgggcagaagacagatacaacaatgttagaagtcttaaaccaacaatttgctgaatatgcactgaaggttacgttacgtcgagagcactttataaaggaattagaaacacttgcacaacccattcatgcaggtatcacaaatgatcgagagacactgacactcgattatgttccaagtttgaagttaagtaattatgaagccaatcaatctgagttaattgaagaagtattagcattgttaaatgacaatttacaaagagaaaaagaacgaggcgtatgtctctatggcccacatcgtgatgacttaagtttcaatgtaaatggcatggatgctcaaacgtatggttcacaaggtcagcaacgtaccactgcgctgtcaattaagttggcagaaattgaattaatgaatattgaagtaggagaatatccaatcttacttttagatgatgtcttgagtgagcttgatgattcacgtcaaacacatttgttaagtacgattcaacataaagtacaaacatttgtgacaactacgtcagttgaaggaatagatcatgaaataatgaataacgctaagttataccgtattagtcaaggtgaaatactaaagtaa

SEQ ID NO: 3113 - DNA, 390 bp, Staphylococcus epidermidis
attcaactttgcaacagaaccgtattatggaatagagatgttggtaacatttatacaggatcattatacttaagtttaatttcgttattacagaaccacacattccaaccagaagagaaagtatgtctatttagttatggttcaggagcagtaggagaaatctttagtggttcaatcgttaaaggatatgacaaagcattagataaagagaaacacttaaatatgctagaatctagagagcaattatcagtcgaagaatacgaaacattctttaacagatttgataatcaagaatttgatttcgaacgtgaattgacacaagatccatattcaaaagtatacttatacagtatagaagaccatatcagaacatataagatagagaaataa

SEQ ID NO: 3114 - DNA, 435 bp, Staphylococcus epidermidis
aggggagaacttatgcactggaaagaaaatagaataaaatcagccaaaaatgacacgaatccgatggtaatcaaagaattaaaaggtagttatgtggtttttggagatgttcagtttcttccaggttattgtgtattacttcctaaaagagaggtaagattattgaatgatcttactttagaagaacgacaagattacttattagatatgagctttgttggtgatgctatgatgaaagcattgaaacctacaagagtaaattatgaaatactaggtaataaaaatcactttcttcatgcacatttattccaaagatatgaatgggaagatgaatctgttaggtatatgccagtgtggtgtatgatgcttctaattggtctaatgaagaaacgtcttacgattctgataaacatgatgaaattagaaataagataa

SEQ ID NO: 3115 - DNA, 156 bp, Staphylococcus epidermidis
ctagattgttgtgcattgcgagacgcatttattgcactagaacgactcatacttgtacttgaagaagttgaacctctagatgcagaagctgcactgctacttgaactagaacttgccaaactggaactactcgttcctcctgacgttgttgcatga

SEQ ID NO: 3116 - DNA, 2277 bp, Staphylococcus epidermidis
atcaatcactgccaacaaggaggcaatattatgacaacaattaaaacttcaaacttaggattcccaagattaggtagaaaaagagaatggaaaaaagcaatcgaaaattattgggcacataaaattgacaaagcagaactagatcaaacactgactgatttacacaaagaaaatcttttacttcagaaaaattatcatcttgatagcattccagttggggatttctctttatatgatcatattttagaaacgtctttattgttcaatattatccctgaacgtttccaaggacgcgaagtcaatgatgatttattatttgatattgctcgtggtaacaaagagcatgttgcaagtgcacttattaaatggtttaacaccaactatcactacattgtacctgaatgggacaacgtagaacctaaagttgaaaaaaatacgttattagaacgttttaaatatgcacaatcaattaatgtaaatgcgcatcctgtaattgttggtcctatcacatttgtaaagttatcaaagggtggtcatcaatcgttcgaggaaaaagttgaaacattacttcctttatataaagaagttttacagtcacttgtagatgcaggtgcaaagtatattcaaattgacgagcctattctagtgactgatgacagcgaaagttatgaagacattactagaaaagcatacgactatttcgcaaatgaaggtttaggaaaatatctcgttattcaaacttactttgaacgtgttcacttaaaattcttaagttcattaccagtgggcggtttaggattagatttggtacacgataacggctataacttaaaacaaattgaagatggtgatttcgatcaaagtaaagcactttatgcaggaatcattgatggccgaaatgtatgggcggctgatattgaagcaaaaaaacaattaatcgaaacattacaacaacacacacaacagttagtcattcaaccttcatcatcacttctacatgttccagtatcactagatgatgaaacacttgatgaatctattgcagaaggattaagttttgctactgaaaagttagatgaattagatgcattgcgtcgtttattcaatgataatgacctgtcaaaatatgaacattacaaagcacgttatgaacgcttccaaagccaatcatttaaaaatcttgaatacgattttgaaagtgtaccgacacatcgtaaatcaccatttgctaaacgcaagcaattacaaaaccaacgtctaaatttaccagatttacctacgactacgattggttcattccctcaaactcgtgaagtccgtaaatttagagcagattggaaaaataatcgcattacagacgctgagtatcaagaatttttacaaaatgaaatcgctcgttggattaaaatccaagaagatattggtttagacgtacttgtacacggtgagtttgagcgtaacgacatggttgaattttttggggaaaaacttcaaggtttcctagtaacaaaattcggttgggtacagtcttacggttctcgtgcagttaaaccaccagttatatatggagatgtgaagtggactgccccacttactgtaaaagaaacagtatacgcgcaaagcttaactgacaaaccagtaaaaggtatgcttacaggcccagttactattttaaactggtcatttgaacgcgtagacgtacctagaaaggttgttcaagatcaaattgccttagccattgatgaagaagtgttagctttagaagaagcaggtatcaaagtcattcaagttgacgaaccagcattacgtgaaggcttacctctacgctctgaatatcacgaacaatatttagaagatgctgtacattcatttaaattagcgacatcatctgtgcatgatgaaacacaaattcatacacatatgtgctattctcaatttggacaaatcattcatgctatccatgatttagatgcagatgttatttctattgaaacttctcgtagtcacggagacttaattcaagatttcgaagatattaattatgatttaggaattggattaggtgtttacgatattcacagtccacgtattccaaccgaagaagagattactactgcaattaatcgttcattacaacaaattgatcgttctctattctgggttaacccagactgtggtctaaaaacacgtaaagaagatgaagtgaaagatgcattaacagtgttagtcaatgcagttaaaaagaaacgtcaagaatctgaatcaacaacagcataa

SEQ ID NO: 3117 - DNA, 129 bp, Staphylococcus epidermidis
aatgaaagactgcggaggctaactatgtcaaaaatcatgaacctcattacttatgataagcttcttaaaaacataacagcaattcacataaacctcatatgttctgatacattcaaaatccctttatga

SEQ ID NO: 3118 - DNA, 384 bp, Staphylococcus epidermidis
tctagtttatgtttaaattgcgcagctattttattctggcttatattaaaatcatctggagaagtcatttctaaagttgtattagtattagattgtgtaattgccgcgaagcaaagaatactaaccgtgaaagctgaaatgatagcaataactgtgagagacatcgcatttttcttcattctgtgcatgatagatgatgtaaagacaacgtctgtgatatttacacgaccatgtttgatatgttttagtgttttaaaaataagtgatacagaacttctaaagaataagaaagcaccaacaatagttaaaaaaagtatgctaaaaggtgtaatcaaagcagttgttaaggctttaaaaacaccaaacatttcagtagacatataa

SEQ ID NO: 3119 - DNA, 156 bp, Staphylococcus epidermidis
aatatattatgtctcattttcttcaatatgtacttatttatattttaccgtaatttactatatttagttgcagaaagaattttctcaaagctagaactttgcttcactataagtattcagtataaagaatatttcgctattatttacttgaaatga

SEQ ID NO: 3120 - DNA, 732 bp, Staphylococcus epidermidis
acaggattatggcggggattggccccatgttttaaagataggagtggaattatgagtttttcgtttctcttcattctgaccgctggaatggttgcggcctttaatccttgtggtatcgccttgcttccttcttatatctcctatttaattggaggcgaaacaaaggatcattcgttccgctatgcaatttttaaaggattagggcttggtggagcgatgaccacggggtttttaacgatttttgtattggctggtttgttgataggaggattgggaagcgcactaacagggatttttccgattctttcattggttatgggtatactcattgctttattggggttgggcatgctatttgggaagcatttgccgattaaaataggatcttttcaagtcaagccagggaaatggtctatctatttttacggaatagcctatgccgtgacatcacttggttgtaccttgccagcctttatgttggtggtctctgcatcgctgaatgacaatagcgtaacggccgtgatcatcaagttcatcatctactcccttggtatgggaattgtggtgacagcgatcacgatggtctcattgatttcacgacaattggtacagaagtttctgcacaactatatgggttctatccaaaaaatagcagctgttgtgattttcctctccggtttgtacatggcttattactggtatttcggttctggtggcatttgtacattttaa

SEQ ID NO: 3121 - DNA, 2124 bp, Staphylococcus epidermidis
gggggtatatgttatattataagtagctttactataacattttcattaggaggggttaatttgaataataatagtgaagagcataatcatcaaaatcacatgaatcattccaatcacatgcatcatgataaccatgaatcacataatcatcatagtggccatgcacatcatcatggaaattttaaagttaagttttttgtttcattaatttttggaatacctatcattcttttatcgccactgatgggtgttaacttaccttttcaattcacatttccaggttctgaatgggtagtgttaatattaagtacaattttattcttttatggtggtaaaccgttcttgtctggtggtaaagatgaaattgctgaaaaaaaaccaggcatgatgaccttagttgccctaggtatttcagtagcttatatttatagcttgtatgctttttatatgaataactttagtaatgcaactggtcatacaatggactttttttgggaattagcaaccttaattttaattatgctattaggacattggatagaaatgaatgctgtcggaaatgctggagatgctttaaagaaaatggcagaactgttacctaatagtgctattaaagttatggataatggccaacgcgaagaagttaaaatatcagacatcatgactgatgatatcgtcgaagtaaaagccggagaaagcattccaacagatggtattatcgttcaaggacaaacatctatagatgaatccctagtcactggagaatctaaaaaagtacaaaaaaatcaaaatgacaacgtcatcgggggttctattaatgggtctggaacaatacaagtcaaggttacagctgttggagaagatggatatctttctcaagttatgggacttgttaatcaagcacaaaatgataaatctagtgctgaattgttatctgataaagtagcgggttatttattctactttgctgtaattgttggcgtgatttcttttattgtctggatgctcattcaaaatgatgttgattttgcactcgaacgtcttgtaactgtgttagtcattgcttgtccacatgctttaggattggcaatacctttagtcactgcacgttctacttcaattggtgcacataatggtttaattattaaaaatagagagtctgtagaaatagctcaacatatcgattatgtaatgatggataaaactggtactttaactgagggtaacttttctgtgaatcattatgagagctttaaaaatgatttgagtaatgataccatattaagccttttcgcctcattagaaagtcaatctaatcacccattagctataagtattgttgattttgcgaaaagtaaaaatatttcatttactaatccacaagacgtgaataatattccgggtgtcggattagaaggtctagttgataataaaacatataaaataacaaatgtctcttatcttgataaacataaacttaattatgacgatgacttgtttactaaattagctcaacaaggtaattcaatcagttatttaatcgaggatcaacaagtcattggcatgattgctcaaggagatcaaattaaagaaagctcaaaacaaatggtagctgatttactatcaagaaatattacaccagtcatgcttacaggtgacaataatgaagtggcacacgctgtcgcaaaagaattaggtattagtgatgtccacgcacaactcatgccagaagataaggaaagcattataaaagattatcaaagtgacggtaataaagtcatgatggtcggagacggtatcaacgatgcgccgagtcttataagagccgatattggtatagcaattggtgcaggcacagatgttgcagtggattcaggtgatatcatacttgttaaaagtaatccatcagatattattcatttcttgaccctttcaaataatactatgagaaaaatggtgcaaaacttatggtggggtgcaggttataatattgttgctgtacctttagcagctggcgcattagcttttatcgggttaatattatcaccagctgtaggagcaatattaatgtctttaagtacagttatagtagcgattaatgcttttacattaaaattaaaataa

SEQ ID NO: 3122 - DNA, 144 bp, Staphylococcus epidermidis
ataactgtgtgtatagcgcatgtgttatccacaatttttgcgagaaattatgtgtataagtggataacttcaaataagcgtcacaattccttcttttttactttgggaaataatttatatggattgcatgaactatgtatatga

SEQ ID NO: 3123 - DNA, 132 bp, Staphylococcus epidermidis
tttaatcttcgacgtaagaattattctgatacattagtagatgataaaacatggatagacttagatatggatactttgcttcataaaattaattttaactatacagttatcggagaaatgaactccctataa

SEQ ID NO: 3124 - DNA, 510 bp, Staphylococcus epidermidis
atgttaaatcgagttgtattagtaggtcgtctaacgaaagatccagaatacagaaccacaccctcaggcgtaagtgtagcgacatttactctagcagttaatcgtactttcacgaatgctcaaggggaacgcgaagctgactttattaactgtgtagtcttccgtagacaagcagaaaatgtaaataactacttgtctaaaggtagtttagctggcgttgatggtcgcatacaatcacgtagttatgaaaatcaagaaggtcgtcgtatttttgttactgaagtcgtatgtgatagtgttcagttccttgaacctaaaaatgcacaacatggtggccaacgttcacagaacaataatttccaagactacggtcaaggatttggtggtcagcaatcaggacaaaatacatcttacaacaacaataattcatcaaactcaaatcagtcggataatccgtttgcaaatgctaatggaccgattgatatcagtgatgatgatttaccattctaa

SEQ ID NO: 3125 - DNA, 153 bp, Staphylococcus epidermidis
ctttacggtcgtcttaacgttatttttacaattattccctatatttcagaccttttagactcacttactacaaatatcatcattgatatcctagttttccacacgcatctttttaaccctaaattaatatcatcattatgtttatgtaagtga

SEQ ID NO: 3126 - DNA, 123 bp, Staphylococcus epidermidis
atatgtatgcttattctcatattcaaattattcaaatatattccttatcatgtattagattctattttttatattatttttgtaattctttgtataaacctatttatttataaagcgctctaa

SEQ ID NO: 3127 - DNA, 183 bp, Staphylococcus epidermidis
aatattatacgtttatctaatataaccgctctttcattgagtgacgcaatacaagttttctttgctatggttaagatgttattaggtacatttaatatgattattaatgttgatatttgctatttggatattttattgcacagaattttttaccgttatactattaaagataatgcactgtaa

SEQ ID NO: 3128 - DNA, 354 bp, Staphylococcus epidermidis
atgaaaaaacgcatttccttcaccgctataatgacggtgttgttaatcggtttaacagcttgtggagcagaatctgataccgcgaatgaatcaaaggttcaagacattcaaggaaatccagtcagcctacctaatgagaaacccacactcatttattttatggcaacctggtgtccatcttgtatatacaatgaggaaatctttaaggaaattcatcaactaaacccgaacgatgttcaattgatcacagttagtttagaccctaacacagatacaaaagaaagctttgcgaaatttaaacaggattatggcggggattggccccatgttttaaagataggagtggaattatga

SEQ ID NO: 3129 - DNA, 210 bp, Staphylococcus epidermidis
tacaatttgcgcaatagacttaaagaattacgagcccgtgatggatataaccaaacagagcttgctaaaaaagctggaatatcacgacaaacggtgtctttaatagaacgcaacgattttacaccatctatattaaccgcaataaaaattgcaagaatctttggtgaacctgttgaagatatctttattatggaggaggaagacttttga

SEQ ID NO: 3130 - DNA, 138 bp, Staphylococcus epidermidis
atgtatattttttatttaaagcaagtgtttttagttcattttcaaaatcatttaaagatttcgcttcataatatgcaaattccatttatttcactccctgttatttttcccatttattcgtttcatgattataagtga

SEQ ID NO: 3131 - DNA, 237 bp, Staphylococcus epidermidis
agaaaaaagctaatcatcattggaggtcatttcatgacgtcaaagtatggaataaatgatatagtagaaatgaaaaaaccacatgcatgtggaacaaatcgttttaagattattagaatgggtgctgatattcgtattaaatgtgaacattgtcagcgcagtgttatgattccacggcaagtgtttaataagaaaatgaaaaaagttcttgaatctcatcaagacaaagaaagttag

SEQ ID NO: 3132 - DNA, 243 bp, Staphylococcus epidermidis
tcattgcttagaaagaaagtgatgcatttgatgatgatagatcataatggaatttttctatgtaaatttggtaatataatgtggaatgtgtttactgcaattaaagtatgtaatactcatttaaatacaatgaaggtaagagataaactcttaaataatagatttgaatatccaaatataatgacaataagaaaagaaggtttgcttcttccctcatttttagaaaagtataagttatattaa

SEQ ID NO: 3133 - DNA, 1989 bp, Staphylococcus epidermidis
aaagtgattagaggtggaagaatgaaccgtcaatccactaaaaaagctttgctcataccgtttattttaatggtactcactgccatagcacttgtcgtcgtgtggtttatttttaaccaactagtggcaggtattgctacagctatactcattgtgatgattattattagtggcgtgttattgagaaaagcatttctaaaaatggataattatgtggatgatttaagtggtcacatctcggcaagtagtaataaggcgattaagcacttgcctatagggatgattgtgttagatgaagataatcacattgagtggatgaaccaatttatgacagatcacattgaaacgaatgtgatttctgaaaatgtcaatgaagtcttccctaacatcttaaaacaactggaaaaagttcaagaagtagaaatagaaaacaacaattattattatcatgtacgatattcagaaaacgagcattgtttatacttctttgatatgactgaaactgaacgtacaaatgaactatatgaagattccaagccgattattgcaacaatatttttagataattacgatgaaatcacacaaaacatgaacgatacacaacgttctgaaattaactctatggtgacacgtgtgattagtcgttgggcgcaagattacaatatttacttcaaacgttacaactcagatcaatttgtagcttactttaaccaaaaaatactggctgaactagaagattctaattttgaaatcttaagccaattaagagagaagagtgtgggttaccgcgcacaactaacattaagtattggtgtaggtgaaggcactgagaaccttattgatttaggtgaattatcacaatctggtttagacctcgcgttaggtcgtggtggtgaccaagttgcaattaagaatatgaacggcaatgtaagattctatggtggtaagactgaccctatggaaaaacgtacgcgtgtacgtgcgcgtgtgatttcacatgccctcaaagatattcttactgaaggcgataaagttatcgttatgggacataagcgaccagatttagatgctataggtgcagctatcggagtttcgcgctttgcatcaatgaataatttagaggcatttatcgttcttaatgattctgatattgatccgacattacgtcgtgttatggatgagattgataagaaaccggaactaaaagaacgctttgtaacatcggatgaggcttgggatatgatgacttctaagacgactgtcgttgttgtagatacacataaacctgaaatggtcttagatgaaaatgtcttaaataaagcaaaccgcaaagtagtcattgatcatcatagacgtggcgaaagctttatttcaaatccattacttgtgtatatggaaccttacgctagctcaactgctgagctcgtaacggaattactagaatatcaaccaactgaacagagattgactcgtttagaatcaactgtcatgtatgcaggtattatagtagatacaagaaactttacgttaagaacaggttccagaacatttgatgctgcaagttatttacgtgcacatggcgctgatacaatcttaacgcaacatttcttaaaagatgatgtcgatacgtatatcaatcgttcagaattgataagaacagttaagatacaagatcaaggtgtagccattgcacatggttcagatgataaaatttatcatcctgtaacggttgcacaagctgccgatgagttgttaagtttagaaggcattgaagcatcttatgtagtagctaaacgtgaagacaacctgattggtatctcagcacgttcattaggttccataaatgttcaattaacaatggaagcgttaggtggcggtggccatctgacaaatgctgcaacacaaataaaaggtgcgacaatagatgaagcaatagaacaattacaacaagcaattacagaacaaatgagtaggagtgaagacgcatga

SEQ ID NO: 3134 - DNA, 690 bp, Staphylococcus epidermidis
gagagggttagtatggctagttatttattttttcatcctaaaccagcgtgtgatacttatggggatatgaatatttatcacgacaaatttggaaataatgaggacccatacgtatggagtgaacggtttttgcatagcttttgtaaaataacggattatgcatatagtaaatctactcaaaaggacattattttttggatatcaataaataaagaaggcaataatttaaaatatttatgtgatttagtatttaaaatagaaaagtgggatttttggtataaaacttttagtgaacaaaaagatgccatagctacaaataaagaattaacgataaatgacgcagtagtagaaggcgatgaagaagcatatgaatatcattattcttggatcaacagaggggaacacaagtgggaaccaacttatcgaaggcgaagactcacattaaaagcagatcccgtcttgagttttcagcctcaaaatcgacaaggtaatttactagatgtcacggaattactaaaaacaattgtgaattttaatgttgaaaaatcacctgcaaaaagtgggacttcttataaagctttcgaacttgaagaagagcaggcaagcaaactatatgaggaaataaaacgattatcttttattcgattaaagggaagggacttaaaaaacttaagaagaaacttttcttga

SEQ ID NO: 3135 - DNA, 543 bp, Staphylococcus epidermidis
aatggggttagcaatgtgaagaaaatttttgcaagcttaggtgttattttattagttgcaatattgggagttgctgttgtatttgcatatgggagttacaaagatttagaactaaaaaaagaagaagctaaactaaaggataagaagaataagaaaatcgataaaaacaaaactacagaaaatgaaaatcaagaccagattaataatcaaacaattacagcaccaaatgaaaaagcacaatatggcaataacctaggagttcaagaaaaaagtacggataaaaatgatcctaatggtgtgcttagatttgatacaaacggagatggacttatctccactagtgaagtaacaccagaagctcaaaaattagttgatgaaggtaaactacagccatcttcagatagaatggttgaagagtggactaagaataaaaataatgtagataatacatatgactatgatgaatcatataaaaaacaacaagaaatgtacaaaaaagctgctcgtggcgaagttcctgaacctggagaaacaataaaataa

SEQ ID NO: 3136 - DNA, 705 bp, Staphylococcus epidermidis
tatatggctagaaaagttgttgtagttgacgatgaaaaaccaattgctgatattttagaatttaatttaaaaaaagaaggttacgacgtatattgcgcttatgacggtaatgacgcagtagatttaatctatgaagaagaaccagatatcgtcttacttgatatcatgttacctggtagagatggtatggaagtatgtcgtgaagtgcgtaaaaagtatgaaatgccgattatcatgctgacagcgaaagattctgaaattgataaagtattaggccttgaattaggtgcagatgattacgtaactaaaccatttagtactcgtgaactcatcgcacgtgtgaaagcgaacttacgccgtcattattcacaaccagctcaagaagtaagtggtgcgacaaatgaaattacaattaaagatattgtgatttatccagatgcatattcaattaaaaaacgtggagaagacattgaattaacgcatcgtgaattcgagctattccattatctttctaaacatatgggtcaagtcatgacacgtgaacacttactacaaacagtgtggggttacgattattttggtgatgttcgtactgtggacgtaacaattcgccgtttaagagaaaaaattgaagatgatccatctcatccagaatacattgtgacacgtagaggcgttggatacttcctccaacaacatgattag

SEQ ID NO: 3137 - DNA, 126 bp, Staphylococcus epidermidis
gtatatgccagtgtggtgtatgatgcttctaattggtctaatgaagaaacgtcttacgattctgataaacatgatgaaattagaaataagataaagaacgaacttgaacagttgtataacatataa

SEQ ID NO: 3138 - DNA, 150 bp, Staphylococcus epidermidis
atgttgaacagtttattagctttttttaaagaaacaatttacaatgttataatgaatttttacattaataaggaggcgagactcttatggattttgatacgattacaagtatttcaacaccgatgggtgaaggtgctattggaattgtga

SEQ ID NO: 3139 - DNA, 339 bp, Staphylococcus epidermidis
aagaaaagcagaagggagggaaatagcatgaaaatcaatcgatacatcacaagaggaattaatgaaagtattccactagaccttcaaatcttactttggcacatggtagaaaaaaaagataaccagcctcatacagattacctacacatttttaaattacaagaagatgagaatatactctcaatcacacatgaacaagaacaacccacatacaaattggaatatcactatacaaactatgaaaaaaatcaaaatgcattacctaagaaagtctacgtcattcgtgaagatgacgtggacgctttttattatgtgatgcttttaccagaagaatactaa

SEQ ID NO: 3140 - DNA, 144 bp, Staphylococcus epidermidis
cttgtgttaagtgggacggttagactaccccgtttgtatagacatgagtatttcttttatggtttcctctttttttacaacaatggattaactatatttagtgaagtgaaagtgattatgaaattaaaattgatcattgcttag

SEQ ID NO: 3141 - DNA, 2028 bp, Staphylococcus epidermidis
tcttatataaggagtatattgatgaaaaagataaaaattgttccacttattttaatagttgtagttgtcgggtttggtatatatttttatgcttcaaaagataaagaaattaataatactattgatgcaattgaagataaaaatttcaaacaagtttataaagatagcagttatatttctaaaagcgataatggtgaagtagaaatgactgaacgtccgataaaaatatataatagtttaggcgttaaagatataaacattcaggatcgtaaaataaaaaaagtatctaaaaataaaaaacgagtagatgctcaatataaaattaaaacaaactacggtaacattgatcgcaacgttcaatttaattttgttaaagaagatggtatgtggaagttagattgggatcatagcgtcattattccaggaatgcagaaagaccaaagcatacatattgaaaatttaaaatcagaacgtggtaaaattttagaccgaaacaatgtggaattggccaatacaggaacagcatatgagataggcatcgttccaaagaatgtatctaaaaaagattataaagcaatcgctaaagaactaagtatttctgaagactatatcaaacaacaaatggatcaaaattgggtacaagatgataccttcgttccacttaaaaccgttaaaaaaatggatgaatatttaagtgatttcgcaaaaaaatttcatcttacaactaatgaaacagaaagtcgtaactatcctctaggaaaagcgacttcacatctattaggttatgttggtcccattaactctgaagaattaaaacaaaaagaatataaaggctataaagatgatgcagttattggtaaaaagggactcgaaaaactttacgataaaaagctccaacatgaagatggctatcgtgtcacaatcgttgacgataatagcaatacaatcgcacatacattaatagagaaaaagaaaaaagatggcaaagatattcaactaactattgatgctaaagttcaaaagagtatttataacaacatgaaaaatgattatggctcaggtactgctatccaccctcaaacaggtgaattattagcacttgtaagcacaccttcatatgacgtctatccatttatgtatggcatgagtaacgaagaatataataaattaaccgaagataaaaaagaacctctgctcaacaagttccagattacaacttcaccaggttcaactcaaaaaatattaacagcaatgattgggttaaataacaaaacattagacgataaaacaagttataaaatcgatggtaaaggttggcaaaaagataaatcttggggtggttacaacgttacaagatatgaagtggtaaatggtaatatcgacttaaaacaagcaatagaatcatcagataacattttctttgctagagtagcactcgaattaggcagtaagaaatttgaaaaaggcatgaaaaaactaggtgttggtgaagatataccaagtgattatccattttataatgctcaaatttcaaacaaaaatttagataatgaaatattattagctgattcaggttacggacaaggtgaaatactgattaacccagtacagatcctttcaatctatagcgcattagaaaataatggcaatattaacgcacctcacttattaaaagacacgaaaaacaaagtttggaagaaaaatattatttccaaagaaaatatcaatctattaactgatggtatgcaacaagtcgtaaataaaacacataaagaagatatttatagatcttatgcaaacttaattggcaaatccggtactgcagaactcaaaatgaaacaaggagaaactggcagacaaattgggtggtttatatcatatgataaagataatccaaacatgatgatggctattaatgttaaagatgtacaagataaaggaatggctagctacaatgccaaaatctcaggtaaagtgtatgatgagctatatgagaacggtaataaaaaatacgatatagatgaataa

SEQ ID NO: 3142 - DNA, 1485 bp, Staphylococcus epidermidis
aattggaggctgtttttaatgtgggaaaataaatttgctaaagaatctttaacattcgacgacgtgttactcattccagctgcatcagatgttttaccaagcgatgttgacttaagtgtcaaattatcagataagatcaagttaaacattcctgttatctcagcaggtatggatacagtaactgaatcaaaaatggcaattgctatggctcgacaaggcggtttaggtgttattcataagaatatgggcgtcgaagagcaagctgatgaggtacaaaaggttaaacgttcagaaaatggtgttatttctaacccgttcttcttaacaccggaagaaagtgtgtatgaggctgaagcattaatgggtaaataccgtatctctggtgtacccattgtcgataatcaagaggatcgcaagttgattgggattttaacaaatcgtgatttacgttttattgaagatttttcaattaaaatatcagatgtaatgacgaaagataatttaataacagctccagttggtacgactttagatgaagccgaggctattcttcaaaaacataagattgagaaacttccattagtagaaaatggtcgtttagaaggattaatcactattaaagatattgaaaaagtacttgaattcccatatgcagctaaagatgaacatggcagattgttagctgcggcagcaatcggtacgtctaaagatactgaaattcgtgcacaaaaactagttgaagctggcgtagatgcattaattattgatacagctcatggtcattctaaaggcgttattaatcaagttaaacacatcaaggaaacatatcctgaaattactgttgtcgctggtaacgtagcgactgcagaggcaacacgtgctttatttgaagcgggtgccgatgttgttaaagtaggtattggtccaggctcaatttgcacaacacgtgttgttgcaggtgtaggtgtgcctcaaattacagcagtttatgattgtgctacagaagcccgtaagcatggtaaggctattattgctgatggtggtattaagttctcaggtgatattatcaaagcattagctgctggtggtcatgcggttatgttaggtagtttgttagctggtacagaagaaagtcctggtgcaactgaagtattccaaggtagacaatataaagtttatcgcggcatgggatctttaggtgctatggaaaaaggttcaaatgatcgttacttccaagaagataaaacaccaagaaaatttgttcctgaaggtattgaaggtcgtacagcttataaaggaccattacaagatacaatttatcaacttatgggtggcgttagagctggcatgggttatactggttcagaaaacctaaaaaaattacgtgaagaagcacaatttacacgtatgggaccagctggcttagctgaaagtcatcctcataatgttcaaattacgaaagaatcaccaaactattctttctag

SEQ ID NO: 3143 - DNA, 198 bp, Staphylococcus epidermidis
cttcaaataagcgtcacaattccttcttttttactttgggaaataatttatatggattgcatgaactatgtatatgacaatttattattaaaattggtgaagaaaaaaattgcttatattaaatcacaacaagtcattttcaatcgttatattcgtaaattcatcttgctttataaaaggtattttgttatattgtag

SEQ ID NO: 3144 - DNA, 138 bp, Staphylococcus epidermidis
tatacccaaagagaacatttgttccttttttatctattttatcttataaaaataattagtaaaagaactatcatatcaattaatattgatttgatatacttaattcaaatattgaaagagagtgattatcatgattaa

SEQ ID NO: 3145 - DNA, 150 bp, Staphylococcus epidermidis
ctcataaaaagactagtacatcgctttacagctattgaagatgaggaaatacttgataaaatctataaaaattttatgaatgatgatactataacaacgatatttaacaataatttacaggcaattattaaccattacctatcaatatga

SEQ ID NO: 3146 - DNA, 147 bp, Staphylococcus epidermidis
catgaaaaaagcacccacaccatttttattggtttggatgctttgataactataattaatgtaactcaaacgattagacatcatcaacatctatcattgagttacgtgcgtatagataaacacacatgctttaattgtgttaattga

SEQ ID NO: 3147 - DNA, 711 bp, Staphylococcus epidermidis
tggagaaaaagtagaggtgtcatcatgattgaattgagaaaaatcaatcgacactttaaaaatggaaatgaatcaaatcatattttgaaagacatagatattcatattgatgaaggtgaatttattgctatcatgggtccgtctggttcaggtaaaagtacgttaattaatatcttgggatttattgatcgtggatatgaaggagaatacttttttaacaatgagaattatcaaaaaagctcagataataagctcgcagaaattcgaaatcatactgtaggtttcgtctttcagaattttaaattgattcaaaataacactattttagaaaatgtaagtattccgctaatttataatggtttgagtaataaagcgagaaaaagcaaagttttagacggacttcatgacgtcggtctaaaaggtaaagagaatctcttaccaaataaattgtcaggagggcagcaacaacgtgtagctattgcccgggcaattattaatgaccctaagtttattattgccgatgaacctactggcgctcttgattcgaagacatctcaagatattatggagcttttcgtaaaactgaacaaagaacagaatacaactattattatggtaacgcatgatcgtgaagtggcggaaaaagctgatcgtattatccatattttggatgggcgtgtgcaagaggaagaggtgttgacacgtgaataa

SEQ ID NO: 3148 - DNA, 402 bp, Staphylococcus epidermidis
atggagaaaaggagtattaatatgaaaaaagtatttatgatcataagtatacttaccataactgttactttaagtgcatgtggaggttctggaaaacaaaaagagccatctaaggaaagtcaaaaatctgataaatatgattatgtttattatgaaatattaaatgatggagattctgaaacgccaaatgttgagattaaatataaagataaaaaaggtaaatcacatatagaaaaagctgatttagatcacgtgtatgaacatatactaggtgatggtaataaaaaaccatatattgtaaaggatgggaagaaaattcatgtatatcgaccaccatatatgatttatggtgatgatgatgttgaaggcaaagccgtttcgaaagatgaagttacgaagtaa

SEQ ID NO: 3149 - DNA, 1158 bp, Staphylococcus epidermidis
acgactggaaggagtttaaatttaatgatggaattcacaattaaaagagattattttattaatcaacttaacgacacattaaaggctatctcacctagaacaactttaccgattttaacaggtatcaaaattgatgctaaagaaaatgaagtcattttaactgggtcagattcagaaatatcaatagaaatcactattccaaaacaagttgatggtgaagaaattgttgaaattacagaaacaggatcagttgtacttcctggtcgtttcttcgttgatattattaaaaaacttcctggaaaagaagttaaattatcaactaatgaacaattccaaacgttaatcacatcaggtcattcagaatttaacttaagtggcttagatcctgatcaatacccattattacctgaggtatcacgagatgacgctattcaattgtcagttaaggtactaaaaaatatcattgcacaaactaattttgcagtgtccacctcagaaacacgaccagtacttactggtgtaaactggcttatacaagataatgaattaatatgcacagcaacagattcacaccgcttagctgtaagaaagttacagttagaagatgaatcagaaaataaaaatgtcatcattcctggtaaagctttatctgaattaaacaaaattatgagtgacagcgacgaagatattgatattttctttgcttctaaccaagtgttattcagagtggggaatattaatttcatctcacgtttacttgaaggtcattatccagatacgacacgtttattcccagaaaattatgagattaaattaggaattaacaatggagacttctatcatgcaattgatcgtgcatctttattagcacgtgaaggtggaaataatgttattaaattaagtacaggtaatgaattagttgaactttcatctacttctcctgaaattggtactgttaaagaagaagttaacgctaatgatgtagaaggcggaaacttgaaaatttctttcaactcaaaatacatgatggatgctttaaaagccattgataatgatgaagtagaagtagaattctttggtacaatgaaaccatttatcttaaaaccaaaagatgatgattctgtaacgcaattaattctgcctattagaacatattaa

SEQ ID NO: 3150 - DNA, 273 bp, Staphylococcus epidermidis
aataaaatgagtcaaaggaggcagttaaccatggcaggtggaccaagaagaggcggacgtcgtcgtaaaaaagtatgctatttcacagcaaatggtattacacacatcgactataaagacactgaattattaaaacgttttatctcagaacgtggtaaaattttaccacgtcgtgtaacaggcacttcagcgaaatatcaacgtatgttgactacagctatcaaacgtgctcgtcatatggctttattaccatatgttaaagaagaacaataa

SEQ ID NO: 3151 - DNA, 399 bp, Staphylococcus epidermidis
aaagaaatgaggaaaatcattatgaagatacgtttaacatttattatcttagcaatactatccaccatcggcttagtacttgttttagcaaaatatccaacaggcccacacacaatcaactataacgaaccttatacagtactcatagccattacgacaatagttataatggctttaccagcactcatattaggtatatttaatcatcttgcatgtagaatcatatcggcgatattacaaataagtgcactgatgatgtgggggtttttagtaatcattagcttaattatgggacaaattgtcattatgcttatggcttccttaacgatacttgcattacttgttagttctattgtcacactttcagtgcacccatctacttcagataaaataaattaa

SEQ ID NO: 3152 - DNA, 381 bp, Staphylococcus epidermidis
atatggatgagaagggttattgtgtttggtatatcaatttctagtgctatactacatttcgttatcggaggatttgctgttgcacttgcatcaattatggctgataaagtaggaggaaaattaggtggcattattgccacaatgccggcagtctaccttgcagctattatagcgttagctatagaccataaaggacagcaacttattcaaatgtcaattcatttaagtacaggagcaattgttgggattgtctcatgtattgtaactgtgttctttacttcaatttttattggtaagaaaaattatagaagtggaacagtatttgcaattctttgttggtttgtgatttctgttgcgattttcttagtcagacatatttaa

SEQ ID NO: 3153 - DNA, 807 bp, Staphylococcus epidermidis
gaaaggatgagtcgcttgatacgtatgagtgtattagcaagtggtagtacaggtaacgccacttacgtagaaagtgagaaaggtagcctactcgtcgatgtaggtttaactggcaagaagatggaagaacttttcagccaaattgacagaaacattaaggatttaaatggaatattagtgacacatgaacacatcgatcatattaaaggtcttggtgtcttagcacgtaaatataaacttccaatttacgcgaatgagaatacatggaaagcgatagagaagaaagatagtcgcattccaatggatcagaaatttatctttaatccatatgaaacgaaatctcttgcaggattcgatatagaatcatttaacgtgtcacatgacgcgattgatccacagttctacatcttccacaataactataagaaattcacgatgattactgacacaggttacgtttcagatcgtatgaaaggtatgattcaaggtagtgatgtctttatgtttgaaagtaatcacgacgtcgatatgttacgcatgtgtcgttatccatggaagacgaaacaacgtattttgagtgatatgggtcacgtatccaatgaagacgcgggccttgcgatgagtgatgtcattacaggtaatacgaaacgtatatacctctctcatttatcacaagacaataatatgaaagacctcgcacgcatgagtgttgggcaagtgctcaacgaacatgatatcgatacagagaaagaagtattgctctgcgataccgataaagcacaagccacaccgatttatacactataa

SEQ ID NO: 3154 - DNA, 771 bp, Staphylococcus epidermidis
aggagtgagaggatggctattttaacagcaaatcaattatcaaaagtatatggtcacaaacaaaaatatcgagctttaaataatataagtttttcagttgaaaaaggggaatttgtagctgtcatgggtccttctggatcaggtaaaacgactttactcaatgtgttaagttcaatagatactatttcaggaggaactgtagaagttgaaggcaaagaaattaataaactgagccacaaagaagtggcaaattttcgaaaacaacatctcggttttatttttcaagattatagcgttttacccacattaacagtaaaagaaaatattatgctaccactctcagtacaaaaattccataaatatgaaatggaacaaaattataaagaagtggctgaggcattaggtatttataacctgggaaataaatatccaagtgaaatttctggcggtcagcaacaacgtacggcggcagcccgggcattcgtccataaaccaacgattattttcgcagatgaacctactggcgcattagattctaaaagtgctcaagatttgttacaccgtctagaagatatgaataaacaatttaattcaaccattatgatggtgacacatgatccttcagccgctagttacgctgagagagtcattatgttgaaagacggtgatatacactcagaaatctaccagggtaacgattcaaaacaaacattttaccaagaaattatgaaacttcaaaccgcattaggtggtgtcagtcatgacatttaa

SEQ ID NO: 3155 - DNA, 834 bp, Staphylococcus epidermidis
atcatacggaggtgttttttttctatgaaaagagcttcttattcagtagaaacaaagtataaagcagttgaaatgaaagcagcaggatttccaacaaaagaaattatgaaagaattaaatattagaaatagaacacaagtgaaaaattggtggcgatggtatcgaaatggggaaagttatagattttcacaacatgttggtaaacaatatacctacggttatcgtaagattacagcattgattaatcaatgttatacatcaccaattaatcataagagagtacagagagtgatgcagaagcatcatttgaactgccgagttagacctaaaaagacgacaagaataggtaaaccgtattataaaacggacaatttattacaaagacaatttaaagcgagttgtcccatggaagtattaacaaccgatattacttatttaccatttggtcattctatgttgtatttatcttcgataatggacatttataacggagaaattgtggcgtataaaatagatgataaacaagaccaacgtttagttaatgatacattaaatcaaatcgatatacctgaggggtgtatattacatagtgatcaaggcagcgtttatacatcttatgcttattatcaattatgcgaagaaaaaggcattatcagaagtatgtcccgaaagggaacacctgccgataacgccccgatagaaagtttccattcctcgctaaagtctgaaactttttacatcaataatcagcttaataactctaatcatattgtaatagatattgtcgaaaatacattaaaaactataataataatcgaattcaacaaaaactag

SEQ ID NO: 3156 - DNA, 591 bp, Staphylococcus epidermidis
cttttcaggaggaatttatctatgtctttaattaacaaagaaattttacctttcacagcacaagcttatgatccaaaaaaagatgagtttaaagaagttactcaagaagattttaaaggttcttggaacgttgtatgtttctatcctgctgacttctcattcgtatgccctactgaattagaagatttacaaaatcaatacgctaaattacaagaattaggtgttaacgtgtactcagtatcaacagatacacacttcgtacacaaagcttggcatgaccattctgatgcaatcagcaaactagaatacagcatgattggtgatccttctcaaacaatcactcgcaatttcgatgtgttggatgaagaatctggtctagcacaacgtggtactttcattatcgaccctgatggtgtggtacaagcagcagaaatcaatgctgacggaatcggacgtgacgcaagtacattagttaacaaaattaaagccgctcaatatgtacgtcaacatccaggtgaagtttgcccagctaaatgggaagaaggttcagaatcattacaacctggtttagacttagtaggtaaaatctaa

SEQ ID NO: 3157 - DNA, 861 bp, Staphylococcus epidermidis
ttgagagggagagaatggataatgaagaaacctttttcaaaattatttggtttaaaaaataaagatgacatcattggttatactgaagaagaacgtaataataatgtagaatccattcatattgaacgtatcgtacccaatcgttatcaacctagacaagtatttgagccaaataagattaaagaattagcagagtctattgaagagcatggattattacagcctatagttgtacgtccaattgaagaagatatgttcgaaattatagccggcgaacgacgatttcgagcattacagtcgttgcataaacctcaagtagatgtcattgttcgagatatggatgatgaagaaacagcggtagttgcattgattgaaaatattcaacgtgaaaacttatctgtcgtcgaagaagcggaagcttataaaaagttacttgaaatcgggggaacgactcaaaatgaattagcaaaaagtctaggcaagagccaaagcttcattgctaataaacttagattattgaagttagcacccaatgtgattaagagattacgtgaaggtaagattacagaaagacatgcacgagcggtattagtattacctgataaaacacaagaagaattaatcgagcaagttattagtcagaagttgaatgtgaaacaaactgaggatagagtacgtcagaaaactggaccagagaaagtaaaagcgcagactttccaattttctcaagatgtaacacaagcaaaagaagaactaggtaagagtattgaaacgatagaaaaatcaggtatacgcgttgaacaaaaagataaagaacatgaagattattatgaaattaaaataaagatatataagaaataa

SEQ ID NO: 3158 - DNA, 519 bp, Staphylococcus epidermidis
gaaaattttgggagtgggattatgaaactaagagcattagagtatagtgatttactttttgttcatgaattaaataatgaatattctattatgtcttattggtttgaagagccttatgaatccttaacggaacttcaacatttatttgataagcatttattagatgaatcggaaagacgttttattgttgaagatgaaaatcaagtcgtaggtattgttgaattagtagaaattaattacatccatcgtaattgtgaaatacaaataattattaaacctgagttcagtggtaaaggttatgcaaaattcgcattcgaaaaagcgataatttatgcattcaatattttaaatatgcacaagatctatctatatgttgatgcagataacaaaaaagctattcatatatacgagtcacaaggatttaaaacagaaggattacttaaagagcaattctacactaaaggtaaatataaagatgcctattttatgtcattattgaaatctgaatatattttgtag

SEQ ID NO: 3159 - DNA, 987 bp, Staphylococcus epidermidis
aggaggtatggaactattatgacgaattacacggttaatacattagaactaggtgagtttataactgaatctggtgaaacgattgatcatttacgtctacgttatgaacatgtaggacttcctggtcaaccccttgtcgttgtttgccatgcacttactggcaatcatttaacatacggtaccgatgcgcaacctggctggtggcgagaaatcattgatggtggctacattccagttcatgattatcaatttcttacattcaatgtcattggaagtccatttggttcgagttctaaattaaatgatgacaacttcccagaacatttaacattgagggatatcgttagagctattgagttaggtatacaagcattagaatttaagaagattaatattctcattggaggcagtttaggtggcatgcaagcgatggaattgctttataatcgtcaattcgaggtggaaaaagcaatcatattagccgctactgataaaacgtcctcctatagtcgtgcttttaacgagattgcaagacaagctatacatataggcggtaaagaaggtttaagtatcgcacgtcaactcggcttcctcacgtatcgatcgtctaaaagttatgatcaacgttttacaccagatgaagtagtgagctatcaacaacatcaaggtgataagttcaaagaatatttcgatttaaattgttatttaacactgctagacgtcttagatagtcatcatttagatagagggagagatgatgttgatgaagtctttcaatcgttggaaacgaaagtactaactatgggctttattgatgatttactttatcctgatgatcaagtaagagctttaggagaacgttttaaatatcatcgtcatttcttcgtaccagataatgttggacatgatggttttcttctaaattttaatgattgggcacctaatttatatcatttcttaaatctgaaacaattccgacgtaaatag

SEQ ID NO: 3160 - DNA, 1659 bp, Staphylococcus epidermidis
caaatacatggaggtcaatatggaaacaaaacaaatcaacatcgttttactgtaaatgatattgttgaaacaattcctgacaatgaattcgacgaattcagacatcaccgtggtgcaacttcgtaccatcctaaaatgatgttaaaagtgattctatatgcctacacacaatctgtattctcaggtcgtaaaatagaaaaaatgcttaatgatagcatccgaatgatgtggctatcacaaaatcaaaaaccttcttataaaacaattaatcaatttagagtaaatccaaaagtagatgctttattagaatctttatttattcaattttacagtcagtgtgtaaaacaaaatcttatagatgataaagctatttttattgatggtacaaaaattgaagcaaatgccaatcgatatacatttgtatggaaaaagagtattcaaaaccatgaatcaaagatgaatgaggattctaaagccctctaccatgaattggtaaccaataaaatcataccggaaattaaagaagatcatgataatgaattaacaaaagaagaaatagatttgattggtagtcacttagataaagaaatcgaagatttaaaccaacatatcaacaatgaaaaatgtactaaaacaagaaaacaaatacgtctcaaaagaactaaaatcaaaaaatacaaaaagcaaatcaatgattattttgagcgaaagtatcgatacgaatttcaaaaatctattttaaaggatagaaatagttattctaagacagattatgatgcgacatttatgagaatgaaagaagatcacatgaaaaatggacaacttaagccagggtataatttacaaatagcaacaaattcccaatttgttttatcttataatgtgtatcaaaatccaacggatactagaacgatgattccatttttaaattcaattcaagagacctacggtcatttacctgaatatattgtagctgatgcaggttatggtagtgaatcaaattataaggcaattatagatgactttaatcgaacgccactcataacatatggaatgtttataaaagataaaactaaaaaatataaaagtgacatctttaatactcaaaattggaactatgacgaaattaatgacgaattcatttgtccgaataataaacggctaggttttaaaagatatgcctatcgtcatgataagtatggttataagcgagacttcaaattatatgaatgtgatgattgttcagaatgtcctctgaaaaatcaatgtatgaacttcaattcaaaaacaaacaaaaaaataatgaagaattataactgggaatattttaaatcccaaattaacaaaaagctttcagaaccagaaacaaaaaatatctacagtcaaagaaaaattgatgtggaacctgtttttggatttatgaaggctattttgggtttcactcggatgtctgtccgaggactcaataaagtcaaaagagaacttggttttgtattaatggcacttaatataagaaaagtagtagctcaacgagctgaaaataatcaaaaaatttataaaaaagacaatttctatattatttcaatagaaattgtcttttttcacttatccaagaactttatgtcccggactcattatgatttatttttttattgctga

SEQ ID NO: 3161 - DNA, 237 bp, Staphylococcus epidermidis
acatttaatggtaatgcacctgcacttgaacgtgaagtaaatgcaaagattagtacttctattgtctttttcacgtatttaacgggattgatacctaagacactcagtataattaaatggataatatacattgtgattagagctgcgtatgaagcaattaagaatttacctaacgtccaaattgcagaaaaatcacttgtcgcaagagtagaagccataatagctaaaatgccataa

SEQ ID NO: 3162 - DNA, 1404 bp, Staphylococcus epidermidis
ataatggatggaatgtatgagcaaaatcaaatgccacatagcaatgaagctgaacaatctgtcttaggtgccattattatagatccagaactcattaatactactcaggaagtcttgcttcctgagtcgttttatagaggcgcccatcaacatatttttcgagcaatgatgcacctaaatgaggataataaggaaattgatgttgtcacattgatggatcaattatcaagtgaaggtagcttgaacgaagcgggtggccctcaatatcttgccgaactatcgacgagtgtaccgacaacacgaaacgttcagtactatacggatatcgtttttaaacatgcgttgaaacggaaacttattcaaaccgctgatagtatagcgaatgatggctataatgatgaattagaattagatacgattttaagtgacgccgaacgacgtattttagaactatcttctactagagaaagtgatggttttaaagatattagagatgtcttaggacaggtatatgagaccgcagaagaactcgatcaaaatagtggtcaaacaccaggtattccaactggttatcgtgacttagatcaaatgactgctggttttaaccgtaatgatttaatcattctagcggcacgtccttcagtaggtaagactgcctttgccttaaatattgcgcaaaaggttgccacacatgaagatatgtatactgtcggtattttctcacttgagatgggcgccgaccaattagcaacacgtatgatttgtagttctggtaacgttgattccaatcgtttaagaactgggacgatgactgaagaagattggagtcgctttacgattgcggtaggtaagctatcacgaactaaaatcttcatagacgatacgccaggtatccgtatcaatgatttacgttctaaatgtcgtcggctcaaacaagagcacggtcttgatatgattgtgattgattatctacaattgattcaaggaagcggatcacgtttctcagataaccgtcaacaagaagtttcagagatttcacgtacacttaaggcgattgcacgtgaattagaatgcccagttattgcactgagtcagttatcacgtggcgttgaacagcgacaagacaaacgtcctatgatgagtgatattcgtgaatctgggtctatagaacaagatgccgacattgtcgctttcttatatcgtgatgattattataatcgtggtgaaggtgatgaagatgatgacgatgctggttttgaaccacagacaaatgatgataacggtgaaattgaaatcatcatcgccaagcaacgtaacggtccaacaggtactgtgaaacttcactttatgaaacaatataataaatttacagacattgattatgctcatgcagatatgtcataa

SEQ ID NO: 3163 - DNA, 132 bp, Staphylococcus epidermidis
tataaattcggaatcaattttgtgtataaaataactgaagaattgaaaccacagctctattttccacttatttttaatcatgataatcactctctttcaatatttgaattaagtatatcaaatcaatattaa

SEQ ID NO: 3164 - DNA, 690 bp, Staphylococcus epidermidis
ataatattagggagaggatataacatggaatttaaagtgatagaatcagctaaagatccattatttaacgaggcactcaaattatatgatgataaattggatattggtttagatgaagatagtaaaatttttaaacgctcacttgaaaataataaaacagaaaatgattacgcctttatcgttggaattgaaaaccagactgtagttagcttagcaactgcacattacgaagcaacaaccaattctgcatttttaatttacttaatcgcaaaagaaagccccaatcatgatgaaagaatgtccttaactttagaggcaatagaaaaacaattaaaccttttatcacaagaagttcataatagagatattaatttcatcatgttagaagttccaaaagaaccctcgactgctaacatcgatgacaagctcagaaatgcactagaacatcgtcgtcaattcctctttgaaaatcaatttgaaaagcaggacgacattgactatattcatccaaaccaaaatcaaaaggaaacgccacaaaaagtagatttatttattaaagctaacattgaattaacaaaggacatttatggtacaagtgtcaaatctaattatattcttaaatatgtttttgcaaatggcatttcaagagaaattatttaccctctcctaaaagaaatgaatttaagatag

SEQ ID NO: 3165 - DNA, 777 bp, Staphylococcus epidermidis
attttgataggagtgggtatagtgtcagattatgtttatgagttgatgaaacaacatcattcagttagaaaatttaagaatcaaccacttggttctgaaacggtagaaaaattagtagaggcgggacagagtgcttctacatccagttatcttcaaacttattctattattggtgttgaagatccaagcattaaagcgcgtttaaaggaagtgtcaggtcagccttatgttttagataatggttatttatttgtatttgttttagattattatcgtcatcatttagtagatgaagttgcggcgtcaaatatggagacatcatatggttctgcagaaggactattagtaggtacaatagatgttgcattagttgcgcaaaacatggcagttgctgccgaagatatggggtatggaattgtttatttagggtcattgcgtaatgatgttgcgcgagtgcgtgaaattttaaatttacctgattatacgtttccgttatttggtatggcagtaggtgaaccttctgatgaagaaaatgggtcacctaaaccgcgcttgccatttaaacatatttttcataaagaccagtatgatgcaaatcagcatcaacaacgtaaagaattggaagcatacgaccaagtagtgagtgaatattataaagaacgtactaacggtgtgcgtacagaaaattggtcacaacaaatagaaacatttctaggacgtaaaacacgtttagatatgttagatgaattgaaaaaagcaggatttattcaaagataa

SEQ ID NO: 3166 - DNA, 126 bp, Staphylococcus epidermidis
tcatttgtaggaacgcgcttaatttttaaaacaacaatgcttaatgatacgttacaatacttaaagctatcatttagggcattgacaggcgcgtttctcttacttttacataaaatcaaacaataa

SEQ ID NO: 3167 - DNA, 177 bp, Staphylococcus epidermidis
atagcagtaggtaagaaatacacgttatgtgtagtgattttaagactgtctttagaatcacgttcactcgcatatgtgatagtcgaaaatactaaaaataaactacttaaaaccaataaagtagttagtatacatttacgttgccaattcaatattgttacacctcgtttcatttga

SEQ ID NO: 3168 - DNA, 1650 bp, Staphylococcus epidermidis
atgaagaaaggatgtaacataatgcaacaacttaaaacaaaacgtgtcggtatctatgtacgtgtatcaacagaaatgcaaagcacagaaggttatagtatcgacggacaaatcaatcaaatcaaagaatactgtgacttccatcattttgaagttaaagatatatacgctgaccgtggtatttcaggtaaatctatgaacagacctgagctccaacgtatgttgaaagatgcaaaagaaggcaatatcgactgtgttatggtatacaaaacaaaccgattagctcgtaatacatctgatcttctcaaaattgtcgaagatttacacaaacaaaatgtcgaatttttcagtttgtcagagcgtatggaagtcaatacttcttctggtaaactcatgttacagatacttgcgagtttctcagaattcgaacgtaataacattgtcgagaacgtatttatgggtcaaacgagacgtgcccaagaaggctattatcaaggcaatttaccactaggttatgacaaaataccagatagtaaacacgagctaatgattaaccaacatgaagctaatattgtaaaatatatattcgagtgctatgccaaaggacatggctatcgtaaaattgccaatgcattgaatcacaaaggatatgtcactaaaaaggggaaacctttcagtattagttcaatcacatacatcttagctaaccctttctatatcggcaaaattcaatttgcgaaatacaaagattggagtgaaaaacgtcgtaaagggctgaatgataaaccagtgatagctgaaggtaagcattcccccattattaatcaagatttatgggataaagtacaaatgcgtaagaaacaagtcagtcaaaaaccccaagtccatggcaaaggaacgaatctgcttacaggcattattcactgtccccaatgtggcgcacctatggcagcaagcaataccacgaatactcttaaagacgggactaagaaacgtattcgttactattcatgtagtaattttcggaacaagggttccaaagtatgttcggcaaacagtgtaagagctgatgtgattgaagattatgtgatgaagcaaatacttgaaatagtcaaaagtgataaagtcattcaacgcgtagtaacacacgtcaatcaagaaaatcaagttgatggcgctgcacttcatcacgatattgcttataagcaacaacaatatgatgaagtacaaatcaaaataaataacttgattaaaaccatcgaggataatccggacttaacatcagtaatcagaccaagtattcaaaaatatgaaaagcaactcaatgacattacgaatcaaatcaaccaactcaaaaatcaacaaaatgaagataagactttatttgatgccaaagaaatcagtaaactattacaacacatctttcatgatattaagcacatagaaaaatctcgactcaaagcattgtatctatcagtgattgatcgcattgatattaaaaaagatggtaatcataaaaaacaattctatgtcacactcaaacttaataacgaaatcattaaacaacttttcaataataaacaactcgacgaagtgcatctcagcacttcgtctttatttttgccccaaacactatatcttactatttag

SEQ ID NO: 3169 - DNA, 237 bp, Staphylococcus epidermidis
ctagtagaaggccatactaagccaagtgattgtttgaaagttcgtgatgatatgcttgggaaatgccataaactatttactgagagaaaagagtttacaggtgatacgccagtaattgttaatattggcgaatgggatgagggcgatgaagaagataaacagagagctctagataaaataaaagaaaactatcctaatagaactatgattgtggatgatataccgttagaggattaa

SEQ ID NO: 3170 - DNA, 1662 bp, Staphylococcus epidermidis
atagaaagagggattcaaatgactcaaaattcatataaaatacccattcaaggcatgacatgcacaggctgtgaagaacatgtaaccgaagcattggaacaagccggagctaaagatgtttcggccgatttccgacgcggtgaggccatttttgaactcagcgatgatcagatcgaaaaggctaagcaaaatatttcggcagccggctatcaacccggagaggaagaaagccagccctctgaaaacagtgtagatttcaatcgggatggcgattacgatcttctgattattggttccggcggtgcggcgttttctgcagctatcaaggccaatgaaaacggggcgaaagtggccatggtagaacggggaaccgtcggggggacctgcgttaacatcggttgtgtaccgtcaaaaaccatgcttcgtgccggtgaaataaacggtctcgcccaaaacaatccgtttaccggacttcaaacgagtaccggtgctgcggaccttgcccaattgaccgaacaaaaagatggattagtcagtcaaatgcgtcaagaaaaatatatagacttgatcgaagaatatggatttgatctcattcgtggcgaggcctcgtttatcgacgataagacgatacaagtgaatggacaaaacatcacgtctaaaagctttttaatcgcaacgggggcttctccggctgttccggaaatcccgggaatgaatgaggttgattatttaacaagtacatccgcactcgaattaaaagaggttccacaacgattggcagtgatcggttctggctatatcgcagcggaattaggtcaaatgtttcacaacctcggaacagaagtgactctcatgcaaagaagcgagcgtctgtttaaaacctacgatcctgaaatttccgaagccatcgatgaatccttaactgagcaaggacttaacctgatcactggggtcacttatcaaaaggttgagcaaaacggtaagtcgacaagcatttatattgaagtgaacggtcaagaacaagtcatcgaagccgatcaagtcctcgtggcaacaggaagaaagccgaacacagagactttaaaccttgaatcagcaggtgtgaaaacagggaaaaaaggcgaagtgctgaccaatgaatatttgcaaacgtcgaataaccgaatatatgccgcgggcgatgtgaccctcggtccgcaattcgtttatgttgcagcttatgaaggcgggattgtggcaaataatgcgttgggtctagcgaaacgcaaaatcgatcttcgctttgttcccggcgtaaccttcaccaatccatcgatcgccacagtcggcttgactgaacaacaggcaaaagaaaaaggttacgatgtcaaaacatcggtccttccgttggacgctgtaccgcgggccttagtcaatcacgaaacaacaggggtctataaacttgtagtcaacgcccaaacccagaaattgatcggggcgcacattgtgagtgaaaatgctggagatgtgatttatgcggcaacgttagcggttcaatttggattgaccattgaagaccttacggatagctttgcgccttatttaacgatggctgaaggattaaagcttgcagccttgacgtttgataaagacgtatcgaaattatcttgttgtgcaggctaa

SEQ ID NO: 3171 - DNA, 615 bp, Staphylococcus epidermidis
atagtaggaggtataattaacgtgttcaatacaacatataaagaaatatatagcatgtttcctaataaaccatacccagtacatgatatctatgaagactgtagaactattcttgctgacttgcaaatagaaatgtttaatagaattaataaacagctttataaaacctgtcattacaataagcctagaaaacatcacgaaatgattaagaaattactaatcgaatttattatagacaacaaagatagcaaaatcgttagcgcggaaccatttgaattaaacctagaagctttttatgctatcaaacaaaattgtaatattagtaataacaataaacccttagatgaatatattattacatattttgaggatttattgtctaatataagtaacacattaacaaataataatagagctaatggaaataacccaataataaattacatctatgttactcaaagaaaagatggcatggtttgcgtagttggaaaatcacatttcaaatatgaatttaagggtaatgaatataaattagttaaaaatcaagaaggtgacttattaagaagatggatgaagataaaggtaccggaaaaatattatcttcattgtatataa

SEQ ID NO: 3172 - DNA, 891 bp, Staphylococcus epidermidis
cttaaaggaggtgacatattggatcgtgcatttcgaatacttacgatatacaatcgtttactacaaaataaatccgtcaacaagcaatcactcacattagaactcgatacaagtcctcggacgatacaaagagatatcgacgatataagaaacttcttatatgaaagtaaatcatggataagcgcacctaaagaaattacgtacgattataaatcagaaagttataagctcgaacaaaataaaagtgaaaatatgtattttatgtatgatattttgactgctttatacctaacaacaccaaaattaagccattacttttatcaatatcttaaattattaatcgtcaaacatcattcaaattatcgaactacattattaaaatatcttgagcgttttgaaattgataagaatcaaacaggtatttcgacatcatcattagttgttcaagcaatgaacgaaaatcaatatcttcaatacaatcaaaatctattattacctttatcgatgtactatcaaatgcatgcttttcacttggtatatcgaatgaacgatgaaattcatatcgatgatattaatcaaatgaatctgagtttgtctgaaaaatctgtggacacacatgaaaaatcaaaggtacaaacctatatcacgtttgaaatttctaaagatgtgtggtcaaaaatgcatcgatattatcaaattcatgtgatagaaaaatatgatgcgcattatcttatcgtcacttttaagatgacaaggattgaagcgattcaactctgttttatgtatcgatccaatatacgtatcatttcaccccctgatttgaaggaacaagtgattgatgaattacttttattacaaacaacctatttaaaacaacaggttcaaaagtag

SEQ ID NO: 3173 - DNA, 1896 bp, Staphylococcus epidermidis
cttttgggaggtaaaagagtggttcaagaatatgatgtagtagtcattggtgctggtcacgccggtattgaagcaggtttagcttcagctcgtcggggtgctaaaacgctgatgttaacaattaatttagataatattgctttcatgccatgtaatccatctgtaggtggtcctgcgaaaggaatcgttgtacgtgaaatagacgctttaggtggacaaatggcaaaaactattgataaaactcacattcaaatgcgtatgcttaatacaggtaaaggtccagctgttagagctttacgtgctcaagcagataaagtattatatcaacaagaaatgaagcgtgtacttgagaatgaggataatttagacatcatgcaaggtatggttgatgaactcattatagaagataatgaagttaaaggtgttcgtactaatattggtacagaatatcgttctaaagctgtcattattacaacaggtacattcttacgtggagaaattatactaggaaacttaaaatattctagtggccctaaccatcaattaccatctgtaactctagcagataatttaagaaaattaggatttgatatcgttagatttaaaacgggtacaccaccacgtgtaaatgcgagaaccatcgattattctaaaactgaaatccaaccaggtgatgatataggtcgagcgtttagttttgaaacaaccgaatttattttaaatcaattaccttgttggttaacttatacaaatggagatacacatcaagtcattgatgataacttacatttatctgctatgtattccggtatgattaaaggtacaggtcctagatattgtccatcaattgaggataaatttgtccgctttaacgataaaccaagacatcaacttttcttagaacctgaaggacgtaatacgaatgaggtatacgtgcaaggattatctactagtttacctgaacatgttcaacgtcaaatgttagaaaccattccaggtcttgaaaaagcagatatgatgcgtgcgggttatgctattgaatatgatgcaatcgtgcctactcaattatggccaacgttagaaacaaaagcgatcaaaaacttgtatactgcaggtcagattaatggaacatcaggatatgaagaagcagcgggacaaggaatcatggcaggtattaacgctgctggtaatgttttaggtacaggtgaaaaaatactcagccgttcagacgcatatattggtgtacttatagatgatttagtcactaagggtacaaatgaaccgtatcgattattaacttcacgtgcggaatatcgattattactacgtcatgataatgctgatttacgtcttactgatatggggtatgaattaggtttaatatcagaagaacgctatgcaagatttaatgaaaaacgtcaacaaatcaaagatgaaatacaacgacttaccgatgtacgtattaaaccaaatgaacatacgcaagcaattattgaagctaagggtggttcaagattaaaagatggcatattagcgattgatttattacgtcgtccggaaatgaactacgaaacaattttagaaatcttagaagaatcacatcaacttcctgaagcggttgaggaacaagttgaaattcaaacaaaatatgaaggttatatcaataaatctttacaacaagtagaaaaagttaaaagaatggaagcgaaaaaaattcctgaggatttagattatagcaaggtagatagtttagcatctgaagcacgcgaaaagttagctgaagttaaaccattaaatattgcacaggcttcacgaatttcaggtgtgaatccagcagatatctcaattctacttgtttatttagaacaaggtaaacttcaaagggtgaaacaataa

SEQ ID NO: 3174 - DNA, 840 bp, Staphylococcus epidermidis
catgttatgggaggttatgtcgttatgaaaacgttagattctgttaatattcctataagaaaagacgaaacacataaaggtgactatggtaaaattttattaatcggtggatcagccaatatgggtggcgcaatcatgcttgctgcacgcgcttgcgtttatagtggaagtgggctcattactgtagcaacacacccaaataatcatgctgcgctacattctcgttgtcctgaggcgatggttatagatattaatgatactaaaatgcttacaaaaatgattgaagcaactgatagtatccttatcggtccaggtcttggagtagatttcaaaggtaataatgccatcacgtttttacttcaaaatatacaaccacatcaaaatttaattgttgacggagatgctataacaatattcagtaagttaaaacctcaaattcctacatgtcgtgttatattcaccccacatcaaaaggaatgggagcgtttgagcggtatacctattgaagaacagacatatgaacgtaaccttgaagcggtagaacgtattggcgcgacagtagtattaaaacaacatggtacggaaatctatttctgcaatgatgatgtctataaattacctattggcacacctgctatggctacaggtggtatgggtgatacacttgcgggcatgattacaagcttcgtaggccaatttgataattttaaagaagctgttacaagtgcaacttacatgcatagttttatcggtgaaaaattatctgacacaatgtatgttgttccaccttcacgtctaattagtgaaataccgtatgtgatgaaacaacttgaaggttaa

SEQ ID NO: 3175 - DNA, 741 bp, Staphylococcus epidermidis
acttcaaagggtgaaacaataatgagtattgaatggttatcagagaaattaagcgagcaaggcatagaactatctaatacgcaaaaagagcaatttcaaaaatattataaattacttgttgaatggaacaaaaaaatgaatttgacaagtattactgatgaacatgatgtttatttaaaacatttctatgattcaatagcgcctagtttctattatgattttaacggtcaattaagtctttgtgatatcggtgctggtgcaggttttccaagtatacctttaaagatagtataccctgaattgaaagtaacgattgtagattctctaaataaaagaatacaatttctaaatcatttagctgcagaactaggtcttgaagatgttagttttgtgcatgatcgagcagaaatatatggcaagggtgtctacagggagtcttatgatattgttacagctcgtgcagtagcgagattgactgtcttaagtgagttgtgcttacctttagtaaaaaaaggtggacagttccttgcacttaaatcatcaaaaggtgaagaagaattgcaagaagcgacatttgctattaacattttaggtggtaatgtgaaagagactcatacttttgaattacctgaaaatgccggtgagcgacaaatgattattattgataaacgtagacagacatcaaaaaaatacccaagaaaaccaggtacgccaaacaaatctccactagttgaaagttaa

SEQ ID NO: 3176 - DNA, 339 bp, Staphylococcus epidermidis
atcatacggggggtgtttttttctatgaaaagagtttcttattcagtagaaacaaagtataaagcagttgaaatgaaagcagcaggattttcaacaaaagaaattatgaaagaattaaatattagaaatagaacacaagtgaaaacttggtggcgatggtatcgaaatggggaaagttatagattttcacaacacgttggtaaacaatatacctacggtaaaggattagaagagctgttagaagtagaacaattaaaattagaaaataagagaaaagatatagaattggatattttaaaaaagtacaaggcattggagaggaagtggtaccaacagtag

SEQ ID NO: 3177 - DNA, 162 bp, Staphylococcus epidermidis
agtgtaattttattactacttcatatatataataacatgtatcatacatggatttccctttttagcatctgtataaagcagatagagttaattccacaagttgttatgactttctgtgaaaataaccctattaaacttactttatttattaaccgaaaatga

SEQ ID NO: 3178 - DNA, 123 bp, Staphylococcus epidermidis
gtgatttttatacagttatttaaaatctatttcataatcaaaaataataaagggggtaataaaaatgaaaaaagaaaaacgtttaaatcttatcttaactgttatacaacagaatcagtttaa

SEQ ID NO: 3179 - DNA, 570 bp, Staphylococcus epidermidis
aattcatttattgggcatacaatgcttttaggcaaatgtttaggaggtatggcaatggatagtcatttaaatcacattttgtcctattggcagggaccaccgttggaaggggcaaaaaccataattagtaagtatggatatccccaggaagcaacaatgagacgattaatttggtacaatagcgggccatggaaacgcacgatagtatataaggatccagtccctcataacttccctacccctcaccttgatttccttaagcagaccatcgattataaagtgcccgtacacttatatgatgcgattgccgcttttgatggaagtgtctacttagatcgaactacaggtgaggcatcagcaaagtgtcatgaggaagcgatgaattttttatctttaaacttgttaaatgacattgtaactggcaaacgtgatgttcaaggagcaaaagctttctacgcccaaactgccgaacagtttaccaaatatcatataacatctccttatacagaaggttttctttttccaatgcaatataatacggcagaccttggcgttacatattttaaataa

SEQ ID NO: 3180 - DNA, 174 bp, Staphylococcus epidermidis
gagcttattatgaatatctatcaaacctatgcatgcttagtcataggaataatcgttaatagtactactactatactaaaaagaaaaaaattaatttcaaatattaaacaactttggaaaagtaaaaagactttagaagaatttatacgttcaaattcgagatttgattattag

SEQ ID NO: 3181 - DNA, 1383 bp, Staphylococcus epidermidis
atatatattatcactgtgaaaggaggagccgatatgaaacaagtcataggctatttacgtcaaagtacgatgaaacaacaatctcttgcagcacagaaacaagctatcgaagcaatagccgaaaaacatcatattcaacatatcaacttttatagcgacaaacaatcaggtcgcaaagataatcgtagtgggtatcgacaaataacacaattaattcaacaaggacagtgtgacatattatgctgttatcgtcttaataggttgcatcgtaatctgaaaaatgcattaaaactcatcaaattatgtcaaacgtaccatgttcatatcttaagcgtacatgatggttactttgatatggatcaagctttcgaccgactcaagcttaatatcttcatcagtttagccgaacttgaatcggataacattggagaacaagtcagaaatgggcttcaagaaaaagcaaagcaaggtcgattgattacaacacatgcaccttttggttacgaatatcacaacggaacattcatcatcaatcaaaatgagtcaccaacggtaaaggctgtattcaattattacattaaaggtcatggttataagaaaattgcacagttattagaagaagataacacgtatatcaatcgacaaccctatcaagttcgtaacattatcatcaatcctaattattgtggtcgtgtcaacaatcaatatggccaattcgacaatatgtttccttctattgtttccacaagtatatatgagcaagcgcagagacttcgattgcaaaaacaaaccaaacagacaccttcggataatcaactcaaacaaaaaatcaaatgcccatgttgtaatgcaacacttacaaatatgaccattagaaaaaagaatcatacattacgttactacgtctgtcctaaaaacatgaatgcttcacgctttgtctgtgattttaaaggcatcaatgcacaaacacttgaagataaagtattagaagtgtgccgagacttttatcaaaatcaacgcatctacacaaaaattaaaagtgcgattgacaaacgcatcaaaagacaaagaaacatagaaaaacatcacacattgactcaagaacaactgatagaaaagttggcacaaggcatcattgatgcagaaacgttcagagagcaaacacaatcattacgtcaacaaccgcaacgcactacatctatcaatgggcatcaaatacaacacatcattcaaaatattattcaaaaacgtttcacgttaaacatattgtacccctatattgaaaccattcacattacgaaagataaaaatcttataggaatctatttcaaaaatgaaccactcaatattgtcaatcaaaccatgcaatcatcgattgcataa

SEQ ID NO: 3182 - DNA, 129 bp, Staphylococcus epidermidis
ttgtatgttatgaaagcctgggacatcgataatctatgccccaggcttcactcacaatcctatattatatataacaatattgctacggttgtttatagacatcaatcataccttttgatagagaattaa

SEQ ID NO: 3183 - DNA, 174 bp, Staphylococcus epidermidis
aattatactatagattcaactttgcaacagaacctatattttgctataattattaaattaattgcctttgtgttagtattccctggattactaacactttggttagctgttctaagtgatacaggtgcagcaatattagttatattaaattcattacgtttattaaaaaaataa

SEQ ID NO: 3184 - DNA, 1515 bp, Staphylococcus epidermidis
atggcaactattggatttgaagaaaaactatggcaagctgcagataaattgagaggaagtatggatgctgctgaatataagaacgtagcattaggtttaatatttttaaaatatgtatcagattcttttgaagaaaagtatgaagaattgaagcaagatccttatgctgacgaagaagatcaagatgaatacttagcggaaaatattttctgggtgccaaaagaagcaagatggcaatatatcaatgataatgcgaaaaaaccagaaattggacaaataattgataaagccatgattgcaattgaaaatgaaaatgaatcattaaaaggtgtgttaccaaaagaatatgcgcgtcctgcattagataaagaaaaattaggcgatattattgatttatttacatttaaggttggagatactgaaagtcgcaagcaagatgtattaggccgagtgtatgagtattttattgctaaatttgcgagtgctgaaggtaaaaatgctggagaattctatacgccatcatcaattgtaaaattattagttgagatgattgagccttataaaggccgtatttacgatccatgttgcggttcaggtgggatgtttgtacaaagtgaacgcttcgttgagaaacatcaaggtcgattagacgatattgcgatttatggacaagaatctaaccctacgacttggaaattagcaaaaatgaacttagctatccgtggtattgataatgatttaggtgaacgaaattctgatacattccataacgatttacataaaggactaaaagcagattacatattagccaatcctccttttaatgcaagtgattggggtcaagaacgattacttgatgattaccgttggcaatttggtattccgccaaaaggtaatgccaactatgcatggattgaacatatgatttcaaaattagcacctaatggtacagcaggttttgtattagctaacggatcaatgtctacaagtggaaaagatgaattagaaattcgcaaaaatcttattgaacaagatttagtagaatgtattgtcactttacctggacaactcttttactcaacccaaatacctgtctgtctttggttcattagtaataataaaggtcaaaatggtaaaaaagaacgtaaaaatgaaattttatttatcgatgctcgtgaaatcggtcatatggtatctagaacattaaaagaattttcagatgaagatattcaaaaagtagcacaaacatatcatgcgtggagaggtacaaacgataaaccttatgaagatatagctggtttttgtaaagtagctaatttagaagaagttaagaataatgaatacattttaacacctggacgatatgttggtttagctgacgttgaagaagaggaagaaccttttgaacaaaaaatggaacgtattacttctgaattaagtgaacaattcgcaaaatcaaaagaacttgaagaccaaatccgtaaatcattggagggactaggttatggagtttaa

SEQ ID NO: 3185 - DNA, 1293 bp, Staphylococcus epidermidis
ataatgactattctagcgattattatttttcttttaactcttatgtttgttatttggcaacctaagggtttagatattggtattacagcattgattggtgctatcatcgccattattacaggcgttgttagtctctcggatgttattgaagttacagggattgtttggaacgctactttaacttttgtcgctgttatactcatttcattaattttagatgaaattggatttttcgaatgggcagctatacatatggttagagcttcaaatggtcatgggtttaaaatgtttgtctacattatgttattaggcgctattgtagcagctttctttgcgaacgatggagctgcattaattctcactccaatcgtgctagctatggtaagaaaccttgggtttaatcaaaaagtcatttttccttttatcattgcaagtggattcattgcagatactacatctctcccattaattgtaagtaatttagtaaatattgtttctgctgactacttcaatattggatttatcgaatatgtaagtcgtatgattattccaaatatattctctttaatagcaagtattgttgtattatggttatatttcagaaaagttattcctaacaattttgaaattaaaaatcttaaaacacctaatcaagcaattaaagatccaaaattatttaagttttcgtggattgttttgtcaattttactcattggttatatagttagtgaatttattcaaattccagtatcgttaattgcttgtttgattgcacttatatttactgtactggcctataaatcgagagtagtaaacacgaaacaagttatcaaaggcgcaccttggaatattgttctcttttctataggcatgtatttagttgtatttggtctgaaaaatgtgggtattactgcactattagctaatattctatcaagcatatcaaactatggactgtttagtagtgttataggtatgggcttcatatccgcatttctttcagcaattatgaataatatgcctaccgtattaattgatgcaattgctattggacaatctgcaactactggtttaatcaaagaaggcatgatttatgccaatatcattggcgcagatttaggacctaaaatcacacctatcggctccttagcaacactgctatggctacacgttttaacacaaaagggagtaaaaatttcatggggcacatattttaaaacgggtattgttattacgattcctgttctttttatcacattagttggtttatacgttacacttattgtattttaa

SEQ ID NO: 3186 - DNA, 192 bp, Staphylococcus epidermidis
aaacttaatattcctatacatgcttatatttctataattaaaaatactgtcattacggcacttttgacatatacgaaaacgataaaatatgatgataaacctaaacaaaagcgtcaagcatattgcaaaagtctaacttattttgcggaactgtatttcaatggtaaaattataaataatattattctataa

SEQ ID NO: 3187 - DNA, 417 bp, Staphylococcus epidermidis
ggtgacaatatggagatgaaaatcagtgaattggctaaagcgtgtgatgtgaataaagaaaccgttcggtattacgagcggaaaggattgatagccgggcctcccagaaacgaatcagggtatcgaatatattcagaggaaacagcagatcgggtacggtttattaaacgaatgaaggaattggatttctcgctaaaggaaatccacctgttgtttggtgtggttgatcaagatggggagagatgtaaagatatgtacgcctttaccgttcaaaaaaccaaagaaatcgagcggaaagtgcaggatttgttacgaatccaacggttattagaggaattaaaagaaaagtgtccagatgaaaaggcgatatatacctgtcctattattgaaacgttaatgggagggcctgataaataa

SEQ ID NO: 3188 - DNA, 945 bp, Staphylococcus epidermidis
aaggaggatataaatatgtctaaaatcgtcgtagctttgggtggtaacgctttaggacaatcgcctaaagaacaattagatttattaaaaagtacatctaaatctctagtaagtttaatcgataaaggatacgaaattgtaattagtcatggtaatggtccacaagttggaagtattaacttaggtttaaattatgcggcggaacacaaacaaggtcctccttttcctttccctgaatgtggtgctatgagtcaagcttatattggctatcagatgcaagaaagtttacaaaacgaacttcattcaatgggcatagataaacaagttgttacgctagtaacacaagttcaagttgcaagcgatgattctgctttcaataaccctactaaaccaattggattattttatacaaaagagcaggctgataaatttacgaaagaaaaaggttatacttttgtagaagattctggacgcggctatcgtcgcgttgtcccttccccacaacctataagtatagttgagttagatagtatagaaacattaatcactcatggaacactagttatcgctgccggcggtggtggaattccagtaattaaggaaaatgaagtttatacaggtgttgatgcagttattgataaagataaaacgagtgctttattagcagcacatttacaatctgatcaattaatcatattaactgctgtggaccatgtttacattaactatggaaaagaaaaccaaagaggtctcgatgaagtgtctgtggatgaaatgaaaaaacatatctctgatggtcaatttgctaaaggaagtatgcttccaaaagttgaagctgcacttcaatttcttgaaaaaaatactaaaggcagtgttttgattacatctctagcaggattaggggacgctttagacggtaaaataggaacattaattaagaattga

SEQ ID NO: 3189 - DNA, 1365 bp, Staphylococcus epidermidis
tgttcgatttttatttgcaaattcaaaatcatattggtaaaatacctagtggttaaacgagaaaaacttggaggtgctcatatgtcatcaatcgtagtagttgggacacaatggggagacgaaggtaaaggtaaaataacagactttttagcagagcaagcagacgtaattgctagattttctggtggtaacaatgcgggacatacgattcaattcggtggagaaacttacaaattacacttagtaccatcaggcatcttttataaagataaattagcagtaatcggtaacggtgtagttgtagatccagtcgcattattaaaagaactagatgggttaaatgaacgtggcatttcaactgacaacctacgcatctcaaatcgtgcacaagtcattttaccttatcacctagctcaagacgaatatgaagaacgtcgtcgtggcgataataaaattggtacaacgaaaaaaggtatcggcccagcatacgtagataaagcacaacgtatcggtattcgcatggcagacttattagaaaaggaaacattcgaacgccgacttaaagaaaatattgaatataaaaacgcatactttaaaggcatgtttaacgaaacttgtccaacattcgatgaaatctttgacgaatattatgctgcaggtcaacgtttaaaagactatgtgacagacacagctaaaattttagacgatgcaaatgtggctgatgaaaaggtattattcgaaggtgcacaaggtgtcatgttagatatcgaccatggtacatatccattcgttacatctagtaatccagttgcaggtaacgttacagtaggtacaggtgttggccctacatcagtgtctaaagtgattggtgtatgtaaatcatatacatctcgtgtaggtgacggtccattcccaactgaactttttgatgaagatggccaccatattagagaagtgggtcgtgaatatggtacaactactggacgtccacgtcgtgtaggttggttcgactcagttgtattacgtcattcacgtcgtgtaagtggtatcacagatctttcaattaactcaatcgacgttttaacaggattagacacagttaaaatttgtactgcttacgaattagatggtgaaaaaattactgaatacccagcaaacttagatcaattaagacgttgtaaacctatcttcgaagagcttccaggttggactgaagacattacaggttgccgtagtttagacgagcttcctgagaatgcacgtaattacttagagcgtatttcagaattatgcggtgtccatatttcaatcttctcagtaggtccagaccgcgaacaaacgaatttattagagcaactttggtag

SEQ ID NO: 3190 - DNA, 936 bp, Staphylococcus epidermidis
tcaaaaagtatgggagtggcgtatgtgttttcaaaaatacaacctaaagcaactattttagcaattatttcattattagtagtcgctttagtaacacatgtattacctgttctcggcttgattttatgtttatttgcaacgattcctggtattgttttgtggaatcgttccatacaatcattcggaattagtgcattagtaacagtcgtacttacaacattattaggtaatacatttgtcttaagtatgatggtcttaatcttattattaagtgcgattatcggacaattacttaaggaaagaacatctaaagaacgaattctttatatttcaacagcttcattaagtttagttacacttattggatggatgttattacaaacattcgataaaattccgacggcagctgtattaattaagccttttaaaaatgcaatgcatgaggctttcttaacaagtggaatcgattcaaactatagacagattcttgaggaaagtttccgacaaatgacggtccaactccctagttttctaattatagttattttcatttttgtcttaattaatctgattattacatttccaattttacgcaaatttaaagtagcaacacctatttttaaacctttattcgcatggcaaatgagccgtaatttactatggttttatcttatagtacttatttgtgtcatgattgcaagtgaaccaagtacgttccaaagcatcgtgttaaactttgatgttgtgttatcattagtgatgtacatccaaggattaagtgtcattcacttctttggtaaagctaaaagatggccgaacttcgcaacaattcttgttatggtagtagggacacttcttacaccagcaacgcatattgttggattacttggggtaattgatttatgtattaatttaaagaaaataataaaaaaatga

SEQ ID NO: 3191 - DNA, 333 bp, Staphylococcus epidermidis
ctaggaggtatatttatgtcttataaagaattatcagcaatattaaaagttttatcagatccaagtcgattagaaatattagacttattatcttgcggtgaactatgtgcttgtgatttattagcgtattttcaattttcacaacctacattaagccatcatatgaaaattttagtggataatgaattagtatctacacgaaaagacggtactaagcgcatgtaccgacttaatcatacgttcttagattcaatcaacaaagaattaacttatattagttctcctactcaacaatgtatgtgtaaaaagataaagacaggtgaatgtaaataa

SEQ ID NO: 3192 - DNA, 126 bp, Staphylococcus epidermidis
aacaagatttttacaaacaacttgaaaaataaattgaaccaccacagatttaaattaatctttatcaaacttcgatacagtcttaactataaatttttaatatttagcaaatacattcataaataa

SEQ ID NO: 3193 - DNA, 1557 bp, Staphylococcus epidermidis
aggagattcatgactatggaaatggcgaaagagcaagagctgattcttgttttagactttggtagccaatataaccagttaattacgcgtcgtatccgtgagatgggcgtttatagtgaattacatgatcacgaaatttctattgaagaaattaaacgaatgaatcctaaaggtatcattctttcaggtggtccaaattcagtgtatgaagaggggtcatttaccatcgaccctgaaatttacaatttaggtattccagttttaggtatatgttatggtatgcaattaacgactaagcttttaggtggtaaagttgagcgtgccaatgagcgtgaatatggcaaagctacaattaacgctaaatcagatgaacttttctttggcttaccttctgaacaaacagtatggatgagtcattctgataaagtaattgaaattcctgaaggatttgaagtgattgcagatagtccaagtactaattatgcagctattgaagataaaaaacgtcgcatttacggtgtacaattccatccagaagtacgtcacactgaatatgggaacgacttactaagaaacttcgtccgccgtgtttgtaattgtacaggtgaatggacgatggagaatttcattgaaattgaaattgagaaaatccgtcaacaagtaggtaatcgtaaagtattatgtgcaatgagtggtggagtagattcatccgtagttgctgtacttttacataaggcaatcggcgaccaattaacatgtatttttgtggaccatggtctattacgtaaaggtgaaggtgacatggtcatggagcaattcggtgaaggttttgatatgaatattattcgtgttaatgctcaagaacgcttcatgagtaagctaaaaggtgtgtctgatccagaacgtaaacgtaaaatcattggtaatgagtttgtatatgtctttgatgacgaagctgcgaaattaacagatgtagatttcttagctcaaggtacgttatatacggatgtgattgaatcaggtactaagacagctcaaacaattaaatctcaccataatgtaggtggattacctgaagacatggaatttgaacttattgaaccaatcaatacattattcaaagatgaagtgcgcgcattaggaatagaattaggtatacctgaacacttagtttggagacagccgttcccaggacctggattaggtatccgtgtacttggagaaattactgaagataagcttgaaattgttcgtgaatcagatgcgattttacgtgaagtgattcgtgaggaaggtcttgaaagagatatctggcaatactttacagtacttccaggtattcaatcggtcggtgtcatgggagactaccgtacgtatgatcatactgtaggtattcgtgcggtaacatccatcgatggcatgactagtgactttgctagaattgattgggaagtcttacaaaaaatttcaagtcgaattgtcaatgaggtggaccacgttaatcgcgttgtctatgacattacctctaagccaccaagtacaattgagtgggaatag

SEQ ID NO: 3194 - DNA, 600 bp, Staphylococcus epidermidis
tttcaaatcataattaaggagtttaaagcaatgaatgttagcaatcaaatcaaaaaatttagagaaagagatgggtattcacaagaatttttggctgagaaaatgtttgtttcaagacaaactatttcaaattgggaaaatgataaaagttatccggatattcataatttacttattatgtgtcaactcttcaaggtatctctagacgaactagtggaggatgatttgaaaaacgtgcaaatcaaaaatattaaaaaagaattagacttttggacatggatgatgataattacaatggtattaggaagtgttctcataggtcctatgattcattactttcattggttaggaataggaataacatatttagtatttttaataggtatcattgcttctacaaaattagaaaaaattaaaataaaaaatgatattgaaacatacgacaggatattagcatttattaatggtaaagatcctaaagaggtgcaaaaaagtaagtttagagatatatggacatcctcaatttcttttattttctttgttggtgtgatcatcggtataagttacttaagtatcattttaactgattattttttataa

SEQ ID NO: 3195 - DNA, 537 bp, Staphylococcus epidermidis
tgcttttacattaaaattaaaataaaagaggtaaaccttatgtataataaagtttttgcaattttaattataattttttccataataattattgcgtctaatgatactttcgcagaaagtaagaatgacatgatgaacatgaaagaagataagaaaagtacaatggacatgacaaatatgaaacatcatgacgaaagaaagaaattaaattcttcacaaggaaaaaatgaaataatatttcctgaagttgcagagtcaaaaaaagataacaatggttataaaaattatacattaaaagctcagaaaggaaagacagagttttacaaaaataatttttctaatactctaggctacaatggaaatttacttggaccaactttaaaattaaaaaaaggagataaagttaaaattaagttaataaataacttagatgaaaatacaacatttcattggcatggattagaagtaaatggaaaagtggatggagggccttctcacgttataaaaccaggaaaagaaaaaaactataaaatttga

SEQ ID NO: 3196 - DNA, 159 bp, Staphylococcus epidermidis
aaaggagtcttttgtatgaactatttcagatataaacaatttaacaaggatgttatcactgtagccgttggctactatctaagatatgcattgagttatcgtgatatgtctgaaacattaagggaacgtggtgtaaacgttcatcatttaacggtctag

SEQ ID NO: 3197 - DNA, 162 bp, Staphylococcus epidermidis
ttattacacattatcttatctgctctttatcaccataaaaatagaaaaaacaagattcctaaagaatataggaatcttgtttcagactgtggacaaactgattttttatcagttagcttatttagaaagttttatttaaattacagtttctatttttattag

SEQ ID NO: 3198 - DNA, 1044 bp, Staphylococcus epidermidis
aaaaataacatgaataaaatattaattgaaaaggagatattcaaaatgaaaaatttaagaaatagaaactttttaactttgttagacttcacacaaaaagaaatggaatttttacttaatttatctgaagatcttaaacgcgcaaaatatgcaggaatagaacaacaaaaaatgaaaggtaaaaatatcgctctactttttgaaaaagattcaacacgcactcgatgtgcatttgaaacagcggcttatgatcaaggtgcacatgtaacataccttgggccaacaggttctcaaatgggtaaaaaagagtctaccaaagatactgctcgtgttttaggtggaatgtatgatggcatagaatatcgtggattctcacaaagagtagttgaggatttggcaaaatattctggcgttcccgtatggaatggtttaacagatgaagatcatcctacacaagtacttgctgattttttaacagctaaagaagtattgaaaaaaccatataatgaaattaacttcacatatgttggagatggacgtaataacgttgcaaatgccttaatgcaaggagcagcaatcatgggcatgactttccatcttgtatgtcctaaagaactaaatccaactgatgaattattaaatcggtgtaatgatatagctgacaaaaacggtggtgaaatccttataactgatgatattgatgaaggtgtcaaaggatctgatgtaatttacacagatgtttgggtatctatgggtgaacctgatgaagtttgggaaaaacgtatcaaattattagaaccataccgtgtaactaaagaattaatgaaaaaaacaggtaatccacatacaatttttgaacattgcttaccatcattccatgatactgaaacaataatcggtaaacaaattcaagaaaaatatggtctaactgaaatggaagtaacaaatgaagtatttgaaagtgaacaatcagttgttttccaagaagcagaaaatagagcacatacaataaaagcagtcatggtagcaacattaggagagtaa

SEQ ID NO: 3199 - DNA, 927 bp, Staphylococcus epidermidis
tactgggtcttatttctacaatatttagctataaacaaaacgaaagtattggtgaaaaatatgaacttaaatgacttagaagctttttataaagtctgcgaaaatcgtagctttactaaagcagcgcaagaactgaattatgttcaatcaaatgtaacagctaaaattcaaagattagagtcttattatcaagtgaaattactatatagagataaaaaaggaattaaaccgacaccagaaggtattgaattactaaaatatattaagagaatattcacaattttacatgaagcagaacataatgtaagcaacaataaaaaattaaatattaacatagggacaattgaaacaatagctgcagttcatttacctaaattattgaatgaatataagaggaaaaatccaaaaattcaaattaatttaaaaacagataatagtattaaattaattgaacatgtaaagaatagagaaatggattgtgcttttatatctgggaatattaacgataaagatcttatttgcacaaatatctttaatgaaaaattagtgattttatctcaaaagagcaactttaaacagaatataaacgaaaataagtctattataatgtttggcgaaggttgtttttatagaaaaatttttgaagattggcttaattatcatgatattaatatagaaaataaaatgacattaaatactttagatggcattttggggtgtgttgaagctggattaggtatagcatttttacctatgtcagtattaaataaaggaaatagcgatggtatagaaataaccaaagtagaggaatcatttcaaacaatatcactaaatatcatttatcgacaagataataaaaataataatgtgataaatcaattgaaacaagttgcttttgagaaaatgaaatcaaatataataaaatag

SEQ ID NO: 3200 - DNA, 324 bp, Staphylococcus epidermidis
ataacattaataataatgaaaggaatgggaattatgagtaacatcataaaaacaataggcaaaggtattggaaaaggtgtcggtgcagcagcatattattcagttgcgactgttggtgctgccatcggtgcgatttgggaaacaacaggcgatagaggtttgatgagagacgctttaagtgatagctctaaccaagacttaatagaaatatatgagatacaaaagaaagatgatggggattatgatacttatattgcggctaaatccttattacaagagagaggattcacttataatcatgaaacgaataaatgggaaaaataa

SEQ ID NO: 3201 - DNA, 549 bp, Staphylococcus epidermidis
aaggtgttaattatgaatttaactactcaaatcacaaaaatgttaggtattaaatatcctattatacaagctggaatggcaggaagtactacgccagaactagtttctactgttagtaaacaaggaggcttaggtatgataggagcaggttattttgattcacatcaactttcgaaagagattttagaagttcaaaaactgacacaagctccttttgcagtaaatctatttacacccaatgatattaagtacgataaaaaacaaattgagcagatgaatacaaaactcaaaccatatagagaagcgcttggattatctactcccaaaaatagtacggttaaagaaaaagaaaagtttgaagatgcaatagaagttattgaatcattaaaagtacctatcattgcttttacttttggtattccaaatcaaaatattattaaacgacttcataatgcaggaaaaattttaattggaactgcaacatcagtcgaagaagcagttgaaaatggaaaatgctggtatggatatagttgtagcccagggctatga

SEQ ID NO: 3202 - DNA, 135 bp, Staphylococcus epidermidis
aaaaagctaataaactgttcaacattcatatgtaaggcttcggtatgtgtgacgttagactacggttcgtctaaatcccctaccctacttaatctttttattaaacacttttgcaattttaagcacatgctctaa

SEQ ID NO: 3203 - DNA, 234 bp, Staphylococcus epidermidis
gaggtcataatgatgacattagaacaacaactcaaacactatataactaacttattcaatctgccaaaggatgaaaaatgggaatgtgaatccatcgaagaagccgctgatgatattctacctgaacaacacgtaagacttggtccacttagtaataaaatacttcagactaatacctactactcatacacacttcacaaaagtaatatctatcccttcatcctctactattag

SEQ ID NO: 3204 - DNA, 675 bp, Staphylococcus epidermidis
tatgtaataatgaattgtaaaacgacatcgaggaggtttcttatggacggtttaattacatttatcattatcacattattgattattatagtacctgggccagatttcattattgtaatgaaaaacactattaattcaagtaaaatgaatggttttatggctgcatttggtattactacggggcatattttatactcttcattagctatttttggaattatatacatacttacgagtttacactttgtttttttaacaataaaaatattgggtgcttgttatcttatttatctcggaatcaaaagtattttgagtgcgcacagttctgttgattttagtaaacaagctttagctgatgtcagaaatgtgagttatatcacttcttttagacaaggttttttaagtacaagtcttaaccctaaggctttattattttatgttagtatattcccgcagttcctttctaacggtaatatacatatgaaatctgaagttgcgttatttgctttttcagttgttgtagttatatgcttatggtttttattttgtgtattcatctttcaatatattaaattattattcagcagaccgagattcaaggctatatttgattatattgtagggtttgttttaattggcttatctattaatttattattaagtaaaagtagctaa

SEQ ID NO: 3205 - DNA, 474 bp, Staphylococcus epidermidis
tcaaaaataataaagggggtaataaaaatgaaaaaagaaaaacgtttaaatcttatcttaactgttatacaacagaatcagtttaataaaaaacaacaaatagtggattacatggcaagacattttggagtttactatagcttgacaactatttctcgtgacttacaagaattagaaatttacaaaatccctgttgaaaataaaaagtatatttacaagaaaataaatcaaacaaatcaattaagtgcaaaaaaacaattagaaatatttagtgatgagattattgaatttataacgctaaataactatgtcttaataaaaacatctcctggctttgctcaaagtataagttattacatagatcaattacaaatgaaagaaatattaggaattattggaggtaacgatactttgatgattttgacttcttcaaatgaaatagcagaatttgtttgttatcaattattcccttaa

SEQ ID NO: 3206 - DNA, 129 bp, Staphylococcus epidermidis
gcatattcaatcctttatttcttctttataaattcctattttactaatcttaatttattacaatttatttttgaaacatacataaccgaaaatcttgtacttaatgcccttccccctacgctctcttaa

SEQ ID NO: 3207 - DNA, 174 bp, Staphylococcus epidermidis
gtctactcaatgtttaaagttatatatcatctcaaattttcaaattacctttctatatttcgctcgatagacaatactcttgtatatcctgcaataatgagtttttaccttacaaaatcaaaaccacccgtacaaacggatggtttactttgcatctataattttttctattga

SEQ ID NO: 3208 - DNA, 159 bp, Staphylococcus epidermidis
aacaatgttttaattaaaagatctaatcttaactatcacatgacaatacactctaaccaaggttatcattaccaacacaagtcatatattaatattcttaaagaaaatagcgcatttcaaagtatgactagaaacgcaaattgtcttgataattattag

SEQ ID NO: 3209 - DNA, 465 bp, Staphylococcus epidermidis
ttaccacaaattgttgatgatgtgtctataccagtaattgcagctggtggtattatggatggaagaggtttagtagctagtttagctttgggggctggagcagcgcaattaggtactgcttatttaacaacgaatgaaagtggcgctgatgacaaaatcaaaaatgaaattattgaaagctctgaaacagatacaatactgacaaatgtatttagtggcaaattggctcgcggaattatgaatgaatttgtacacaatatgaatttatattcaaaacaggtgcctccttatcctttacaaaatcaattaacaacgcaaatacgaaaatctgctttggagaaaggatatactgagtggacccatatttggagtggacaaagtactagattagctgacacagtcgatgcagctcaattaacaaaaaatattattaatgatgcagtcaaaattatcaataataagtga

SEQ ID NO: 3210 - DNA, 2739 bp, Staphylococcus epidermidis
ggggaacaaatgaaaaatatagatatcgcaatttatgatatagataaagttatttgtaaaagtattgagaataactcatcagatttaggttatttatcacaaagtatcttatcacatttaagaaactacgtagaacatattggtatgaaatattatttcgaaagtgtaaatgaagatatgactaatagttcttcaaatatctataatgaaatacaaatgggaataggttattttaggaagcattacaaattgaattggcttaaaaattttcatgaattacttcagcaatctgtttctcattatacatttgatgaagatagatccgaacggttatttataaagtattatgacttaatgttagaattaaaagaaaagttaaagaaagattttgaaatggatttattgcaaaatttatataaagtaccgctgaatattgatagtgatttaaaaggatattatcatacaatatctcaattaataggtaataaatacactgataatgaatatgaagtagataattcaaggtattatattgaaaaaacaaaaccatttgttattgaaaataaagtatattatgaaattacatttagaaatgcaaatgataaaactagtaaatacgaaaggctgattggttattcaaaacatagaataaacacaaattatgctgtaaaattcgcattagaaatgcaaacaataagttatttagggattaaagctaacgtaataataataaatgattacgaaatatctataagaccttgtgaatttaataattttgctaaaatattagattacgatttaaaattacaatcaaatcataatgaatataaaaaattaatgaaattgttaaaagaatttaatttacatttacttgatattgttttgttagatgacgatgaatttaatgaattggagtgttcagtgaatagcgaatcagcagttattaatatttttaatgtgttgagactagcaagaagatatattttaacaaataaatcaggcgcaaatgttcttaggtatttattatttgtttttaacaataggataattcgtttacagttaccttataataggaataaatgttataaattatctaaccttatattggattataaatgtgttccatttgatcaaatgccatttacagcctctttaaaaggccataatcctaatatctatactttgttacaatgtatagaatacaaagggagagaatatgaattattagtcaggaagattcaaaagaatactttgaagaataagaaagtttatacaagcaaagaagaaattgagcagtatggtgttgtaaacgaactaatcgataaatataataataatttgtattataagcatcgaccgaatagggaaatacattcatttggtgataaatattatttatatgaaaatgagcagagtattatgagtataataaagtcaattaaactattgtcaaatgaaagcgtagagggctattcaaattcagtagagttttggctaaataatgaatatacatcgttggattgtaaagaaaagaaggaaatactcttaagaatgttttcaaatagcaaaatatcgatggtatacggagctgctggaacagggaaatcaactttaataaaccatatttgcaattttttctatgataaagatgttatcgtcatagcaaatactaatactgcagtagacaatattaaaagaaaaatcaaattatctaacattaaaacgtctactatttctaaatttttatataatgataaagaaaagtatgacttgttaataatcgatgaggcaggtacagttagtaataaggacatgaatcgaattcttgaaaacaagcaatttgaattattattaattgtcggtgataattatcaaatcgaatcgatagattttggaaattggttcgaaattgccaaagatgttttgtcaaaaaatataatcaacgaactaactgatatgtatcgaactaaaaatgatgatttactttacttttggaaatctgttagagaaaaaaagagtaatttaaatgaaattattaatatgaataaatattctacaagattagatgaaagtatatttaatgaattcaataaagatgaaattattctttgtttaaattacgatggtatatatggtatcaataacattaatagattattacaagcaaataataaaaatgattctgtaatttggggtgtgaaagaatataaagttggtgatcctattctatttaatgaaactaataagtactcaccaatactttttaataatttaaaagggtcaataattgaaatacatgtttttgaagaatatatattgtttgatttagaaataaataaagttataaatgaacttgatattatttcgttagaaattgatttaataagttcttctgaaaatagttcggtgattaggattagagtagaaaaaagtgatgggttgaatgatgatgataatgattcatctgatagtatagttccttttcaagtgagttatgcaatttcaatacataaagctcaagggttagagtttaattcagtaaaaattgttatatctgatgatttagacgaacaaatcactaacaatattttttatactgcaattacacgagctagagaaaatttaaagatttattggtcaccacgaactgaaaagaaaattattgataatataatttctaaaagaaacttgaaggatctttctatattaaaatctcgaataaaaaaacaaaatacttag

SEQ ID NO: 3211 - DNA, 180 bp, Staphylococcus epidermidis
tttaacgaaattcatattttcatcccttattttcatcttcttttcaatcgtaatccaaggtcgttaattcaatataaaattaagattaaaaaattattaatgtttttaaagatgagaagtgatttgtggataactagaaaggtgaaaaataaaaaagttgttatagcaatgtttaagtaa

SEQ ID NO: 3212 - DNA, 1824 bp, Staphylococcus epidermidis
cagcaacccttcgaaaggaggtgttcgctaatgactcaaactaacccttcatttaatccttcaccacgatacaaatcaaaaaaaggttggtataaagacaagcctcccaaagaaaaaggaggaatgcctactgaagttgaaatcgcaggtcctatcgttatcgaaaataagtttattgaccctaaaactaacactgaaaaagtaattattacagacgaggatcaaaaagtaattgttgaatctagtgatattttaacaacacaaaaactgccctctttaatgaaatatggatttagtattaatgaaaaatatacaaaagatttaggttatgcgttgcaacaaatgcgcaaccaattacccatttcctacttatatgaaggggtaggtatactggaaacaccgtttggtcctattgtatcgttaaatgaaatctatactactacggaatttgataataaatctccatctgacgccatttgtgagaatacttatgacttagcacctaggggaacatttgataattggtttaacatgtatattgacgaggttaaagatcatcttcttttagaattgacagtcatatttgggatttctgccttagtgacaagttttctgaagcataaacatgaaatcgaatttgcaggaattctctttagttttacaggtcaatcctcaaccggtaagtcaaccgcagctgctttagctgtatcagtcgctggtaaccctaccaaaggtaatgaaactctttttagaagttggaatgccacacgtaacgcacttgaaggttatttgagtaacaattatggcgttcctatagtatttgatgaactttcatctacgacacttaaagataccacaggtttgttatattccatcgctgaaggtcaaggtcgtcaacgttccaatgtacacggagaagttaaagcgcctaagaattggggtacatctgtgatttcaacctcagaatacagtatatttaatgattctgctcaaaatgatggtttacgtgtgagaaccatcgagattaatgaacaattcactacaaatgcgaccaatgctgacaatattaaaaaagctgtagcactaaactatggtcatgttttaccgttagtagctaaatatcttataaatcgtgaagatgaagttattcaatggttttacaaggaagtagattggtttgaagctaaattgaaagatgaaacaaacaatacaggtattcgtatgtttaagcgttatgcagtcattacaacatctgcgaaaatattaggtcgtgttttatctacagatattgatatcgctaatataagagactactttattgattatcatactcatacagtctctgaacgctcattagctgataaagctattgatgtcatcattcaatttgtggcacaaaacagaggtaagttttcagatgaaggtgctttgaaaaatatgtttgagaactatggattaatctcattaaaagatgaccatatcgaagtaaaaataattgcgaacgtttttaaacagatgctaaacaatcatcaatttcaagatgttaataatgttgtcaacgccttaagagataaaggtttcatattagctgaccgtggacgccaaacaactaaaagaagtgtcaaagataatagcggtaaaaaacaatcacttgtattttaccatctaaaattagatgtagagtttgcatctatcctcggattaactaaagataagtcgttacttcaaaattggacaccgtcaaatgataacaaagctgcgaaagaactttttaaatccgctaatgaagggataggcccttcaggagttcacgaagatttctaa

SEQ ID NO: 3213 - DNA, 600 bp, Staphylococcus epidermidis
ggagacagaatggaaatttatttagtgaggcatggtgagtcacagtccaattatgataataaacacgggtatctatatttttgtggacagttagacgtccctttgacggaaaggggtataaaaagcgctaaagaactatctgtttattttaaaaataaatacattgacaatgtatatgtatcagatttaaaaagaacaaggcaaacgtatgaggagctatttccttatgatattccaacaatatatacaaagacgttaagagagcgttcgttaggtgtttttgaaggtaaaaataaagaagaagtttgtaaagacaaacggttcgaaaaatatttccgtgatcctaattataaatactttagacatagcttttcgcaaaaagcaccacaaggagaaagttatcaagatgtctatgatagagtggttactttcattgaaaatgagcttaatcaacagcagagacgtgtagtgatagttgcgcaccaagttgtaattagatgttttttcgtctattttaaaatgataactaaggaaaaagccttaacgacggaaattcataattgctatccatatttaattaaagaagaaatgaagttttga

SEQ ID NO: 3214 - DNA, 825 bp, Staphylococcus epidermidis
ctaggtggaattatgaaaaattttaaagttcaagaagctaaagaaactccattaagtgctcaaaatgcaaatgtattcattaaatgtgttaaaaaatataattggcttaaagacataataataaatggttatttccaatataggtatgtaactgaagaagtagaatatttaaatatagagactactgacttaagtggaaagagaattcctatcgaagacattacgtttccaatgttatgtttttgtgatataccattaaatcaattaaaagatcataataaatggtatggagactatgcgatatgtatgaaaaaatcttggggagtaaacaaaaacctacagccattgcattatgtatcgaatactagtgagtatattaaaatgtatcaagaagtgtttaataatatagttaataaaccagacactgatgaaaaagtatatgaatttatattcgcttcattatttttcttaaaacattttaaaggaagtcaatattgtgaaaaaactgataaaatagaagagaaaatattcatggatgaacaagaatggagaagtataaaattagttgatgaagatttagatcctttttacatcaatgaaaatagtgactctaaaagaaattattataatgaagctttaacaaaattatcaagtaataaattagaatttaattgtgaagatattaggtacattattgttgaaaaagaagaggacgttattcagctaataaatgatattaattgctctaattacgatgatcaagaaaaaagcttactcatttcaaaaataagtgtcttaaatcacttaagagaggattttatgtaa

SEQ ID NO: 3215 - DNA, 1530 bp, Staphylococcus epidermidis
aagagagtgattatcatgattaaaaataagtggaaaatagagctgtggtttcaattcttcagttattttatacacaaaattgattccgaatttatactaaaagaatatgcacaacatattttacctgaagaaatgagaacaaattatgtagtgggagaagcacaacctaatgaaactatatatataagctactttgtaaatacctctaatcaaaatattgaacaacacactgtgaaatgtagtgaagagggtatatttatcgataaaattcctagtggctttactaaagataatctgacgtattctattgatagtcaaagtatggtggacatagatgaactttcaaatgaaatcattgaccaaggtgtagatgctctagatgtgttagaatcaacaactctagatacatatttcaccgagttcttaaccacaatcaataaaacaacagattttgctaaaaagatagctaacaatacaataaaacagattcgagaaaatattgaattaaaaaaagctaactatagaatagattatgaaaaagctattgacgatgtatcttctttggaatcatttataaatctgaaagatacaatattagaaactcatcaagatttatctaaagaaaattttgacgatgtattaataagtgattttttaacgaaatatctcatttataaagaaaaacaagactcttatgttaagaaaaatatctcaaacttaaataagtctaactactttaaacaattagtgacggaaggtttaatcaaagaacgaacaagtaattctcaatactttgaaattgctaatagtatcaaaccttcgattcataacaagtatagcttaaatcaatctgatgagttagaccaatttaggcaagctgttatcggcatttctctcaacttatatgatcaaaatgatacatactttaaattcatccgtagtattctgacagaaaagtcacgtaaagttaatttaacaatagatggacttattgagtctcaaaacactataaatgaatttatgaaaaaacaagatctaattagcgacaatgaattatattatttaacaactattgaagatacgttccactttgcattattcactgccatttccgatttaatggatgaattagttttagtaacaagtaaaatcattcaaagtgcgacacaatacgatgtattagtcgctttatatagtatttctaatttaaaaaatgatttgaataaattagcacacaaacacgaacgatcattaacccgttttaaaagtcttattgatggttatgtaagaaatactagattaaaagatttaattcataatattattatgaatgatataaaaatgacagaaaaagtagaaaggtctttactcaccgatctaaaaaaatataatattagcaacttttataaaagagacaactttaataataatcctaatgattttctcgataaactaatgattcaaataatcagtaagttttacaagacacgtttagaagatattaacgatggaccaaatttatattattaa

SEQ ID NO: 3216 - DNA, 471 bp, Staphylococcus epidermidis
gaaatcacgattgagaatatatattgtactcattgtatgtgtgattgtgatgatgcttcttctaagttcaattctaccttcatacgtagcaattttaatagccgcaattgttgctgcattgttaggggtggtgatggaaaaatgacgacagatttacatacattagtacttattgttttatgtggcgtggtcacattactcgttcgagttattccatttattatgatatcacgtgtcaacttaccagcaattgtaattaaatggctttcttttattcctatcactttatttacagctcttattatagatggtgtaattcaacaacatgatcatgcatttggttatacgcttaatttaccttatattattgcaatcgtgccaactgtgatgctcgctattttcacacgtagtctaacagtgacaattctcggaggtatatttgttattgcttgcttacgtttaatcttttaa

SEQ ID NO: 3217 - DNA, 132 bp, Staphylococcus epidermidis
ggtgtgaagattaaaaaatatattaaagaaatacttgataaaatttatgaagattttatgaataacgacgctatcacaaccttacttaacaatgatttacagactattattaatcaatatctatcaaaataa

SEQ ID NO: 3218 - DNA, 342 bp, Staphylococcus epidermidis
ttagaggagatcgattcatttaatgaattattttatttaatagaattatatttgaaggcatttaaaggacaaaagaaaacaggctatgaatttgaagaaagattgaacacatttattcaatcatatgtcattattttacttatagatataaggttaccgactgttaggttatatattattaggcatattgtggatacatgcgaaaaagaagtggacaatcaaaaaagaattatactaatagagaaatctattaaaaagtacagatatgtaaaagaacagattaaaagatttggaaatgcgttgaaagaagaattatctaacgcgactttgtctattgaatag

SEQ ID NO: 3219 - DNA, 1413 bp, Staphylococcus epidermidis
cgaccttggattacgattgaaaagaagatgaaaataagggatgaaaatatgaatttcgttaaatcaaaaactgacttatttagactcatagacaatgaagctcaaacatcgacatctaaggtggttttattcttaatattaggaactatatttttagatgcatatgatattactattttaggtacaatgactgatcaactcactcaacagtttcatttatcaccagcaacgctatctatagtaatgacctctttacctattggtgcattatttggtgcattacttggtggtacattagcatatcagtttggacgcaagcgtattttatcaattgccttactaacacttactgtaacctctcttggtgcggcactcgcaccaaatgtaattattctaataatatgtcgttgtataatggggtttgctattggaatggatagtccagttgctttcacttttattgcggaaataagtaatttaaagcacaaaggaagaaatgttaactattggcaagtcgtttggtatgttgcaatagttacttctgctttagtggtcactgcgttctttatgctaggggctggtgcacatttgtggagatatgcagttggatttggtgcacttattgcttttgtcttgtacatcttgcgaattaaatatttacacgaaagtccgacatgggtgattaatcattattctttagaaaaagcaactgaatttataagaaaatattatcataaagacatccacctagagggaacgcttgaagatgatttaaattctgatgtgacttcgccacataattcttggacagacttatttaaaccgagatatataaaaagaattatcctagcgactgcgatttcaacattacaaggtatgcagtactatggtgtcggtttatacatacctattattgcaacttatcttattagtaaggataaaataggtgtattattaggtactgctatagtcaatatagcaggtattctaggcgcatatttaggtgctcaattgacttataaattaggtacacgcaagcttacaatgataggcttcacacttgtattactttcaatggtatgtgtaggactcttttatcatcatctaccaatgcttcttaacactttccttattggattatttttatttggccattcaggaggtcctggtactcaaggaaaaacaattggtgccttatcattcccgactcatttacgttcacaagctactggctttgtagaatctgtaagtcgtactggtagtatcataggtacttttgtctttccaatcattcttgctgcagtaggtctaacgaatactatgttaatcttgtccattgtccctttactcggaattatcataacagtatctataaaatgggaagctgtcggtaagcatattgaagtagaataa

SEQ ID NO: 3220 - DNA, 138 bp, Staphylococcus epidermidis
aaggaagggatttatattaaaattttgaattcaaaaattattgaaagggaagctaccttagaaattgaatctatggccactaactgcttttttatatcaccacttattaaaaaatgtaagaatattcctcagtgctaa

SEQ ID NO: 3221 - DNA, 207 bp, Staphylococcus epidermidis
aggacggtttttattatgaaattcaaagaattaatcaaacaatcatatgaggatttaaaaaacttaacagttaattggtttaacgtactcagtttaactgtaatcatatttattttaagtaacattgtcacaccgcttattggtatatctgtgggtttactcggtggtgcatatatcctaaagagacgtgaagagaaaaataaataa

SEQ ID NO: 3222 - DNA, 1476 bp, Staphylococcus epidermidis
atcaacaacttgaatttcttcttaaccccctttattcttattacatatgtcggaatactaaaaattaaaaaggagctatatatcgatatggaaatactttttacagtaattaatgtcatcgtgttacttgttttcctagtaatgttaaatattatggcaagaaaacacgtctcattccctaaacgtgtctttaccgctttagcaataggtatcgtatttggcattgtattacacctcatatatggtgcagagtctaaaactctcgaacaatcaacagactggtttagtattgttggagatggttatgttgcactattacaaatgattgtcatgccactaatattcatttcaattgttgccgcttttagcaaaatacaaattggtgaaaaattcgctaagatcggttcttatatttttatgtttttaattggtactgtagccattgcagctatcgttggaattttttacgctttgatctttggtttagatgcatcgtctattgatttaggtagtgcagaacattcacgtggtacagaaatttcaaaacaagccaaagatttaactgcaaacactttaccacaacaaattctcgaagtattcccaagcaatccatttttagatttcacaggacaacgtacaacttcgacaattgcagttgttatttttgcaacgtttgtgggctttgcttatcttagagttgcaagaaaacagccggaacatggaagcttacttaaacgtggtatagaagcaatctattctatcgttatggctatcgtaacttttgttttgcgattaacgccttatggcattttagctattatggcttctactcttgcgacaagtgatttttctgcaatttggacgttaggtaaattcttaattgcttcatacgcagctctaatcacaatgtatattatccatttaattatactgagtgtcttaggtatcaatcccgttaaatacgtgaaaaagacaatagaagtactaatctttgcatttacttcacgttcaagtgcaggtgcattaccattaaatgttcaaacgcaaacaaaacgtttaggtgtacctgagggaattgcaaacttctctgcaacttttggtttatccatagggcaaaatggctgtgcaggaatctatcctgctatgctagcagttatggtggcaccagtagcaaatgtagaaattgacttccaatttgttgttacacttattgctgttgttattataagttcatttggcgttgcaggtgtaggtggcggggcaacattcgcatcaatactcgtattatctacacttaatctaccagttgctctcgcaggggtactgatatctatcgaacctctcatcgatatgggtcgtacagcacttaacgttaatgactcaatgctagctggaacaggtaccgcacgcttaacgaatcattgggacaaaaaaacatttgactcaaatgattacggcgatttatctgcaaattaa

SEQ ID NO: 3223 - DNA, 177 bp, Staphylococcus epidermidis
aaaagtgactttaaaatgttttacgtgaaacaaaaattatcattatttagaaaattaggtgatttaaacaatatatttacaacaattgatttacgctataaactaaaagtaaacgatacgtttcgtttaataaatatggatgagaagggttattgtgtttggtatatcaatttctag

SEQ ID NO: 3224 - DNA, 123 bp, Staphylococcus epidermidis
gaagtttatgtttatcagaaaagtgagcaaagaggacgtaaagaggtttatattaataaaaaagacgcgtgcaatcatgctataagaagacatgattgcacgcgtttttatttaatattatga

SEQ ID NO: 3225 - DNA, 207 bp, Staphylococcus epidermidis
aatcaaaatgtttacaaccttacttttaaagattatcaaaaaataataatgactaaacttttgcaactctttaagacatcattgatttttaattttttattaaaattttatttagaaatagtaattttcaaaagatacttaattttgtttgatataatcacaccatcaaatgaaacgaggtgtaacaatattgaattggcaacgtaa

SEQ ID NO: 3226 - DNA, 147 bp, Staphylococcus epidermidis
ttttattgtgtaataaatatattgaattgtcaaaatagcgaaggcatgtttcaaaaagatggggtgatgaaattaactcgaatatcaaaaacaagcccaaaaaagatgttagtacaacatcttttttgggcaagtaaaataatgtga

SEQ ID NO: 3227 - DNA, 567 bp, Staphylococcus epidermidis
cgtggacgctttttattatgtgatgcttttaccagaagaatactaaaggaagtgacgatgatgaatacaatcaaaagtacgatacacacagaagccatatttagcgatgatgaacagcaccgctatttactcaagaaaacatgggatgaaaagaaagctgcatgcacagtgataacgatgtatcctcatttagacggtgtattatcactcgatctcacaactgttcttatcctcaaccaattagccaattcagaacgatacggtgctgtatatcttgtaaatctattctctaatattagaacacccgaaaacctcaaacatatcaaaaatccatacgatgagcacactgatattcatttgatgaaagcgattagtgaaagtgacacagtgattcttgcttatggtgcctatgcgaagcgaccagttgttatcgaccgtgtcgaacaagtgatggaaatgttaaaacctcataaaaagaaagtaaaaaagctcatcaatccagtaacaaatgaaattatgcatccactcaaccctaaggcacgtcaaaaatggattttgaaatcatag

SEQ ID NO: 3228 - DNA, 195 bp, Staphylococcus epidermidis
actttaagcgtctcaatatcattgagacgcttttttattattaattattttatactttttgatttatctccaggattagtcatttttcttatctttttaatttacacactaaaaaatatcctccttaacaataataagttatttaaattattgattaaggaggatatttttatatctatttatttctcaatctag

SEQ ID NO: 3229 - DNA, 270 bp, Staphylococcus epidermidis
cttttcttagtgatgataggatatgttgaccaaattggccgtgagattggaggggtggtttttatggttagttgttgttcaatcgatccatacactgaattcgaagtcattattattggtgccggggtgccggaggtttctcttgcctttcatttgacttcatacggcataaggacggcacttgcggatgaacagaacgtggataacagattaaaggactttttaagaacttttcaagaattgattgagcgcgattcgggtatgccgtga

SEQ ID NO: 3230 - DNA, 258 bp, Staphylococcus epidermidis
aaccccttagtgcatattttcaatgacatacgtactaaggggttttttaatgcttattctacttcaatatgcttaccgacagcttcccattttatagatactgttatgataattccgagtaaagggacaatggacaagattaacatagtattcgttagacctactgcagcaagaatgattggaaagacaaaagtacctatgatactaccagtacgacttacagattctacaaagccagtagcttgtgaacgtaaatga

SEQ ID NO: 3231 - DNA, 123 bp, Staphylococcus epidermidis
agtatgttagtaattgaagctaacatatacttcgttaatttatctatttatatgaaccaatttctaggtaggaagttggaaatattggtaattgaattcagatggaggtgttttgcatggtaa

SEQ ID NO: 3232 - DNA, 510 bp, Staphylococcus epidermidis
tgggtatttttagtaataccatcgatatatgaaaggagtaatatgatgagtaatatcacagtttataatgtcattgaattgggcgtaaacaatcttttagccgattatgacaattggaatgttgaagaagtattagataaagaaactcaacatttcccaaacactttacattggcaatatggtcatgtattaacaatctttgaacaagcattatcattaggcaatcaacatgtagtagatgttgaaaaatataataaattgtttggatatggttcaaatcctagagactggaagggacaagatgtacctgctatcaacgaaatcaaacaacacattcaaacattaccagaacgtgctaaaaaattaacacacgagcagttagctcaaaaattagaccaacctatcgcaggttgtaacacacttgatgaattattaatgttaaatgctatccatgtgccattacacaccggtaaaattgaagaaatgacacgtgtacttcgtgaaaaataa

SEQ ID NO: 3233 - DNA, 129 bp, Staphylococcus epidermidis
gtattgtcagtacatattctcatgcaacaacgtcaggaggaacgagtagttccagtttggcaagttctagttcaagtagcagtgcagcttctgcatctagaggttcaacttcttcaagtacaagtatga

SEQ ID NO: 3234 - DNA, 1893 bp, Staphylococcus epidermidis
gtggtgtcagtcatgacatttaaccaacttatccttaaaaatttaagaaaaaatattaagcattatggaatgtttctattttcattattgattagcattatactttattttagtttctcaactttaaaatattcaaatagtattaataactcagattcttcaactattattaaaaatggtgctacaattggtgccacaattctttttatcattattgttgttttcttaatgtatgcaaatcatttatttattaaaaggcgtacaaaagagtttgccttataccaactgataggtttaacacgtggaaatattctaagaatgctcaatatagaacaactagtattttttattgtaacgggaattttaggcactttaattggtatttttggttcaaaacttttacttgttatcgcttctaaattaatgaagttaaacacacatatctctattggctttgaaccccaagctatacttattactatcgtaatgttagctgtcgcttttttattgataatgatacaaaattacattttcttaaaaaaacacagcattttagctttgatgaaagacaattataccccggaagctacccaaaaacggataactacgtttgaagcaatcggcggcattttaggaattataatgatagtatttggatattatatgtctactgaaatgtttggtgtttttaaagccttaacaactgctttgattacaccttttagcatactttttttaactattgttggtgctttcttattctttagaagttctgtatcacttatttttaaaacactaaaacatatcaaacatggtcgtgtaaatatcacagacgttgtctttacatcatctatcatgcacagaatgaagaaaaatgcgatgtctctcacagttattgctatcatttcagctttcacggttagtattctttgcttcgcggcaattacacaatctaatactaatacaactttagaaatgacttctccagatgattttaatataagccagaataaaatagctgcgcaatttaaacataaactagatcaagaaaatttaaaatatcatcagcggacttatgaagtaatcaatccaaaaacattaagcgaccacgtcatgaagagtaaaaatggttctgatatgtctactaatacaacatcactaatgatgaactcacatctcaaaggtcatgaagctaaaataacgaatatacaatcatcaacaggattaatagatattcatttaaatcataagattacagttaaaggaaaatctaaacaatctattatcgttaaagacaaagataactctaaaatatatccatcccaattatcatttggagctcctatagttgaggtgagtccggaggtatataacacattaaaaactgacaatattgttaataagatgtacggttttaatttcaacactcacaaagatgtgaaaaaagcagaaaaaattgcctcaaaagttaatcgtaatattgtatcgcacgatgaatataagaaatttataaaccaaagcaatggcatacttatctttgtaacatcattcttaggaatagcatttttaatggctgctggttgtattatttacattaaacaaatggatgaaactgaggatgaacttgataactttaagatattacgtcgtataggatttacctacactgatatgtctaaaggtttactattaaaaattgcatttaattttggattaccgcttctcattgctttattacatgcattatttgcagcacttgcatttatgaaacttctaggaaatgtctcaatgtcacctatattcatagtaatgattatatatacaattgtttatttcatttttgctatgatttcatttatacactcgagtcgtatgattaagcattctatttag

SEQ ID NO: 3235 - DNA, 1491 bp, Staphylococcus epidermidis
aagtcacaagtaattcattcattaaatcaaataacaagatttttaccacctttattaggggagattaatatggatgaaaataaattaggtaaaacttccttaattggtttagtcataggctctatgataggcggtggtgcattcaatatcatctcagatatgggtggccaagctggtggacttgcaataattatcggttggataataactgctattggtatgatttctcttgctttcgtatttcaaaatttaacaaatgagcgaccagatcttgatggaggaatttatagttatgctcaaacagggtttggagattttattggtttttcaagtgcttggggatattggtttgcagcatttctaggtaatgtggcttatgcaaccctattaatgtcagctgtgggtaactttttccctatatttaaaggaggtaacacacttccaagtattatcatagcatcaattttattatggggtgtacattttttaatacttagaggtgtagaaactgcagcgtttataaatagtattgttacagtagctaaattaatacctatatttctagttattatatgcatgatagttgtattcaacttcagtacttttaaatccggtttttatggtatgactagtggaagtgttggcgtttttagttggggagatacaatggcacaagtaaaaagtactatgttagtaactgtatgggtattcacagggattgaaggagccgttgtcttttctggacgtgcaaagtctaaaaaggatgtaggaactgctaccgttattggtttgatttctgtgctagtcatttatttcttaatgactgtactagcccaaggtgtcattcaccagaaccaaatttcaaaacttgctaatccatcaatggcacaagtattagaacatattgtaggtcattggggttcagtgttagttaatataggcttaattatctctgttttaggagcttggttaggatggacattactagctggtgaattaccattcattgtagctaaagatggacttttcccgaaatggtttgctaaagaaaataagaataaagctccggtcaacgctttaattattactaatatattagttcagttatttttaattagtatgttgtttacagatagtgcctatcagtttgcgttttcacttgcatcaagtgcaatcttaattccatatacactcagtgctttttaccaggttaaatatactattcaaaataaatctaaagctaatttaaaacaatggataataggaattattgcatctatttacacaatttggttggtttatgcagctggattagattatttactattaacgatgttgttatatatacctggattactcgtatacagctacgtacaaagggataataacaaacatttgacaaaattggattatacgttattcatattcatcattgtacttgcaataataggaatagttcgtttgattacaggtaatatttctgtattttaa

SEQ ID NO: 3236 - DNA, 252 bp, Staphylococcus epidermidis
ttttttaaagtttacagtgatatgcttatttttttatcttacgattttgtacgtgcatgcttgcctaggggtatggctcgagccattagtctctcgcacatactattccctcaggcgtcagcacttacaaaatcggttgtaattttcatttttatacgcattcttactgagattatactaataagaggaatagtaaaagcaattctaagtaaaattgcagataagaggtttgttaaaagcagttctaagtaa

SEQ ID NO: 3237 - DNA, 231 bp, Staphylococcus epidermidis
cttctaaaagttttaaaccgggtagacctattggtggagatttctacttacgtggccttattaaatgcccagaatgcggaaataatatggtatgtcgacggacgtattataaaacgaaaaagtccaaagaacggacaatcaagcggtattacatttgttccttattcaatcgttcagggagttctgcatgtcacagtaattccatcaatgctgaagtcgtcgagcgtgtaa

SEQ ID NO: 3238 - DNA, 1146 bp, Staphylococcus epidermidis
attaaaggagtgttggaagtgaaaactagagcagcagttttacatgaaatgggggctaaaaagccctataaagaatctaaacctttaaaaattgaatacttagaacttgataatcctagcgaacacgaagtattaattaaaattcatgcagctggattatgtcactctgatttgtcagtaattaatggtaacagacctagacctttacctatggcacttggtcatgaagcttccggtgaagtaattaaagttggaaaagctgttacaagagttagcgaaggagatcatgtggtatgcacatttattcccagttgtggaaaatgtatcccatgtaaagaaggacgtcctgcattatgtgaaaacggagcaatatctaatgaaaaaggcgaaatgttagagggagggatgcgtttatctaatgatgaaggaaaagtatatcatcacttggggatatcaggttttgctgaatattctgttgtctctgaaaactctatagttaaaattgataaaaaaataccttttgaacgtgcagctgcatttggttgtgctattatcacaggtatcggtgctgtggtgaatacagcccaaattcgttctggtagtaatgtagcggttgttggtttaggaggtattggattgaatgctattattggagctaaactagcgggagccaatgaaattattgctttagatattaacgaagataaatttgaattagcaaagcaatttggggctacagcaacatttaattcaagcgataaagatatcgatgagcaaattaaagaatatattcctggcggagtagaatatgcttttgaaacagcgggtgtagtgccagctatgaaagttgcttatcagattactaaacgaggggggacaactgtaacaacaggactgcctaatcctaaagataatttttctttccctcaagttactttagcggctgaagaacgtaccattaaaggatcatatgtaggaagttgtgtacctgacagagatataccaaggttcgttaatctatacaaccaaggacgtttaaatattgattcactcatcagtgaggttatcactttagatgaaattaatgagggatttgatcgtttgtctaatggtgaagtaggtagaattataatgaagatgcattga

SEQ ID NO: 3239 - DNA, 243 bp, Staphylococcus epidermidis
agtaaaggagtattatctatgaaccatgacaacactatacaatccaattggcgaacggttgctagttgtttagcatcacaaaattacatttcaatagtaaaaggtctggtgcatcatttcacagccatcgatgacgaggaaatacttgataaaatctatgaagagtttataaatgatgactctattacaacggtacttaacaatgatttacaaacaattattaatcattatctatcaaaatga

SEQ ID NO: 3240 - DNA, 264 bp, Staphylococcus epidermidis
caaaaaggagtcttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgccccaattttatatcaaatttggaagaaaaagcataaaaagctaattacaaatggcgtattgatgagacgtacatcaaaataa

SEQ ID NO: 3241 - DNA, 693 bp, Staphylococcus epidermidis
caaaaaggagtcttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgccccaattttgtatcaaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctgactgtcattgtacatcgaaatatctgaataacctcattgagcaagatcaccgtcatattaaagtaagaaagacaaggtatcaaagtatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 3242 - DNA, 243 bp, Staphylococcus epidermidis
gaaattttggttcaagaagttgttgtagaaggaaatatcactttaggtcaatttcttaaaactgaaggaatcatagaatcaggtggacaagctaaatggtttctacaggattttgaggttttaattaatggacaacgtgaaacaagacgtggcaaaaaattagaacacaacgaccgcattgatattacagatatccctgaagatacgggttcctttttaatcatccatcaaggtgaacaatga

SEQ ID NO: 3243 - DNA, 1401 bp, Staphylococcus epidermidis
aaggacaaggtacgtcaatctttattacgcttccttgcgaaatcattgaagacggtgattgggatgaataacaaagaacatactaaatcaattattttagtcctactcgtcttgatgagtatcgttttgacatacatggtctggaacttttctccagacctttcaaatattgataacacggataatagtaaaagtgataagcctaaaccacttactaaaccaatgactgcagaaatggaaggaacaatcacaccatttcaaatcgtgcattctagagatgataaatctcaaggaacagtagcatcaggtgcagtcttagataagatgattcaacctttaaagaatcaagaagttaaatctgtatcacatctgaaaagggaacataaccttgttatccctgaactaagtaacgactttattgtcctagatttcacttatgatttgccactttcaacgtacttaagtcaagtactcgatatcgatgcgaaagtgccgaataactttaattttgatcgtctccttatcgatcaagatcataataaccacgtcgtactatttgcgattagcaaagaccgtcatgaagtagttaaacttaagacaacgatgaaagggaataatgttgataaagcttttaaaagtatcgaacctgacatgcagccctatacggaaatcatcacgaataaagatacaatcgacaaagcaacacacgtgtttgcaccaagcaaaccgaaagacttaaagacgtatcgcatggtcttcaatacgatcagtgttgaacgcatgaactcaatactatttgatgattcaacgattgttcgtagctctcaaagtggtacgacaacatacaacaacaatactggcgtcgccaactacaatgataaagatgaaatgtatcattataagaatttatctgaagacgcgaaaagttcaagcaacatgcaagaaaccatcccaggcacatacgagtttataaatagtcatggtggcttcttaaatgaagattatcgcttatttaaaacagataatagaacagggaaactcacatatcaacgattcctcaacggttacccaacgtttaataaacagaacttcaatgaaatccaagtcacatggggggataaaggcgtttacgattatcaacgttcgctacttaagacggacgtcacactgaacagtgaagaatctaaatccgtccctaccgttgagtccgtgcgttctgcattagccaaccatcctgatattgattttgaaaaggtaacgaacattgcgattggttatgatatggacgacaaggcaaataacgaagatattgaagttcaacgtaactgtgaattaataccacgttggtttgtagaatacgatggcaattggtatgcctataaagatgggaggcttgaataa

SEQ ID NO: 3244 - DNA, 213 bp, Staphylococcus epidermidis
gaggttagggtattgagcttttatcgttttatgaagaattttgaaggtgaaaaaagtcattttggagatttgtttgaaggtatgaaagatattaattttcctgaaaacattacgactccaagggaaattatggaaaagttccaacattggttacaagaacctagtttacacgatacgatacaagatgcgattaagcagtatcaaaataaataa

SEQ ID NO: 3245 - DNA, 156 bp, Staphylococcus epidermidis
acatcgttatttaaaggaggtgagataatgggagtcaaagacgtattaaaaaaattaaaacctcaggaacaatcttgttgttcagtagaaattgaagaaaaaacagagaagaatgaaaaaggacagcaagataataataattgttgtaacaattaa

SEQ ID NO: 3246 - DNA, 195 bp, Staphylococcus epidermidis
atagtctcattaagtttcttgaagagactttcaaatatttcattatgctttctacataaatactcaagtaaatctttcggtaaagttaatattttacaatctgtcaaagctgtacatatttcatatggtgcaggggtttcattaaatatgaagttcattggaaatatattttcgtctttacttaatcttaaataa

SEQ ID NO: 3247 - DNA, 162 bp, Staphylococcus epidermidis
aaattgtcttttttcacttatccaagaactttatgtcccggactcattatgatttatttttttattgctgacttgccattaattctgcttgctctacaacttgttccacagccattttttgaagatctggtggatagccatatttctttaataggcgtctaa

SEQ ID NO: 3248 - DNA, 198 bp, Staphylococcus epidermidis
agtaatacattacataggagtgataaaatgccaagtcgttgggtaaaagttaaaacctttaagtcattatctacttccaaattagagaaaaagttacaaaatttcaaatcatataatagctttgatattatagaaattaaaagacattcatatttatttttaaatatagtcgaagtttattacaaagataaaacttag

SEQ ID NO: 3249 - DNA, 126 bp, Staphylococcus epidermidis
ttagaaacattgatatacgaattaattgataattcaactaataactcgaaatttagttcaaatgcagtaggcctttttgatagaaatgaagaacaaagatttagattgagtaacgaatgtttataa

SEQ ID NO: 3250 - DNA, 216 bp, Staphylococcus epidermidis
ttatgggcattcttagctatccagcgtccttcctcagttttaccaaaactagcatatagattttcacaacaagttggtaaacaatatacctacggtaaaggattagaagagctgtcagaagtagaacaattaaaattagaaaataagagaaaagatatagaattggatattttaaaaaagtacaaggtattggaaaggaagtggtaccaacagtag

SEQ ID NO: 3251 - DNA, 162 bp, Staphylococcus epidermidis
ttaattaaattacgctcaatattaattggcagcgtcgcattggcaaaattagaggcatggatattatttgctgttgttaaaatgtctccaagccatgatagacgtgatgctggacctggtataaatgagaatgaacgtggatggttcggacgatataaataa

SEQ ID NO: 3252 - DNA, 135 bp, Staphylococcus epidermidis
atgtataaatttaaaacactgtttaatgatagagacgtaaaaggagttactcaattctatgaaaaagagagtcattacatacttgatactagcgttgtctttaacacttgcagcatgctcaaatacgaacgataa

SEQ ID NO: 3253 - DNA, 912 bp, Staphylococcus epidermidis
tttaataaatttggaggcgttatactaatgatagattcgattatagaatttataaaaacatttctaatgctattttttgaattattaatactgttcataatcgtaagttttattgtaagtctaatccaacaagtagtttcggaagataaaatcaaaagcatgttaagtaaacctaaccaaggaatcaattatttttttgggatgatatttggtgcgattactcccttttgttcttgttcaacaattccaatacttgcaggtctattaaattctaaagtaccttttggtccagcggtgagtttcttaattgcttcaccattaatgaatccattaatggtgtttatgctatgggttttattgggctggaaagttgcaatagtttattttattgtactagcaatatttagtatctttacaggtcttgtgttttcaaaaatgaatttggctgaaagttataagggcgtaaatgttaaaggagatggattttttgccaataaagaaggatctcgttttaaacaagcattaaatgatgcgtgggcatttttatatccaatgcttccttacctatttattggtgtatttattggagcattcatatatggatttgtacccgaaacatttattacaaaatacgcaagtggagatggcgttatatccgtattcattggatctgttataggcattccaatgtatattagacctgaaacaatgttacctatagctgaggcattagtatcaaaagggatgtctttaggaacagtagttgcgttgataataggtggtgctggtgcaagtattccagaagttgtattgttaacgaaattattcaagaaaaaatttgtagtctcattcgtaatcgcaattttagttgtagctattgctacaggtttgattgtgaacatcgttatttaa

SEQ ID NO: 3254 - DNA, 333 bp, Staphylococcus epidermidis
catgataaattagtggttagctatatttttttactttgcaacagaaccctattctttggcgcaacatgggggccaattatgtgggtaatgttgccagaaatgttccctacacgcgctcgaggtgcagctactggtatcgctattgtagtattacaaataggaacacttattatttctcaagtatttcctatccttgttaatatgttagaagtacaatatgtattcttgatttttgcagttataggggcattagcactcatttttgtagttaaattcttaccggaaacgcgtggtaaaagtttagaagaaatcgaattacaattacaaaactaa

SEQ ID NO: 3255 - DNA, 144 bp, Staphylococcus epidermidis
ctgattttttcagctataagtgaccaaattaatgtagaaggaattgcacctaatccaacaaacatccagcttaaagtcgcatattcagcaacagaaggaattgatttaactatagcaactagaaaagtaccagtaataatataa

SEQ ID NO: 3256 - DNA, 816 bp, Staphylococcus epidermidis
tataaattttcagataatttaggggaggggtacaatatgacactaacaaataaagaagttgctaaagttttatttaaagcttatagatataaaaaacccatcgatttcattagtgagaactatcaattaaacgaagaagaagcatatcatgtacaagaagaactaattgaccaattaactttcaaagaccgttcgactgttacagggtataaagttagtatgactagcaaggcaacgcaagcaattgctaacactaacgaacctgcatatggaacactcttatctaaccaaattgttaatgatggtgcctcagtctctctttcagaattattttcaccattactagaaccagaaattatctttatagtgcaggaagacttaccttatgatgctgatttagaaacaattagatatcatacccgtatcgcgccaggcattgaaattccagatgcaagatataaaaattggtttccaaattttactttatcagatttaatatcagataataccgcaacaggacttgtcgtagtaggtgaccctgtagacggacttgataacgatgcatttgctaatgtacatttaaatttatataaagatgataaatgcattgccacaggagaatcatccgaagtactcggaaatcctttaaacgctattcattggctaattaaaaaactacacacgcacggtaaacaacttaaaaaaggagatatcatttcatctggaacttttatatctccactaaaattagaatatggcacgtaccgtgctgaatatagtggtatcggtaaggtatcattttcggttaataaataa

SEQ ID NO: 3257 - DNA, 243 bp, Staphylococcus epidermidis
gtagcgaaatttattggaaaaggtacttatattgaagatattgttaatggttcatttttaaaaagccaagacgatttgaagttaaaagcttctgacttcactgtcgaagataactataactacggtgtacttatatttccagagaatctttctcttacagataataataagaaattggaatctttaataaaaactatactatttacaggtaaacgatatcaatatacttattttaaaatttga

SEQ ID NO: 3258 - DNA, 1851 bp, Staphylococcus epidermidis
aggaggctttcaatgagtcatttactgaaccaattaaagagcaacgttttagtagctgatggcgctattggaacaatattctactcggaaggtcttgatacttgtccggaagcatacaatcttactcatccagataaggtcgagcggattcatcgttcttatatcgaagctggtgcagacgtcattcaaacgaatacgtatggtgctaactttgaaaaattaaagtcctttggtcttgaacataaagttaaagaaattcaccaagctgcagttcaaattgctaaacgtgcagcaaatgaggacacaattatacttggaacggtaggtggattcagaggcgtccggcaagaggatatcagtctttcaacaattcaatatcatacagaacttcaaatcgatacattaattgatgaaggtgtagatgcccttctatttgaaacttattacgatttagatgaattaactcgcatcgtcactgctacacgacaaaaatacgatattccaatcatcgctcaactcaccgcttcaaatacgaattacttagttgatggcactgaaattaatgccgcattgaaatacgtagttgaatgtggcgccaatgtagttggattaaattgtcaccatggcccacaccatatgcaacgatcattttcacatatagaacttcctaaacatgcgtatttatcgtgttatccaaacgctagtttattagatatcgagaatagtgaattcaaatatagtgataatgctcaatatttcggagatatagctcaagaattaattaatgagggagtcagattgataggtggttgttgtggtacaacacctgaacatattcgctatattaaatcagcagttaaacatttaaaacccgttaaagataaaaaggtaatccctattaataaagcttcatctcaaaagcaaacgcgagttcttaaacaaaaccttacttctaaagttaaaaatggcccaacagtcatcgtagaacttgatacacctaaacatttggatactgatacatttttcgataatgtaggcaaattagatgaagctggcatagatgctgttacattggcggataattcattagctaccgtaagagtaagtaacatcgcagcggcaagtttaattaaacaacgctacgatattgagcctcttgtacatgtgacatgtcgtgaccgtaatttaataggattacagtctcatctcctaggtttatcactcattggtgtcaatgaaatactagctattaccggagatccttctaaagtaggccatttgcctggagctacaaatgtctatgacgtgaactcaaaaggccttacagaacttgcactaagatttaacaaaggtattaacactgacggcgatgcgctgaaaaaacatactaactttaacatcgctggtgcgtttgatcctaacgtacgaaaattagatggagccattaaacgacttgaaaagaaagtagcaagtggcatgagttatttcataactcaacccgtttatagtaaagaaaaaattattcaagtatatgaagaaacaaaacatttaaatacacctttcttcataggtatcatgccaatcgcaagttataacaacgcacttttcttacataatgaagtgcctggcatcaaaatgtcagacgatgtacttaaccaattcaaagctgttaaagatgataaagaaaagactaaagaattaagtttaagactttccaaagaactcattgatacagtacatgaatacttcaacggtctgtacattattacacctttccaaaaggtagattattcattggaactcgcagcatactctaaatcaatcactgccaacaaggaggcaatattatga

SEQ ID NO: 3259 - DNA, 228 bp, Staphylococcus epidermidis
ttttggaaattaatgttacccaaaatactaacgccgtatgccataaccattccaaacattgctatcattgccccacctaaaaccggcaatggaataatattagctaaagcacctaatttaggtatacaaccgcaaattagtaaaagaataaccattccatatatcacattgttctttttagctcctgataaagaaacaagacctacattttgggaatatgcagtgtaa

SEQ ID NO: 3260 - DNA, 450 bp, Staphylococcus epidermidis
acgttgatttctcaagaactgttaatacaaaaaattcaagatgcagatgcattaatcactttattgtctacccaggtaagccgacaagttattgaatcggcgccaaaattaaaaatcattgcaaattatggtgctggttttaataacattgatatccaagcagctcgcgaacaccatattaatgttacgaatacacctatagcttctacaaatgcaacagctgagttaacaatgggaatcttattggctgtcgctcgtcgtattcctgaagacgatcaactttgccataatgaagggttcaatttgaaaatcacagatgataatctgcaagtcgattaccctcgtcaatttctgaaaggcgcacatgcaccgagtgttaaagcacagcacgttattcattggggcgacaccttctgggtttcgtcgttatggttagcgtggttttattaa

SEQ ID NO: 3261 - DNA, 1374 bp, Staphylococcus epidermidis
agagtgatttctgtgaggaggataatgatgacaaagaaatacgatcttattgtgattggtacaggttctgcggggtcaatcacagcagcaaaatgtaataaagccggctggaatgtagctatggtagatgacaggccgtttggaggcacgtgtgcactacgtggatgtgacccaaaaaaggttctacatggtgctgccgagcttattgattggaacaaacggatggttaagaatggagtaccgtctgaagtctccatcaactggaaagatcttatgaattttaaaagaacctttacagatgatgtcccggaaaaaaaagaggaagcattgaataaacagggaatcgatacgtatcatggcaatgcatctttcgtgagtgaggacaaacttgaagtgaataaagaagtgctcgaggggagtcatttcttgatcgctagtggtgcgaaacctacccctttacccataaaaggagaagaacatcttacttatagtgatgagtttttggagttggatgaattaccacaaagaatcgtctttgttggtggtgggtatatttcgtttgaatttgctcatatcgcggcacgtgctggatcagaagttcatattatccatcgaggtcaaagacctttggagaattttgatatagatcttgtagatatccttttagaaaagtcgaaagagattggcatacaggtacatcttcaacattccgttgaatccattgaaaaagaacaaggaaagtttcatgtgtacgctcgaaaaaaagaggatataacgcggtttgaagcagacattgttattcatggtgctggacgggtccctgccttagatatgaatcttgaaaaagggaatatagaaaggaaaaaacatggtgtccatgttaatgagtatttgcaaagtgtaagtaacccgaatgtctatgcagctggagatgctgcagcaacggatggcttgcccctcacacctgtagccagtgcagattctcatgtcgtagcatctaatttattgaaagggaacagcaaaaaaattgaatatcccgtgattccatctgctgtatttaccgtacctaaaatggcatcggtaggtatgagcgaggaggaagccaaaaactctggccggaatattaaagtaaagcagaaaaacatctccgactggtttacgtataaacggacaaatgaggactttgctgcgtttaaagtgctaattgacgaggatagtgatcaagttgtcggtgctcatttgattagtaatgaagccgatgaactaattaaccactttgcaacagccattcgctttggaatttcaaccaaagaattgaaacaaatgatatttgcctatccaacggcagcttcggacattgcacacatgttgtaa

SEQ ID NO: 3262 - DNA, 162 bp, Staphylococcus epidermidis
caaacctcttcaaatttgggaatggtaaactattatcatcaatcaatatttaaagatgttatgcacctaaccatttttcaacgcataatcttaactcattttgggattcaatctcataacattactgaaatatcgtcgaaggatatgtatctaaaaatctag

SEQ ID NO: 3263 - DNA, 135 bp, Staphylococcus epidermidis
tttacagaattgtgtgacaatcatagctgtttatttgctatcaacacttttaaatgttggagggataaattgtatgataaattacgtttaatttattacgaaagtaaaagatttaattttttagaaatttattaa

SEQ ID NO: 3264 - DNA, 192 bp, Staphylococcus epidermidis
tcatgttgtccatcaatattcaaaccggctgtcggtccaagtgtagaatcacttgctggagaacctgaatcacctaaagcacttgctgtaccaattaaagcaataagagccattgtgtctaaaccaattgatgctccaaaaggtataaataatgaagcgataataggtatattcgcaaaagtcttcaccacg

SEQ ID NO: 3265 - DNA, 387 bp, Staphylococcus epidermidis
tataggatgttatatcgattttctcacaagactggtgtttatggtgtaagtgtcaaagaggaaactggaaatcaaatactcgtacaaattgaacaagtaattaaacatcccaaacaaggtgatttacaccaccccaatgaaacagaaggcgtcttttttcatgaacgtaaagctttaagccattttgagaaacgttacgctacaccttctcaacttcgtgattttaatgtcgaggccatgccttatgaagactcacttcaacatgctattacacatcttgagaatcaactaaaaaaagagaagacagagtattctcgattgtctttaaataatttaaatcgtttaaaagaagattacgctattcaatataaaagacacttcgactaa

SEQ ID NO: 3266 - DNA, 123 bp, Staphylococcus epidermidis
ataaagaagccagtaaatgaatttatgaaaactcatttactggctattttgctaggaattatgtctcagcctcgaatagatacattcagatataccattcaattatttgtcttttcgaggtaa

SEQ ID NO: 3267 - DNA, 144 bp, Staphylococcus epidermidis
ttagtcgagttatttgatttatgctatgatatgagtgttaagaaaatcgaaataaggggttatcaagttgaatcatcactacaaagtaggtcaacatatcaaggtacgtgtgactggtattcaaccgtatggcgcatttgttga

SEQ ID NO: 3268 - DNA, 294 bp, Staphylococcus epidermidis
acaaaattaacgaggtgccttatgtataaagactataacatgactcaacttactctaccaatggaaacttcagttcttatccccacaaatgatatttcacgacatgtaaatgatattatagaaacaattcccgagactgaattcgatgaattcagacatcatcgaggtgcaacatcatatcatccaaaaatgatgttaaaagtagttttatatgcctacacacaatctgtgttttcaggacgtaagatagaaaaattacttaatgataatatccgaatgatgtggctatcataa

SEQ ID NO: 3269 - DNA, 129 bp, Staphylococcus epidermidis
cactttgtaactctttgcaaattgtggtattatttaaatcgtaataattacgttttaaaagcagaggggcgattcaatgcactggacaattattggtggtggcttacaaggaaccaccattgcacttaa

SEQ ID NO: 3270 - DNA, 279 bp, Staphylococcus epidermidis
gtggtgaagacttttgcgaatatacctattatcgcttcattatttataccttttggagcatcaattggtttagacacaatggctcttattgctttaattggtacagcaagtgctttaggtgattcaggttctccagcaagtgattctacacttggaccgacagccggtttgaatattgatggacaacatgatcatattcgtgatacatgcatcccgaatttcttgttttataatgttccccttatgatttttggtacgatagcagctatggtactataa

SEQ ID NO: 3271 - DNA, 201 bp, Staphylococcus epidermidis
tgtggctatcataaaatcaaaagccttcttataaaacgattaatcgattcaaaaacaaataaaaaaataatgaagaattatagttgggaatatttcaatgtccaaattaatcaaaagctttcagaacgaaaagcaaaaaccatctacagtcaaagaaaaattgatgtggagtctgtttttggaattatgaagctattttga

SEQ ID NO: 3272 - DNA, 1512 bp, Staphylococcus epidermidis
aaggagcgccagaagatgatagagagtaacttgcttgttttaactttagtcatacctatcctaactgcaattttactcatatttattggaaagcgcccaataataaaaagatatgttgcacttgtcggtacattgctaacattggtcattgcattgattaacttaaagaatgtgctacgagatggaccaatcaaggttgaactgggctcttggaaagccccatacagcattgtatttgtagtcgatatttttagcgctctactcatcatcacaagtattattattaccatattagtcattttatactcatatcgttctatcggtttagatagagaacgtcattattattatttctctatcatgtttatgttgattggtattattggctcatttacaacaggagatattttcaacttgtttgtgttctttgaagtctttttaatgtcttcatattgtttactcgttattggtactactaaaatacaattacaagaaacaattaagtatattttagtcaatgttgtttcatcgtctttctttgtcatgggtgttgcagttttatattcagttgtaggaactttaaatctcgctcatattagtgaaagattgtcacaactttctgtacatgacagtggcttagtcaatattgtttttattttatttatctttgtctttgccactaaagcaggcgtttttcctatgtacgtatggctacctggtgcttattatgcccctccagtagcgatcatcacgttctttggtgcactattgactaaagtgggtgtatacgcaattgcgagaactctaagtttattctttaataatacagtaagcttttctcattatgtcatccttttcttagcattacttacaattatttttggatgtataggtgcgatagcttactatgatacgaagaaaatcatcctttacaatattatgattgcagtaggtgtcatattagttggtattgctatgatgaacgaatcaggcatgactggtgcaatatattacacactacatgatatgttagttaaagcttcattgttcttactcattggcgtcatgtacaaaatcactaaaacgactgacttacgtcattttggtggcttgataaaagggtatcctattctaggttggacattctttattgcagcgctaagcttagcgggtataccaccttttagtggtttctacggtaaattctatattgttcgagcgacctttgaaaaaggattttatctaagtggtatcattgtacttttatcaagtttaatcgtgttatattcagtcatacgtattttcttaaaaggatttttcggtgaagttgaaggatatactttatctaaaaaggtaaatgttaaatatctaacaactatcgctgttgcatctacagttattactgtaatctttggattatctgcagacacgttattcccaatcatcaaagatggcgctgaaacgtttgtcgatccaagtcaatatattcatagtgtgttaggaggtaaatag

SEQ ID NO: 3273 - DNA, 126 bp, Staphylococcus epidermidis
aaagccaaacacaatgaccatgaagaaaataatcacggcagcgtattgaaagataaggttattttgttgtctattcatggtcattcacctcacttgattgatttttctgttttaatcgtaatttaa

SEQ ID NO: 3274 - DNA, 153 bp, Staphylococcus epidermidis
acatcccttaatcgaatgagacccgttgcagcaaaggcactaatcaaagctccaagaacaacaaatatgatagagacactagtgacgatcgttgctatcatgcttgatcaccttaccttcatccataaatttagaaaagactgcagttcctag

SEQ ID NO: 3275 - DNA, 393 bp, Staphylococcus epidermidis
ggggttatcaagttgaatcatcactacaaagtaggtcaacatatcaaggtacgtgtgactggtattcaaccgtatggcgcatttgttgagacccctgaccatactgaagggcttatccatatctcagaaattatggatgattatgtccataatttaaagaaatttctatctgaaggacaggttgttaaagcaaaaatattatcaattgatgatgaaggtaaattaaatttgtccttaaaagataatgattactttaaaaattatgagcgtaaaaaagaaaaacagtctgtcttagatgaaattagagaaacagaaaagtatgggtttcaaacacttaaagaacgcttaccggtctggatcaaacagtcaaaacgtgcaattcacaatgactaa

SEQ ID NO: 3276 - DNA, 378 bp, Staphylococcus epidermidis
actatgaccaatcttttagaaacatttgaaatgaagattgaacaaaaagaagatggtaaagtagtagtgtctatgcctgtgacagataaagtaaagcaaccctttggctatttacatggtggtgcaagtttagctttaggtgaaacagcatgttcgataggtgctgctcatttgattgatacgcagcaatttattccactaggtttagaaatgaatgcaaatcatattcgctcaactcgacaaggacatgtgagagcatttgcttctttaatacatcaaggaaaaacaacacaagtttggaatattgatatcaaagatgaccatgaccaattaatcagtgtcatgcgtggtacgattgctattaaacctattcaataa

SEQ ID NO: 3277 - DNA, 435 bp, Staphylococcus epidermidis
atgaccatgaatagacaacaaaataaccttatctttcaatacgctgccgtgattattttcttcatggtcattgtgtttggcttttcattatttttagctggacattatacacctggtggcggtttcgttggtggtttgcttttcgctagtgcattattagttattacaattgcatatgatgtaaaaacgatgcgaaagatttttcctttagattttaaaatcttaattggtattggtttattattttgcgtgggtacaccattaacaagttggttcatgtctaaaaacttttttacacatgtcacttttgacatccctttgcctttacttgaacctatgcacatgacgacagcgatgttttttgatttcggtgttttatgtgcagttgttcgaactattatgactattattatttcgattggagagaacgaatag

SEQ ID NO: 3278 - DNA, 2427 bp, Staphylococcus epidermidis
attttaaaggaggaaaacatagtgagtttgttacatattgcggtactattaccgttaatatttgcactcattattccattcctataccggttcgttaaacgtatacatttaggatggtttgtattacctgttcctattgtcttatttatatatttcatatcattgatttcaatgacgatgtcaggtaataacgtaatgaaaaacttaaattggatgccacatattggaatgaattttaatttatatgtggatggtctcggattattattcagtttgcttatcactggcataggaagtctagtggttttatattctatcggatatttaagcaaatcagaacaactcgggaatttttactgttatttattactatttatgggtgcaatgttaggagttgtactctctgataattttattattttatatttattttgggagttaacttctttctctagctttttattaatctctttctggagagagaaaaaagcttcaatttatggtgctcaaaaatctttaatcattaccgtattaggtggcttgagcatgctaggtggtatcattttactttccctagctactgatacttttagtattcaggctatgatttcaaaagcaagtgacattcaaaatagtcctttctttatcttagtaatgatactttttatgattggtgcatttacaaaatctgcacaagtgcctttttatatttggttaccagatgctatggaggcgcctacgccagtgagtgcataccttcattctgcaacgatggtaaaagcaggactatatctaatcgcaagaatcacacctatttttgcaatatccgaaggttgggtatggacaattacacttgttggtttaatcaccctattttgggcatcactcaatgcaacaaaacaacatgacttaaaaggtattttagctttctcaactgtgtctcaactagggatgattatgtctatgcttggtattggtgctgtaagttatcattatcaaggcgctaatagtcaactttatgttgctggatttgttgctgccatatttcatttaattaatcatgccacgtttaaaggtgcactatttatgattacaggtggtattgatcattcaactggtacacgtgatgttaaaaagttgggcggtttacttacaatcatgcctatctcattcacgcttacagttattacaacattaagtatggctggtgtgccgccttttaacggctttttatcaaaagagaaattcttagagtcaatgattaatgttacacatttaaatttaatgagtttaaatactttaggtattcttttaccaatcattgccattattggtagtattttcacatttgtatattcaattaaatttatattgcatatattctttggttcttataaacctgaagctctgccaaaacaagcgcatgaatcttcaattttaatgcttatttcacctatcattttaacatcactagttatagtattcggtttattcccaagtatattaacgcaatctattatagagccggcatctgtagcagttagtcaaacatcaaatataactgctgagttccatttattccatggtataactccagcattcctatcaacaataggtatttatattattggtattttattattaatttcatttagttattgggttcgtttattacaagcacatccatatcagttaacgttgaatcattggtatgacacttcaggccaacgtattccaggatattccgaaaatataacaaatagttatgttacaggtttttctagaaataatttggtgattatcttaggtattctcattgctttaacttttgttacagtcatcagtgtacccttcagtattgactttaaaaacgtgagtcatttacgcgtatttgaaggtgcaacagtattgtttttactgattgcttcaactttcattatatttgcaaaatcacgtttgtttagcattatcatgttaagcgctgtgggttacgctatatcagtattatttattttctttaaagcgcccgacttagcattaacacaatttgtagtggaatctatttctacagcattattcttactatgcttttatcacctacctaatttaaatcgctacaatgaaaaaccaacctttaaactgacaaatgctgtgatttcaattggagtgggattatcagtgattattttaggattaattggctatggtaatagacactttgactctattactaaattctatcaagaacatgtttttgatttagcacatggtaaaaatatggtaaatgtcatcctcgtaaatttccgtggtatggatactttattcgagtcatctgtactaagtattgcaggtttaggcgtatatacaatgattaaattacgattaaaacagaaaaatcaatcaagtgaggtgaatgaccatgaatag

SEQ ID NO: 3279 - DNA, 189 bp, Staphylococcus epidermidis
  modified_base (70)..(70): a, c, g, t, unknown or other
  modified_base (76)..(76): a, c, g, t, unknown or other
  modified_base (173)..(173): a, c, g, t, unknown or other
tgtggagtctgtttttggaattatgaagctattttgagtttcactcgaaagtccgttcgagggataaatnaagacnaaagagaactaggacttgtgctaatgacacttaatataagaaaagtaccagctcaacgagctgaaaattataaaaaaatcataaaaaagaaaatttntatattatgtcaatag

SEQ ID NO: 3280 - DNA, 312 bp, Staphylococcus epidermidis
aaaggtaggcgagaaataatgccttttaaaatatttattattacagccttaattattgttgtcttatcaatgttagcaatgttaatacgtgttattttaggaccctctctagcagaccgtgtcgtcgcacttgatgcaattggtttacagttaatggccgtgatagcgctatttagtattttactgaatattaaatacatgctcgtcgttattttaatggtcggtattcttgcttttctaggaactgcagtcttttctaaatttatggatgaaggtaaggtgatcaagcatgatagcaacgatcgtcactag

SEQ ID NO: 3281 - DNA, 492 bp, Staphylococcus epidermidis
gaggtaaatagtttggctatacagtttgtaattaatttacttgtttctgtcatatggttacttgtaacaaatagctataccttaaataactttgtattaggttttatactaggtttgtttctagtttatctcctgcaccgtgtcttgcctggtcagttttatttagtgagaatatatagaattataatgcttatcattacatttttaactgagttaataaaagcaaactttggtgtactaaaaattattctcaaaccacgaattgagaataaacccggattctttgtgtacgagacggaattagaacgtgactggcaacttgttttactttccaacttgattacgttaacacctggcacagtcgttttaggtattagtgatgaccgtaaaaagatttatatccactcaattgatttcagtacaaaggaagaagagattcaaaatatcaaatcttcattagagaaggtcgttagaaaggtaggcgagaaataa

SEQ ID NO: 3282 - DNA, 333 bp, Staphylococcus epidermidis
  modified_base (174)..(174): a, c, g, t, unknown or other
tctttgttgagtggtattctcacatctataagtgtctatctcgtttcgtctaaaagtttgatacgtatcattatggggactacactactaactcatgctgcaaatttatttttaattactatgggaggtttaaagcacggaactgttccaatatttgaaaaaggaacatcaagntatgttgaccctatcccccaagcattgattttaacagctatcgttatcgcctttgctacaacagctttctttttagttcttgcatttagaacatataaagaactaggcactgataacgttgagctaatgaaaggagcgccagaagatgatagagagtaa

SEQ ID NO: 3283 - DNA, 612 bp, Staphylococcus epidermidis
cacgaatggagaattgaaatgacgaactatcctcagttaaataaagagattcaagataacgaaattaaagtagttatgcatacaaataaaggtgacatgacatttaaattatttcccgacattgctccaaagacagttgaaaactttgtgacgcattcaaaaaatggatactacgatggtgtaacattccaccgtgttatcaatgattttatggtacaaggtggggacccaactgcaactggtatgggcggagaaagtatttatggtagtgcttttgaagatgaattttctctagaagcttttaacctttacggtgcattatcaatggctaatgcaggtcctaatacaaatggatctcaattctttattgtccaaatgaaggaagtgcctgaaaatatgttaagtcaattagcagatggtggatggcctcaacctattgtagaagcatacggtgaaaaaggtggtacgccttggttagatcaaaaacatacagtatttggtcaacttattgagggtgaatcaactttagaagatattgcaaatactaaagttggtgctcaagacaaacctgtttatgatgtagtcattgaatcgatagatgtagaagaataa

SEQ ID NO: 3284 - DNA, 1173 bp, Staphylococcus epidermidis
aagcagaggggcgattcaatgcactggacaattattggtggtggcttacaaggaaccaccattgcacttaaattaaaaaatgaaggactaaaaaatgaggcgcttactatcatagatccttactcctcattatgtgagcgatttaatatttatacacaacgtattagtatgccatacttaagatcgcctttcgttcatcatattcatcctaaaccttttcatctcaaacaatatgctagatatcatcagtatacttcagcttattacggcccgtataaacgtcctcaaagagatatgtttatgcatcatgttcatgatttgatacatcaatttaaacttaatgattgtcatatacaaggtaaagtcgaagctattaataaatcaagaggtaaatggtgtataaaactatcaactggcgataaaatgattaccgattgtgttgtgatagcaaatggctatacgcaaacgccattcatacctgaaattttcagaaataaagcgaatgtaaaacacatattcgctgataattatcatgcctctttagataaagatactcaacatgttgttggttcaggtatatctgctgcccacctcactttaaaattattaaatgaacacaatcaccaacttgttcatttatggatgaataaagatattgagatacataattttgatgctgaccctggttggttaggacctaagaaattgaactatcttgcatctatatcctcatcagatgcaagaatgaagttaattgaagacgaacgtcatagtggttcaatgcctatggaattatttttaaggttaaagaaatatgtgcaaagtggtcgactcgtcatacatacgagtcaaattgatgatgtaactgaatcctatattatctccgctggaaaatattttgaatataagcatattttgttagctactggattttataatcaattgttaacacaaccactcataaaaaatcttattcaaaacgaacaagcaccacttaatcaatcaggttatccttctttgtcaaacgaactagaatggttaaatcaattattcgtagctggtggactcgcagatttagaactaggtccttttgcaagaaatataatgggcggtaaagaaagcgctgaacgcataagtaaagcatataaacgtttaaataagaaaatctcttaa

SEQ ID NO: 3285 - DNA, 126 bp, Staphylococcus epidermidis
ttacatactattctaattatttgcttacaaattatttattctccaattataaaaatgctaagcatagttaattacattcaacaaataaataataactatctaaaattttttattttcccttattga

SEQ ID NO: 3286 - DNA, 363 bp, Staphylococcus epidermidis
tcaagcatgatagcaacgatcgtcactagtgtctctatcatatttgttgttcttggagctttgattagtgcctttgctgcaacgggtctcattcgattaagggatgtttactcaagagcacatgcagctggtaaagcagccacgttgggtgcgatgtttttactatttggagcatttttatactttattggcactgaaggatatgtaaatatgcaattaattatcggaattattttcgtatttattactggccctctttcaagtcatttaatcatgaaagctgcctacaacattaaaacaccatataccaaagatactaaaattgatgaaattaaagaggatatgaagcatacaaaactataa

SEQ ID NO: 3287 - DNA, 1173 bp, Staphylococcus epidermidis
  modified_base (620)..(620): a, c, g, t, unknown or other
catgctatagtcataacatcattaaacaaggagagtattaaaaatatgaataataaatatgaacctttatttaaatctttaacactacctaatggtgttgaagtaagaaatcgttttgttttagctcctcttacacatacttcatcaaatgatgatggaacaatttcagatatagaattaccttacattgagaaacgttctaaagatgttgggattgcaattaatgcagcaagtaatgttaatgatgtaggcaaagcatttcctggtcaaccttctgttgcacatgactcagatatcgaagggttaaaagaacttgctcaagttatgaagaaaaatggtgcgaaagcaatagtccaaattcatcatggaggtgctcaagctttaccagagttaacacctgatggagatgttgttgcaccaagtgccatttctcttaaaagttttggtcagcaaaaagaacatgatactcgtgagatgactgctgaagaaattgaacaaactattagagactttggtgaagcaactagaagagcaattgaagcaggttttgatggcgttgatattcatggggcaaaccaatgtcttattccccaatttgtttctccttactataatataanaaatgatgtttgggctgataactataaattccctgttgctgttatagatgaagttgttaaagctaaaaaagctcatgcaaatgatgattttattattggttacagattgtcacctgaagaagcggaatcaccaggtatttcaatggagataactgaagaattaattcaccaaatcgcaaataaaccacttgattatattcatgtgtcattaatggatgttaactcagttacgcgagaaggtaaatataaaggtgaaaatcgcttggaacttattcatcaatggataaatggacgtatgccgcttattggtataggttctgtctttacagctgaagatgcactaaatgctgttgaaaacattggagttgaatttgttgcattaggtcgtgaaattctacttgattatgattttgttgctaaaataaaagaaggtcgagaagacgaaattataaatgcttttgatcctaatcgtgaagaccaacattatctaacaccaaatctttgggaacagtttaatcaaggattctatccattacctcgaaaagacaaataa

SEQ ID NO: 3288 - DNA, 183 bp, Staphylococcus epidermidis
ttttgtttattggtatttattaaattatacgaaagaccttatttttttaagtatttcattgtgaaattacatataaacacaaagtattttggcgagactcttgagggagcaggacaagttgaagactacaggctgaagctgtccctaagaaagcgagccaacaatacgaggtattgtaaataa

SEQ ID NO: 3289 - DNA, 165 bp, Staphylococcus epidermidis
aaaatttgttcttcgataagtcttttttatgattttagtactttaaataaagcgtcaaaaataatgttttatgaattaatttttatcttcaaatataacagttgtacttttatcaataagttgtgcagcataaattttgacaggctttcccaaactaaatcttaa

SEQ ID NO: 3290 - DNA, 501 bp, Staphylococcus epidermidis
tggttatgttcacgtattctgattaaactattcttaaataaaaatagaaaagaggaatacattatgaatacaaaatatttattagcagtcggagcaattgttacatcacttacattaggcgcatgtggaaattctaactcggaaagcgatcacgctaatcacaaagataaacaacaagaagacagtaatgtaaaaacagacacaacgaaaaaattatctggtaattttgaatctaaaaacggagaaaaagtagaaggtaaagctaaaattgaaaatggcaaacttatgttagagaattacaaatcttctaaaggtccagacctatatgtttacctaactaaaaacggagatattaaatccggtaaaaagatttcaacagtagactacaataaatccaaacaaacttttgatttaaaaaatgtagatttagaaaaatacaatgaagtaacaatttattgcgaaaaagcacatgtaatttttggtggcgctaaattaaaataa

SEQ ID NO: 3291 - DNA, 150 bp, Staphylococcus epidermidis
atatttacctccttagagttgcacagtgagaattataacgtactgactttttattgcaaccctaaaaaaatgtataaatttagctattctgtatttttaatcattttagaaaacgatttttcaggaatcaatataaataaaaatgtataa

SEQ ID NO: 3292 - DNA, 789 bp, Staphylococcus epidermidis
cgtcatacctcatactttaattcaggaggtgaaatgatgaaagaacgcttcagtcccaaaacgctttctgacattaccggagttagtatacgcacgcttcattattatcatgaaaaggggttactcgtgccacaacaaatgagtgctaatggataccgatattataatgttcaagatatttcaaagttacaatatattctctttttaaaggaattagatttaacattaaagcaaatacagacgtattttgaaggtgatagtgattttagaactaaaatattacatgataatttttatcacattgttaaaaaaagagatcgcttaaacgatattatccgtacgttagaacatcattttcacaaagataacgatgagattgaggtaactacaatgcaaaatttcaatttaaatgaacagtatgaaaaagaagcagcaagtaagtatggagatactcattattatcaagcatataaagataaacaaaaatgtaaggatgaatcagaacagcaaaatcattttgaggaaattaataagcaattaaatatgttttttgacgaaatgaatcaactatacttaaacaaagtttctatacttgaagcaagtggaaaaactaagaaattacaatgtattttgaaagaacaagttcctaattgtgacaatcaatttttagaatatatagctcagatttatattgaggacgagcgatttgtaaagtttattaacaagcaacgtgaacgtggtttgaatttatacatttctgacgcgataaaaacatttattaaattataa

SEQ ID NO: 3293 - DNA, 234 bp, Staphylococcus epidermidis
ggattcacctccatatatgttgtgtcacgcttaggtaacacgtatttaaatcatcatgactcaataagtgacaactacatgctaagaccttcccatcgtgacactccccgtaaaaaatgtgattggcttcattctatcataaatcttttgttatatgttaaacatatgccaatactatattgtagacaaaataatttttttattcaaccaatgacaaatcatttgaaagcatga

SEQ ID NO: 3294 - DNA, 174 bp, Staphylococcus epidermidis
ccttttaactcaataagttgtgcacctataaatggcccaaataaaaaaccaagtgaaaacattgaacgtaaaacagtattagcaaacttagcacgatcacgtgaacttgaagcattgattgattctctggcagaggcatacaattgtggcattgctggtgcaaataatccttga

SEQ ID NO: 3295 - DNA, 516 bp, Staphylococcus epidermidis
tctaatggctccaaatactctaaagaatcttcaaaatcatcgtttaaatcatctttcacaaaacgttttgttacttcgtgttgtggattctcaaatactttacttaccgctccctgttcgataactttaccgttttccattacagcaacttcatcacaaattcttcgtataacatgcatttcatgtgttataagtacaatagttaaattttgttgttcccttaccttcaataataaatctagaatttcatctgtagtttgtggatctaatgcacttgttgcctcatcgcataacaatacatctggatcattagctaatgctctcgcaatacccactctttgtttttgtccgcctgataattcagacggatacgcactttctcgaccttttaggccgacaagttcaatgagttccaatgctttttgtttagctagaccacttggaacgccagcaatttctaatggaaatgttacatttttcaatacatttcttgaccatagcaggttaaaatgttga

SEQ ID NO: 3296 - DNA, 162 bp, Staphylococcus epidermidis
aaatatttatcacttcatactaagcatatgcgtgaaatttttatccctaaaatcttatcaatgggtacaattatacacactctgctatgtaatgttaaccataaattttcatttttttacattcagatagtatttaattcacactttctcttatttttttaa

SEQ ID NO: 3297 - DNA, 684 bp, Staphylococcus epidermidis
ggagtcatatcaatgtcacaaaatgacttaaataaagaaaaagcacttgtcgtatttagtggtggtcaagatagtacgacatgcttattttacgctaaaaaacattttaaagaagtagaactcgttacatttaattacggacaaagacatgataaagaaattgaagttgcaaaaaaaattgcaaaagaacaaaatttgaaacatcatattttagatatgtcattactatctcaacttactcccaatgcacttacacaacatgagttaagtattgaagataatgatgatggtattcctaatactttcgtaccagctagaaatctattgtttttatcttttgctggcgcgttagcctatcaaattcatgctaaacatattattactggtgtttgtgaaacagatttttcaggttatccagattgtagagatagctttatcaaatctatgaatgtaactttaagtctttcaatggataaagactttgtcattcatacaccattaatgtggttagacaaagcacagacatgggcactcagcgataagctaggtgtgttagattatattcgccacaacacattaacatgttataacggtatcattggtgatggttgtggtgaatgtccagcatgtcacttaagagctcgaggtttaaaacattatcttgaacataaaggagaagaataa

SEQ ID NO: 3298 - DNA, 201 bp, Staphylococcus epidermidis
ggagggatatcaatgagcttacatttccaaattttgctgtggctttctatcttatttatcatcgcaggaacgatattattggtaacaatgcttaaaactaaaaaagaagaacgaaaagaatcttatctaggctttactgtaattttcttaatctttggttttgccatcttaatttatacttttatattcggaattttataa

SEQ ID NO: 3299 - DNA, 201 bp, Staphylococcus epidermidis
attcagacatcatcgtggcttaatataagaaaagtaacagctcaacgagctgaaaatcatcaaaaaaattataaaaaagacaatttctatattatttcaatagaaattgtctttatttacttatcctggaactttatgtcccaacctcttatttttatattaatgtctttagtaatcattttgaaattagaatatctttaa

SEQ ID NO: 3300 - DNA, 168 bp, Staphylococcus epidermidis
attcagacatcattgtggcttaatataagaaaagtaacagctcaacgagctgaaaataatcaaaaaaattataaaaaagacaatttctatattttttcaatagaaattgtcttttttacttatcttgaacctttttgtcccagcctcaaaaaaccacccacaatttga

SEQ ID NO: 3301 - DNA, 471 bp, Staphylococcus epidermidis
ggaatcaaatcattcttaaccatgaagactaacgtaattatagatggagatgcttgtcctgttgttaattctgtcattgaattgacgaaagggacaggcatttttgttacaattttaagaagttttagccatttttcacaacaaatacaacccgaacatgtaaaaattgtatacgttgatgacggtcccgatgcggtagactataaaatagtcgaacttgctagcaataatgatatcgtcatcacacaagattatggacttgctagtctactgatagacaaagtacatactgtcatgcatcataaaggaaatatttatcactcaaacaacatccaaagcttattaaatcaaagatatctaaatgctcaaataagaagacgaggtggtcgtcacaaaggccctcctcccttcacaacagaggatagacttaaattcgagcatgcttttagaaaaatcattaatcaaatatag

SEQ ID NO: 3302 - DNA, 210 bp, Staphylococcus epidermidis
aatcaaatgtctttttatgattttattttaggatttatcaatgacgatacgccactaggtcatttagcacaatacatttttaatgatgcttgtttcccaaaggaagagaaaaataataattctataagaacctatgtgcttcttaattataatgatcgtcagttaatcgaaagtacaaatcgtgcaattagtctatatcaattaatttga

SEQ ID NO: 3303 - DNA, 273 bp, Staphylococcus epidermidis
atcaaatcgtcctgcaacttctctctgctaattgggtcaagagcactaaaaggctcatccatgataataacgggaggatctgcagctaatgctcgcactacaccaaccctttgtcgttgtccacccgatagttcatcaggttttctatttttaaattgctcaggatttaaacctaccattgtcaataattcatccacacgtaaatcaatatcgttatctttccactttttcatttggggtacttgtgcaatgttttctttgatagtcatatga

SEQ ID NO: 3304 - DNA, 276 bp, Staphylococcus epidermidis
ttcactactttgtcatgttattactccgcacttgtaactgttgcgagcatacaaacagttggaattatccttgtagttgctttactaatcactccagcttctacagcttttttaatcagtaaacaactttatgccatgatggtaattgcaagcataatcagcgtgataagttcgattatcggtctaaattttagttatatatataatattccaagtgggagcaactattgttatctgtacctttatgatttatattgtaacgctatcagttactag

SEQ ID NO: 3305 - DNA, 1029 bp, Staphylococcus epidermidis
ctaagggagtctttatttatgtcatatattttaattgtcacgatagctatagttatattttcattaatatttgactttatcaatggtttccatgatacagctaatgctgtagctactgcggtttctactcgagcattaacaccaagaagagctattttattagcagcagtcatgaactttattggggcattgaccttcacaggtgttgctggaactattacaaaagatatcgttgatccattcaaattacaacatggtttagttgttgtgttagcagctattattgctgccattatttggaatttaatcacttggttgtatggaataccaagttcatcttctcacgcactaatcggatctatagcgggtgcagccattgcatcgcaaggttcgtttgcagtattacactatcaaggttttacaaaaattattatcgtattaatcatttcaccaattatagctttttgtgtaggttatatgatgtatacgattgttaaaatcgtttttaaaaattcaaatttaacacgtactaatcgtaattttaggtttttccaaatctttactgcagcattacaatcattctcacatggtacaaacgatgctcaaaaatctatgggtattatcacattagctttaattgtaggtaatttacaagatggtagtaatgttgaacctcaagtatgggttaaagttgcgtgtgcaacagctatgggattaggtacagcagtaggtggttggaaaatcatcaaaactgttggcggaaatattatgaaaattagacctgctaacggtgcagccgctgatatttcttcagcattaacgattttcgtagcgtcatcattacatttcccattatctactacacacgttgtgtcttcatctattctaggtgtaggtgcttcaaatcgtgcgaaaggtgttaaatggagtactgctcaacgtatggttgtaacatgggtgattactttacctatctcagctgttttagcagcaattatttattttattattcatctgttcttaaaataa

SEQ ID NO: 3306 - DNA, 138 bp, Staphylococcus epidermidis
caattcacttttacccatttctttttcgttgcttgtcattttcttaagtcaccgccaattataatcttcaatcaatatcattatattaaattcatcttatcacactcaaatatgcaaagtaacatacttatattgtaa

SEQ ID NO: 3307 - DNA, 165 bp, Staphylococcus epidermidis
gctccaacttttgtcatcaatgctgcaaataacgcggcaagttccgtattaagcactgcatatgctttaggtaaccacatgaaaatcactagtgctgcctttgaactaaaagcaactagaaatactaaagatatcatcgttattgtttggttattttccatatga

SEQ ID NO: 3308 - DNA, 249 bp, Staphylococcus epidermidis
cttatgtttccgttagtggagttctgtatttcaaatatggccaaaggtagtgatgttgtatttgaaaaattagaaaatgatcctaacatagatgtccttgaatacggttgtctacaaaattgtggtctatgcgcaagtagcttgtatgcccttgtagatggtgatattgttgaaggtaacacaccagacgatttattaaaaaacatatatcaacatatcgaagataatgatataacgaatttgttataa

SEQ ID NO: 3309 - DNA, 159 bp, Staphylococcus epidermidis
gcactcactcctttaattctttatgtcttctgtgctcatgttaattgtactataaatattactaaaataacaataatattacaaaatgattacgtggatttagtagatgacttttttaacaactgttttagcgcttatagagaaacctatctttcttaa

SEQ ID NO: 3310 - DNA, 195 bp, Staphylococcus epidermidis
acaggatatcctttggctaacatcgctgaaacacttaaaacaagtaacagtgtgattaaactgaaaataatggaaaatatagggaaccataaaaaactaagtcccaaaaataaagcaattccagatcctaatgatgcaccactagctaatcccaatgtaaaactatctgcaagtggattatttaacacaatttga

SEQ ID NO: 3311 - DNA, 510 bp, Staphylococcus epidermidis
gaaaggctgttagttatgtttatttatctgtttcactttatcattagtttcattgccacagtccttttttcaattatatttaatgcacctaaaaaattgctattagcttgtggatttgttggagctgttgcttggacaatatatcagatgacagtaggtatggatttaggtaaagttggcgcttcatttttaggaagtctaatattaggattaatgagtcatacaatgagtagacggtacaagcaacctgttattatatttatcgtccccggcattatacctctcgttccaggtggcgcagcatatgaagctacaagatttttagtatcaaatgattatacgaatgcagttaatacttttttagaggtaacattaatttctggtgcaattgcattcggtatacttgtatctgaaatagtctattacatttattcacgcatcaagcaatcttatggtaaaatcaagggtaaaacttataaaaaatcctataatatgaataatagagtataa

SEQ ID NO: 3312 - DNA, 939 bp, Staphylococcus epidermidis
gaaaggatgttcaaaacattgaataaaaatgacatcttacgcggattagagtcaattcttcctaaagatattattaaagtggatgaacctctcaagcgttatacatatacagaaacaggaggagaggcagatttttatttatcccctaccaaaaatgaagaagtccaagccatcgtaaagtttgcccatgagaacagtataccggtaacttatttaggaaatgggtctaacattatcattcgagaaggtggaattcgaggaatcgtcctcagcttattatctctcaatcatattgaaacctctgatgatgcaattatagcaggtagtggtgcagcaattattgacgtttcaaatgttgcacgtgaccatgtattaaccggtttagaatttgcatgcggtatccctgggtcaattggtggcgccgtattcatgaatgctggtgcttatggcggagaagttaaagactgtattgactatgcattatgtgtcaatgaaaaaggtgatttattaaagctcactacagctgaactggaattagactatagaaatagtgtggtacaacaaaaacatttagttgtattagaggctgctttcaccttagaaccaggtaaattagatgaaattcaggccaaaatggatgatcttactgaaagacgtgaatctaaacaaccgcttgaattcccttcttgcggaagtgttttccaaagaccaccgggtcattttgcaggtaaactcattcaagattctaatttacagggctatcgaatcggtggcgttgaagtttcaactaagcatgcgggattcatggttaatgtagacaacggtacagcaactgattatgaagcacttatacatcacgtacaaaaaatagttaaagaaaaattcgatgttgaattgaatactgaggtacgtattataggtgatcatcccacagattaa

SEQ ID NO: 3313 - DNA, 270 bp, Staphylococcus epidermidis
ggtgtaacacctatgaaattaaacaaagcaaatatattcaatttgatattcaccattttatttttttcatttaacattctcataacctataacgcaaatatagattataagttatggttaatacctggtttagcaatttgtggttttgctcttttttcaagcttgaccttagtaattatctatagtgatttattcagtgaaatattattttttatcaacattatcttagcactgtattacatttatccgattttttatgaatttgtctaa

SEQ ID NO: 3314 - DNA, 762 bp, Staphylococcus epidermidis
atgagaacaccaattatagccggaaactggaaaatgaataaaacagttcaagaagctaaagactttgtaaacgaattaccaacattacctgatcctaaagaagtagaatcagttatttgtgcaccaacaatccaattagacgctttagtaacagctgttaaagatggtaaagcaaaagggttaaaaattggagcacaaaacgcttactttgaagaaagcggtgcttatactggagaaacttcaccagtagcattatctgaattaggtgttaaatatgtagtgattggtcactcagagcgtcgtgactatttccacgaaactgacgaagaagtaaacaaaaaagcgcatgctatcttcaatcacggtatgacacctattatttgtgtaggtgaatctgatgaagaacgtgaagctggtaaagcaaataaaatcgtaggtaatcaagtgaaaaaagctgtcgaaggtttatcagatgatcaacttaaagaagttgttattgcatatgaaccaatttgggctatcggtactggtaagtcatctacatctgaagatgcaaatgaaatgtgtgctcacgtacgtcaaacattagctgacttatctagtcaagaggttgctgacgctacacgtattcaatatggtggtagtgttaaacctaataacattaaagaatatatggctcaatcagatatcgatggcgctcttgtaggtggcgcatcattaaaagttgaagatttcgtacaattgttagaaggtgcaaaataa

SEQ ID NO: 3315 - DNA, 1107 bp, Staphylococcus epidermidis
atgaaaggaccgtcaattgtagtaaaaggtgcacgagcacataatttaaaaggagtagatattgaattacctaaaaacaagttgattgtcatgactggactttcaggctcaggtaaatcttcgttagcgttcgatactatttatgctgaaggtcaacgacgttatgtggaatcgttaagtgcatatgcgcgacaatttttaggacaaatggacaaacctgatgtagataccattgaaggtttgtcaccagcaatatctattgatcagaagacgacaagtaaaaacccacgttctaccgttgccactgtgactgaaatctatgattatattcgattattatatgcgcgtgtcggtaaaccgtactgtccttatcacggtatagaaattgaatcacaaactgttcaacaaatggttgatcgtattttagaattggaagaacgtacaaaaattcaattacttgctccagttatatcacatagaaaaggaagtcatgaaaaattaattgaagatataggtaagaaaggatatgtgcgtttacgtgttgatgatgaaatcgtcgatgtaaatgaagtgcctcaattggataaaaataaaaatcacacaattgaagttgttgttgatagacttgtagttaaagatggcattgagacgcgtttagcggactctattgagacagcacttgaacttgctgaaggtaatttaacagttgacgttattaatggagaagaacttaaattctctgagaaccacgcatgtcctatatgtggtttctctattggtgaattagaacctagaatgtttagtttcaacagtccgtttggtgcgtgtccaacttgtgatggtttaggtcaaaaactaaaagtagacctagatttagtcattcctgataaaaataaaactttaaatgaaggtgcaattgaaccatgggaaccaacaagttcggatttttatccaactttattaaaacgtgtatgtgaagtctacaaaattaatatggataagccatataaaaaattgactgatagacaaaaaaatatacttatgaatggttctggagaaacagaaattgactttactttacacgcaacgaaatggtgttactcgtag

SEQ ID NO: 3316 - DNA, 156 bp, Staphylococcus epidermidis
cctaaaatgccttgcattaatgttttgcataaagatttattcgttgttaagcgattagaaataaatgtgcttactaaatatagaaaaaacactttaacatatcttggattcattttcattatattaccttctttaaaactatacttgaacacttaa

SEQ ID NO: 3317 - DNA, 273 bp, Staphylococcus epidermidis
cagcaggtgccaaaaggtaaacgatttgcgctacctaatgctgaagttatgattcaccaaccattaggtggtgcacaaggacaagcaactgaaattgaaattgcagcaaatcatattttaaaaacacgtgaaaaattaaatcgtattttatcagaacgtacaggtcaatcaattgaaaaaattcaacaagatactgatcgcgacaacttcttaacagctgcagaagctaaagaatatggattaattgatgaagtaatggaaccagaaaaataa

SEQ ID NO: 3318 - DNA, 2571 bp, Staphylococcus epidermidis
gccaaacagtttttagttaaaggagcgacgcgtgcaatgggatttttatcgaaaattgttgacggcaataaaaaagaaattaaaagattaggtaagttagcagataaagtacttgctttagaggaagatactgcgatattaaccgatgaagaaatacgtgaaaaaacaaaatcttttcaaaaagagttagcagaaattgaagatgtaaaaaaacaaaatgattatttagataaaattttacctgaagcttatgcacttgtacgtgaggggtcaaagagagtatttaatatgattccttataaagtacaagtaatgggtggtattgctatacataaaggtgatattgcagaaatgagaacaggtgaagggaaaacattgactgcaaccatgccgacgtatttgaatgctttagctggtagaggtgtacatgttattacagtcaatgaatatctatcaagttcacaaagtgaagaaatggctgaactatataactatcttggcttaactgtaggtttgaacttaaatagtaagtcaactgaagaaaaacgtgaggcttacgcacaagatatcacttatagtacgaataatgaacttgggtttgattatcttagagataatatggtgaactatgctgaagagagagtaatgcgtcctctacattttgcaattattgatgaggtcgattccatattgatcgacgaagcaagaacacctttaattatttctggtgaagcggaaaaatctacttctttatatactcaagcaaatgtttttgcaaaaatgcttaaagcggaagatgattataattatgatgaaaaaaccaaagctgtacatcttacagaacaaggtgcagataaagctgaacgtatgttcaaagtagataatctttatgatgttcaaaatgtggaagtgattagtcatattaatacagctttaagagctcatgttactttgcaacgcgatgttgattacatggtcgttgacggtgaagtattaattgttgaccaatttactggacgtacaatgcctggacgtcgtttttctgaaggtttacaccaagcaattgaggctaaagaaggtgtagcaattcaaaatgagtctaaaacgatggcatccattactttccaaaactatttcagaatgtataataagttagcggggatgactggtacagcgaaaaccgaagaggaagaatttcgtaatatctataatatgacagttacccaaattccaacaaacaaacctgttcaacgtaaagataattcagacttaatttatattagtcaaaaaggaaagtttgatgcggtagttgaagatgttgtagaaaaacataaaaaaggacaacccgtcttactaggtactgttgctgttgagacttctgaatatatttcaaatttactaaaaaaacgtggtgtcagacatgacgtattaaacgctaaaaatcatgaacgcgaagctgaaatcgtttcaaacgcggggcaaaaaggtgcagttacaattgccacaaatatggctggacgtggaacagatattaaacttggtgatggtgttgaagagttaggtggacttgctgttattggtactgagcgtcatgaatcaagacgtattgatgatcaattacgtggacgttcaggacgccaaggtgatagaggagatagtcgtttttacctatctttacaagatgaattaatggtacgttttggttcagaacgcttacagaaaatgatgaaccgtttaggaatggatgattcaacgccaatcgagtcgaaaatggtatctcgagctgtagaatcagctcaaaaacgagtagaaggtaataactttgacgcgcgtaaacgtattctagaatacgatgaagttttacgtaagcaacgtgaaattatttataatgagcgtaatgaaatcattgatagtgaagaaagttctcaagtcgttaacgcgatgttacgttctacattgcaacgtgcgattaatcattttattaatgaagaagacgataatcctgactacatgccatttatcaattacgttaatgatgtgttcttgcaagaaggagatcttcaagatacagaaattaaaggtaaagattcagaagatatttttgaaattgtatggtctaaaattgaaaaagcatatgcacagcaacaagaaacattaggagaccaaatgagtgaatttgagcggatgattttattacgttcaattgatacacattggactgatcatattgatacgatggatcaattgcgtcaaggtattcatttacgttcatatgcacaacaaaatccacttcgtgattatcaaaatgaaggtcatgaattatttgatatcatgatgcaaaatatcgaggaagatacatgtaagtatatcttgaaatcagtggttcagtttgaagatgatgtagtacgtgaaaaatctaaaagctttggtgaagcaaaacatgtaactgctgaagatggcaaagaaaaagcaaagccccaaccgattgtaaaaggtgatcaggtaggtagaaatgatccatgcccatgtggtagtggtaaaaaatataaaaattgtcatgggaaagcgtaa

SEQ ID NO: 3319 - DNA, 123 bp, Staphylococcus epidermidis
tcgctcaagtttattgaaacttttgcgactatttttttatacatgattacgtttgattatacatttttatttatattgattcctgaaaaatcgttttctaaaatgattaaaaatacagaatag

SEQ ID NO: 3320 - DNA, 135 bp, Staphylococcus epidermidis
ggtgtaaagttattttctaattctaaacacacacttaagctatcatatcataactacgaattcgcttataattatttctttttatcactaggagtaaagcgaattgtacttgttaattctaaggcaagttcataa

SEQ ID NO: 3321 - DNA, 753 bp, Staphylococcus epidermidis
aataaaattactatagtgtacgaaatgagggatagaatgacccatgtagatattgcagcgacaattgcaccagaagacaagctttctaaaactttactcaaagatataaaagtaaacgaagaatcaatagatatcattgaattgcgcattgaccaatggccatcatttaataaggcattattaaatgaagtgattaagcaattaaaaatattccatttgaaaatattagtaacatatagaacttcagttcaaggaggaaaaggagctgtaaatgagcaagagtatttaaatatactaggtgaattaattgagtgtccacaatttgatatgattgatattgagtggagcagtgccgtcaaaattgaaaaatatacgcatcttgttcaacgtgcacaacaaaaagggctcgaagttgttctttcgcatcataattttcaagaaacacctgctttagatgaacttaaatttatttactttaaaatgcaaaaactcaatcctgagtatttaaagcttgcggttatgcccaaatgtcaagaggacgtgttacatttattagaagccatgtcactcacagcgaagcacacaacatgccgaattgtcggtatatcgatgtctagtttgggtaaagtcagccgaattgctcaaggcgtatttggtggaacgctgtcttatggttgcatagaagaaccacaagcacccggacagatacatgtctctaagttaaaatccatggtttctttttatgaggattaa

SEQ ID NO: 3322 - DNA, 582 bp, Staphylococcus epidermidis
ggagagattactatgattagatttgaaattcatggagataacctcactatcacagatgcaattcgcaactatattgaggagaaagtaggtaaattagaaagatactttaacaatgtgccaaatgctgtagcacatgttagagttaaaacttattctaattctacaactaaaattgaagttacaattcctttaaaagatgtcactcttagagctgaagaaagacatgatgatttatatgcaggcattgatttaattactaacaaattggaaagacaagtacgtaaatacaaaactcgtgtaaatcgtaaacatagagatcgtggagatcaagatatctttgttgctgaagtacaagagtctacaacaaacaatcatgcagatgatatagaaagtgaaaatgatattgaaattattcgttctaaacaattcagcttaaaaccaatggattctgaagaagcagtattgcaaatgaatttattgggacatgatttctttatttttaccgatagagaaactgatggcacaagcattgtttatagacgaaaagatggcaaatacggtctgattgaaacaactgaataa

SEQ ID NO: 3323 - DNA, 813 bp, Staphylococcus epidermidis
ggaggagttactttgaaaaagttagcctttgcaattacagccgcttcaggcgcagcagcagttctatcacatcatgatgctgaagcttctacacaacataaggttcaatctggagaatccttatggactattgcacaacaatacaatacttcagtagaaagcattaagcagaataataatcttagcaacaatatggtattcccaggacaagttattaatgtaggtggaagtgcttcacaaaatactagttcaaacacttcttcaagttcagcatcttcacatactgtagtagcaggtgaatcattaaacatcatagctaataaatatggtgtttcagttgatgcattaatgcaagcaaatcatctaaatggttatttaattatgcctaaccaaatattaactatccctaatggtggttctggttcaggatcaggtggtacagcaactcaaactagcggtaattatacttcaccttcattcaaccatcaaaacttatacactgaaggtcaatgcacatggtatgtgttcgacaaacgttcacaagctggtaaacctatcagtacttactggtctgatgcaaaatactgggcgtcaaatgcagcgaatgatggttatcaagttgataatactccatctgttggtgcaattatgcaaagtacacctggaccatatggtcatgtagcatacgttgaacgtattaatggtgatggtagtattttaatttcagaaatgaattatgcaaatggtccatacaatatgaactatcgtactatcccagcttcagaagtatcttcatatgcatttatccactaa

SEQ ID NO: 3324 - DNA, 675 bp, Staphylococcus epidermidis
atgaatgagttaggtcaaacaattattgagaattacaatacctttgcgccaaaaaatatgttctcagagtggcttaagaatctgctacaaccacttgccactttatcgttgggattttttgtatataaatacactgataatcgtcataaaaaaagattattaaacgagttagattcgaagtcagaatggagaaaaacgttatttataataggtgggaactctaccgtcacattagatgatgtatatcaattcagaactgcactaagatttaattttaaaaacaatgggaactatatcgataaagagaaaagcaaaaaagaaggctttagttatttctttgacaatatgaatataataattattaaatactgtattaatctaatagaaaagaagcaagcagtatctaactcaatagatttagatataaaagatcaaaacagtataagactattttgtagatatatgttagcagaccactgggagaaaaatcaaaataaaaatttaaaatttgatgatcctaacaaagaagaagagttatgtattttcacattaaaagagtttttgaagctacacaaatattatcaaaattctaaagatgaagattcaaaaaataaatttaagtctttatttgacgaatcgaaagagttagtagaaaaaaaagacaccccttcataa

SEQ ID NO: 3325 - DNA, 552 bp, Staphylococcus epidermidis
agcttagctacacaacagcaaaaattattctttaagctactgttttttactctggtgcacgtaagggcgaaattagagccctcacatggcgcgatattaactacgatgatgattttcatacatataaataaaacggactatcacggtgaagtgacagcccctaaaacaaaagcagcaatacgtgatatatacctaccttttcatatgatgaatgacatagaaaaatatttaaaatggtacaaagaaaacaatgtatataaagatgattatgtattattcggtacattcttcaaggcatacagtgaatcaactatagatcgttggtttaccactgcattaaaagtgttagatgaacaactgccagacgttcagacattccctagaatcgttatacatgaattaagacatagccatgcgtctatgctagtcaatcatggtgcaagtatcatggtaatagcacagcgtttaggtcatgctgatagtaatgaagtatataaccgatacggtcatttgtaccctagtacgcagaaagaaatagttaaatacttgtaa

SEQ ID NO: 3326 - DNA, 126 bp, Staphylococcus epidermidis
ttattatatactaactttttactatatattttctatacccattttaatagatactatttaataaatgaaaagaattcttataataaaagtaaaaaatttatgaatcatcaaaaagaaagattataa

SEQ ID NO: 3327 - DNA, 1554 bp, Staphylococcus epidermidis
agatttcgtacaattgttagaaggtgcaaaataattatggcaaaacaaccaactgccttaatcatcttagatggtttcgcaaatcgtgaaagtgaacatggcaatgcagttaagcaagcacataaacctaattttgatcgatattatgaaaaatatcctacaacacaaatagaagctagtggcttagatgtaggtcttcctgaaggtcaaatgggtaactctgaagtaggacatatgaatattggtgcaggacgcatcgtatatcaaagtttaactcgtattaataaatcgattgaagacggagaattctttgataacactgtattaaataacactgttaaacatgttaaagacaatggctctgcgcttcatgtattcggattgctttctgatggtggtgtacacagtcattataagcatctatttgctattttagaattagctaaaaagcaaggaatagataaagtatatgtccacgcatttttagatggtcgtgatgttgatcaaaaatctgctttgaaatatatagaggaaactgaagataaatttaaagaattaggtgtaggccaattcgcttctgtttcaggacgttattatgctatggaccgtgacaagcgttgggatcgtgaggaacgtgcctataatgctattcgtaactttgaaggtcctacatttacttcagctaaagcaggcgttgaagctaattataaaaatgatgtgactgatgaattcgtcgaaccgtttatagttgaaggccaaaacgatggtgtgaacgatggagacgcagtaatcttttataatttccgtccagatagagcagctcaactttcagaaatctttactaataaagcgtttgatggatttaaagttgaacaagtggacaacttattctacgctacattcacgaaatataatgacaatgtagatgctgaaattgtatttgaaaaagttgacttaaataatacaatcggtgaagttgctcaagataatggcttgaaacaattacgtatcgctgaaactgaaaagtatccacatgtaacatactttatgagtggtggacgaaatgaagagtttgaaggagaacgtcgtagactcatcgattctccaaaagtagcgacttatgatttaaaacctgagatgagtgcatatgaagttaaagatgcattattagaagagttagacaaaggtgacttagatttaattctactgaactttgctaacccagatatggttggacatagtggtatgcttgaaccaacaattaaagcaatcgaagcagtagatgagtgtcttggtgaagtcgttgacaaaattattgatatgggtggtcatgccatcatcactgcagaccacggtaactcagatcaagtattaactgatgacgaccaacctatgacgacacacacaactaatcctgttccagttattgtcactaaagaaggtgttacattaagagaaactggacgtttaggcgatttagcgccgacattattagatttattaaatgttaaacaaccatctgaaatgacaggtgaatcactgattaaacattag

SEQ ID NO: 3328 - DNA, 723 bp, Staphylococcus epidermidis
atcatgcgtacgaatgataaagtattactcgaaaatattaatgattattttagtcacaaaggaatgtcaccacacttaattgatgatataaaagaaaaatatcgacaagatattaaaaagtctgaagaaaaagatcaagattacattgaatatagaggtaaatcacctgcgcaattaatattaacaattcagcgtaatttgtttgcattacaactcaatccaatgattttctttatcattaactttattcttatttcatatttgtacgataaacaatatgtaccttttcaagcaattaccggtataagcttgttttattgcttagttatatttccaataacactcattttatatgtgcgtattgccaaaaaaaattatctatacagtaataagtatgaaatgagaactggaataatcattggtattattgctttaattctagtaattatgcaagggtttcactttaactgggctattattcctatttctatctatggtcatcagtttgtatttttcgctggaattattttaagtcttgttggtatattctttaaacgtatagaatttgtaggagttggcttactattttgtcaaaaaacaatagatgcaatggtaactgacccggaaattgcacagtttttctctttagcaatttggattatacttgttgtgctaatcattttttatacgatacgtttatctgaacgcactaaatcatcataa

SEQ ID NO: 3329 - DNA, 948 bp, Staphylococcus epidermidis
gaaagttggtttttatcattgttttttctatatcttttaggaatttttgttggcatgttacttcctattcaaacttcaatcaactcaaggctaagccaatttacccgttcatctttttatgcttcaaccatatcttttgctgtcggaacaatatgcttacttgtgcttaatatcattattcatccacaagtattaacaccagaattcttttctaagcaaacacttaactatacttgggtcctaggaggactattaggtgttatctatttaactggaaacttattattattaccaagattaggcgcagcacttactgttgttattacggttacagggcaaattattatgggtgtaatcattgatacatttggattattgggcgcccatcaacaatcttttacattatttaaaggtgttggaattatatttttaattactggaattatatttatgaattatgttcgtagacatcctgttaatagacataagaatacaccaatagtattctggttgcttattggattcgtatttggtttcgctccgccaatccaaacaacaatcaacagcacactggctcaacacacacactcatccatatttgcttcactcatatcatttagcgttggtacaatagcgttatttatattaacattagtatttaatcgtagtctgaaaatatcatctactcataaaacactaggtaagattaaatctatttattttattggagggatactaggaatggcattcgtaacatctaatattattttaatgcctttcttaggagcagctttaactactataattgctatgatgggccaaatgattatgggtattattatcgatcatttcggtttgttgggttcacctaaaaacaaaataacatcacgtaagttaggtggattattatgtatagctataggtattattttattacgattattttaa

SEQ ID NO: 3330 - DNA, 138 bp, Staphylococcus epidermidis
gacatcatcacacgtctcaggtttttcttgtattattcgtcagtaactaaagtaaatacttatgttttcaactctgttactcactgtatcggtgaaacgataaacacaaattccatctcacctaattttaaattttaa

SEQ ID NO: 3331 - DNA, 513 bp, Staphylococcus epidermidis
tgggaggtcaccatgaacaatatccgtttattgaatcaaaacgatttggattcctatattgaattaatgaaatttggtcaccataattatgaatgggatcgttactatttagaaaatgttagcattgatagactcaaaactatcttgtctaatcatactgattattggaatatatttggtgcttttgaagatgatgaacttgttgcaacatgcactttaaaacaaatgaattatgtaggtaaatgccataaagctattcttgaaaataattttgttaaaaataatgatgaaattgttaaccgagaattaattaatcatattattcaatacgctaaagaacaaaatattgaaacattgatgattgctattgcatcaaacaatataagtgctaaagtgttctttagttctataggttttgaaaatcttgcttttgaaaaaaacgctagcaaaattggcaatgaatattttgacgaaaattggctcatttattcaacaactgagtcatcagattaa

SEQ ID NO: 3332 - DNA, 177 bp, Staphylococcus epidermidis
actaatttaacgaggtgctttatgtgtaaagaatataacatgactcaacatactctaccaatggaaacttcagttcttatccctacaaataatatttcacgacatgtaaatgatattgtagaaacaattcccgatactgaattcgatgaattcagtcatcatcgtggcttaatataa

SEQ ID NO: 3333 - DNA, 177 bp, Staphylococcus epidermidis
actaaattaacgaggtgccttatgtataaagaatataacttgactcaacatactctgccaatggaaacttcagttcttatccccacaaatgatatttcacgacatgtaaatgatattgtagaaacaattcccgatactgaattcgatgaattcagacatcattgtggcttaatataa

SEQ ID NO: 3334 - DNA, 183 bp, Staphylococcus epidermidis
actaaattaacggggtgtcttatgtataaaaattatcatatgactaaacatactctaccaatggaaacttcagtaattatctccacacatgatatgtcacaatatgtgaatgatattgtaaaaaaattccaggtactgaattcagacagcatcgttgcgcaacattatagcatcccaaaatga

SEQ ID NO: 3335 - DNA, 1149 bp, Staphylococcus epidermidis
attatgctaactgaaaaagagcaagatattatcaaacaaactgtaccattattacaagataaaggaactgagattacttcaattttttatcctaagatgtttgaggctaacccagaattattaaacatgtttaaccaaacaaaccaaaagaaaggtatgcaatctgctgcattagcacaagcagtactagctgcagcaatgaatattaataatttaggtgcaattaagccagcaattatgcctgtggcacataagcactgtgctttacaagtttatcccgaacattatccaattgtaggtgaaaatttacttgctgcaattcaagatgtgacagggttagaaagtgacgacccagtaattcaaacatgggcaaaagcgtatggagaaattgcagatgtatttatcaaattagagcaagaaatttacaaccatatgttatggaaaggttttaaaccatttaaaatcacaaacattacacaagaaacaagtgacatcaaatctttcacagttgaatctgaagaatatgatttaagtcaattcgaaccaggtcaatacattaccgtagatgtttctagtgaaaagttaccatatagagctaaacgtcattattcaatcatagatggagatgaaaatcacttagtatttggtgtcaaacgtgatgtgactactgaacatgaaggtgaagtttcaacaattttacatgatgaaatatcagaaggtgacatgattaatttatctgctcctgtaggtggcttttcaatagaaaatactgaaagaccgcaattgtttattggttctggcgtaggtatgacaccattagtttcaatgtttaaaaaagctgcatcattaaacgttccaactcaaatgattcaagcggttgtgacagaagatgaacgaccatttgctcaaaaacttgatagcattacagataattatgagcaagcacagctacatttacacgtgaaagataaagaaggttatttagaagctaaagaattagaacaatatttaagtgaacagcctgaaatttatatttgtggtggtacgaaattcttacattcaattataaattctcttaaagaattaaattatgatatgaatcatgttcattttgaaacatttattcctcgtttaagtgttcaagtatag

SEQ ID NO: 3336 - DNA, 168 bp, Staphylococcus epidermidis
cagtcgataactaaattaatatacgactatttcaaattttttagaacacaacatagagaatttcaccgagtaaattcaacaggcaaagcaggttggggttcgggattcaggacgtggggcaacgaattcaatttgaaatttgacacgtgcactcagttaattaaatga

SEQ ID NO: 3337 - DNA, 204 bp, Staphylococcus epidermidis
atatttgtaacaaatccattaattaaaagagaatattctataaaaataattccacaatcaacttcacgtactttattacttaaccactactatacgcttatttttggaaaagtaaaggattttctatattttataaattgtagagctcttaataatgtcaaaagctatttaaataaggcattgtatagattaatagtttattaa

SEQ ID NO: 3338 - DNA, 762 bp, Staphylococcus epidermidis
atgtcatcaacattagagattaaggacctacatgtgtctatcgaggataaagaaattttaaaaggtgttaacttaacaattaacactggtgaaatacacgcaattatgggacctaatggtactggtaaatcaacattatcgtcagcaattatgggacatccaagttatgaagttacacaaggtgaagtattattagatggcgttaatattttagagttagacgttgatgagagagctaaagcaggcttatttttagctatgcaatatccatcagaaattacaggggtaacaaacgcagattttatgcgctcagcaattaatgcgaaacgtgaagagggacaagaaattaatttaatgcagttcatcaagaaattggataaacaaatggactttttagatatcgataaagatatggctcaacgttatttaaatgaaggtttctctggtggagagaaaaaacgaaatgagattttacaattaatgatgttagaaccgaaattcgctattttagatgaaattgactctggtttggatattgatgctttgaaagtggtttctaaaggtattaatcaaatgcgtggtgaagagtttggagcattaatgattacgcactatcaacgacttttaaattatattacaccagataaagtacatgtgatgtacggtggtaaagttgtgaaatctggaggtccagaattggctaaacgccttgaagaagaaggctatgaatgggttaaagaagaatttggtgctgctgaatag

SEQ ID NO: 3339 - DNA, 249 bp, Staphylococcus epidermidis
tctaatacaacggcatttttaggattctttggtacttcgacagtattagagatttttttcttatcactgccattattttctttaccacttgcttcaaaactatttttgatggttacagtttctttagaatcactatttttctttttcgaagttgaattattattcgaactattactacaagccgttaaaactaaaactagagacaataataaaaataagactgtttttttcatatgtgcaactccctaa

SEQ ID NO: 3340 - DNA, 834 bp, Staphylococcus epidermidis
gtgaataaaactatcagagatatcattttagttatgataggttcatttattttctctgcaggtatcaatgcatttgttatttcagggaatttgggtgagggtggtgtcactggtatagccatcgtattatattatgcttttcatatttcaccgggaataaccaatttcgttttaaatgctattttaattattgtgggttataaatatttgagtaaacgtagtacatatttaacaatttttgctacagtactcatttcaatctttctaggtttaactgaaacatggcatgtagaaactgggaatgttgtgattaatgctgtgttcggtgggacttgtgttggtttaggaattggtattatcgttttagcagggggaacaaccgctggaacggttattcttgcgagaattgttaataaatatttagatattagtacgccttacgctttgttattctttgaccttatcgttgtgcttatttcattgacagaaattcctttagtgaagtgcttagttacagttatgtctttatatataggtacaaaagtgatggaatttgttatagaaggattaaatactaaaaaggcaatgactattatatctagtcgccctaatgaggtagcaaaagctattgatcagcaagttggaagaggattaacaatattaaatggacacggttattacactagagaagaaaaagatgtactttacgtagtcatctctaaaacacaagtatctcgtgctaaacgaatcatcaaaaatattgacgaaaatgcctttttagttattcatgacgttcgtgatgtatatggtaatggttttttgttagatgagtaa

SEQ ID NO: 3341 - DNA, 801 bp, Staphylococcus epidermidis
atgaaaaaaacgctaactgtaacgttaagttcgattgcagcttttattgcaatcaacactgcagctaacgcacaagaatctgagacgtcgcaactagacacatatgcaacgggtgatgtaattacaaatcaatcaaacttaggtatttacattgtaaaacctggagatagtttatataaaattgctttagaacataatctttctttagaagagctttatgcattaaatcctggtgtagaacctcttatttttccgggagatgaaattgtagtatctgaaactgcatttgaacaatttaataacacaaacacattcgtaaattatgaaactaactacattccagtaggatataataatgtatcaactgatacatccaacactacttatgataattatgatagtgaatcaactgatacatactctgtgtcaaacgcctatgatggtctaagaagtgtatctaactcagctaatttatacactactggtcaatgtacttattatgcattcgatcgtcgagctgagctagggaaaccaattggaagtctatggggcaacgctagtaactgggcatattcagctaatcaggctggctttaatgtagatcacacacctgaggttggtgctgtattccaaagtggtccgggtcaaaatggggctggtgcttatggacatgttggcgttgttgaatcaatcaattctaatggttctgtaactgtttcggaaatgaactggaatggtggcgttaacgtaaaatcttacagaactattagcaaccctaattcatataattacattcactaa

SEQ ID NO: 3342 - DNA, 846 bp, Staphylococcus epidermidis
tgtactatgacaaatgatgtccaaattttaaataacggttatccaatgcctgcagttggattaggagtttataagatagcggatgagcagatggaagaggttgtccgtacagctttagatgcaggatatcgtgcatttgatacggcatacttttatggaaatgaaaaagccttaggtagtgcattaaaacattcaaatgttgagagggacgagttattcataacatctaaactttggaatgattatcaaggttatgaccaaacaatagagtactttaataaatcattggacaatttagggttagactatttagatttatttttaattcattggccttgtgaaaatgatcaattgtatattgaatcatataaagccttagaacatttatatgaagaaggtaaaataaaagccattggtgtatgtaactttaagatacatcatttagaaaagttaatgaaagaaactaaaattacaccacaggtgaatcaaattgagttacatccgtactttaaccaacaagatgtacaagacttttgtgatgaacatgatattaaagtaacagcttggatgcctttaatgcgcaataaagggttgcttgatgaccctgtaattacagatattgctcatcgttatgataaaacacctgcacaaattgtcttacgttggcatcttgcacataatcgtattatcattcctaaatcacaaacacctaaacgtattaaagaaaattttgatatttttgattttaatcttgagttaacagatgttgcagaaatagatagtttaaataaaaatgctagacaaggaaaagatcctgatgatgtcagtattggagatttgaaataa

SEQ ID NO: 3343 - DNA, 960 bp, Staphylococcus epidermidis
acatccatgaccaagcaacgcatcgttatttcttcattactattcattttcattctcacaacttgtagttttagttacattactttctctaaattaacttctagaacagaagatattaaaaatattaaaactataaaagcaaagcccaaattactcctttcaacaactggtatacaagcccctcttaacagctatattttctactacactcccactttaggacaactccaaaaacttttagtaaaaaatcatagcaaagtatctaaaaacactccagtgttagaatattacaattatgaaaaagatcatttatatgaggaactccaaaatacacttagtaatgaacgtaacaacaaaactttaaattctaaaaatgatttacattattattcattccttaatcagctaaaattacaaatgattcaaactaaatcctcaattaaatccactttattttcaccaattaatggaagtatttcatatattaattctatcccttcaaaaccaaacgaaaagatagtgcaaattaatagcaacgaacgtattattcgtgctaatatatcagaatctgagttgaatttattaaaaataaatcaaaatatttctgtaacatctagtgacaacactcaatttactagtaaaattaaagaaatttcgaatataccatcaaaaataaaaaatggcgtctcatattacgacattttactttctacacaacccaatcatcaaattggaacacactttaaaatcaaattagcctcaaatgacataaagttacctacgtcagctattgttcaaaaacgctatgttttaattctaaaaaacgggaaaattacaaaaagagaagtaacatacaaaaagagtttaaaaagtgggtatattaatataactaaaggcttattgatagatgaaaaagttgttaaaaatcctacttctaaattaataaacatttatatataa

SEQ ID NO: 3344 - DNA, 495 bp, Staphylococcus epidermidis
atagagatgacagcgatattatggattttaattattatagcctttgcgttagcatttattggtttaattaaaccggtgataccatcacttttaatgttatggattggttttttaatttatcaatttggttttcatgagggaagattatcgtggattttttatgttgcaatgattatctttaccattatgatattagtagccgattttgtgatgaataaatatttcgtcaatcgctttggaggaagtaaaataggtgaatacacagcgctcataggtgtgattgtaggttgtttcgtttttcctccctttggtattatcattattccttttgttgctgtgttcattgttgaattggttcaagggtttaactttcaacaagctataaaggtgagttttggctcagtgattgcatttttagcgagtacaattgctcaaggtctaataatgattgtaatggttatttggttctttttagatgtctttctaataaattaa

SEQ ID NO: 3345 - DNA, 294 bp, Staphylococcus epidermidis
cttaatgcgacttctgcgccatctactatattttttccaaaaacattaattactttttctaaattcatacctgatattaatccaccgacaagtgcactaataaataagctaatgaccacatttaatcgacataaacatagtatgatcattaatatgactgcgattacaacagcatttatcattctgcctcaccctttatcactctatcgaactaaagtatttataaaatatatactagcaagacatatatttaatgtcaatgttaaaaaagactcaacgattatatacatttag

SEQ ID NO: 3346 - DNA, 1575 bp, Staphylococcus epidermidis
aataaggagacgattaaaatggctaaaggggaccaatatcaagctcatactgaaaaatatcatgataaaaagtctaaaaaaagttataaacctgtgtggattatcattagttttattattttaattacaatcttgttattacccacaccagcaggattacctgtaatggctaaagcagcactagctattttagctttcgctgtagttatgtgggttacagaagcagttacttatccagtttctgcaacattaattttaggattaatgatacttttactaggtttaagtccagttcaagatttatccgaaaaacttggaaaccctaaaagtggcgacataatactaaaaggtagcgatattttaggaacgaataacgcgcttagtcacgcttttagtggtttttcaacctcagccgtagcacttgtagctgcagcattatttttagcagtagctatgcaggaaaccaatttacataaacgacttgcattacttgtgctatcaattgttggaaataaaactagaaatatagtcattggtgctattttagtatctattgttctagcattctttgtaccatcagctacagcacgtgctggtgcagttgtcccaatattactgggaatgattgctgcatttaatgtgagtaaggatagtagacttgcttcattattaattattactgctgtacaagcagtttcgatatggaatataggtattaaaacggctgcagcacaaaatattgtagccatcaattttattaaccaaaatttaggacatgatgtatcatggggagagtggtttttatatgctgcgccgtggtcaatcattatgtctatagctctttattttataatgattaagtttatgccacctgaacatgatgcaattgaaggtggaaaagagttaattaaaaaggaacttaataaattaggaccagtcagtcatagagaatggcgactaattgtgatttcagtgcttttattattcttctggtcgactgagaaagtattgcatccgattgattcagcttcgattacactagttgctctaggtattatactaatgccaaagattggtgttattacttggaaaggtgttgaaaagaagattccttgggggacgattatagtatttggtgtaggaatctcacttggtaatgtattacttaaaacaggagccgctcaatggttaagtgatcaaacatttggtttgatgggtcttaaacatttaccgatcatagcaactattgcgttaattaccttatttaatatattaatacatttaggttttgcaagtgcaacgagcttagcctctgcgttaatacctgtgtttatttctttgacttcaacgctaaatttaggtgatcatgctattggttttgtattaatacaacaatttgtgattagttttggtttcctactacctgtcagtgcaccacaaaatatgcttgcatatggtactgggacttttaccgtaaaggattttttaaagacaggtatacctttaacgatagtaggttatattttagttatcgtatttagtttgacgtattggaaatggcttggtttagtgtaa

SEQ ID NO: 3347 - DNA, 1944 bp, Staphylococcus epidermidis
caaaatttttttgaaaattcgatagttgacaatttccagtatttgaaaaggaagataagcatggaagcatacaaaattgaacatttaaataaatcctatgcagataaagaaatttttaatgatcttaacctatctatatctgagcatgaaagaattggattagtaggtatcaatggaacaggtaaaagtacactattaaaagtcattggtggtctagatgaagattttactgcagatattacccaccctaatcaatatcgcattcgttattcctctcaaaaacaagacctcaatggccatatgactgtgttcgaagctgttttaagttcggatactcctacattaagaattataaaaaaatatgaagaagcagttaatcgctatgcgttagatcaaagtgactctaattttaataaaatgatggaagcacaagaagaaatggatcaaaaggatgcatgggactataatgcagaaattaaaacgattttatctaaactagggattcacgatacaactaagaaaatagttgaactttcgggtggtcaacaaaaaagagttgtattggctaaaactctaatagaacaaccggatttacttttgctagatgaaccgacgaaccatcttgactttgaatccatccgttggctcattaattatgtcaagcaatatccacatacagttttatttgtaacacatgatcgctactttttaaatgaagtatcgacgcgaattattgaactggatagagggaagttaaaaacatatccaggtaattatgaagattacatagtaatgcgtgcagaaaatgaattagtagaacaaaaacaacaagaaaaacaaaaagcattgtataaacaagagttagcatggatgcgagcaggagcaaaggcaagaactactaaacaacaggcacgtatcaatagatttaatcaactagaatcagacgttaagacgcaacatacacaagataagggtgaacttaatcttgcatattcaaggttaggtaaacaagtatatgaattaaagaatttatcaaaatcaattaataataaagttttatttgaagatgtcactgaaattattcaaagtggtagacgtataggtattgtaggacctaatggagcgggaaaaacaacattacttaatattttaagtaatgaagatcaggactatgagggtgagcttaaaatcggtcagactgttaaggtagcttattttaagcaaacagaaaagacacttgaccgtgatattagagtgattgactacctaagagaagaaagtgaaatggctaaagaaaaagatggtacctcaatttcagttacacaattgttagaaagatttttatttccgagcgctacacacggtaaaaaagtttataaactctcaggtggagaacaaaaacgtctgtatttattgcgtttacttgttcataaacctaatgtactccttttagatgaaccgactaatgatttagatactgaaacacttacgattttagaagattacattgatgatttcggtggttctgtcattacggtcagtcatgatcgttatttcttaaataaagtggtacaagaatattggtttattcatgatggtaaaatcgaaaaaattattggatcatttgaagattatgaatcttttaaaaaggaacatgaacgccaagccatgctatctaaacaaactgaacaacaaaataaacataagcatcaaccaaaaaagaaaacaggactatcttataaagagaagttagaatacgaaacaattatgacgcgtatagaaatgactgaaacgcgtttagaagaccttgaacaagaaatgattaatgcaagtgataattatgcaagaatcaaagaacttaatgaggataaagagcaacttgaagcaacctatgaagcagacatcacgagatggagtgagcttgaggaaattaaagaacaataa

SEQ ID NO: 3348 - DNA, 513 bp, Staphylococcus epidermidis
gaggacattgccatgcaacatcttataaaaaaacatgtattgaatggcgagtttgaactagttagacagttaatgtccgaaacagattttatggaatttgaagaagcatacatctctagtgctcatgaagtagagagtatgatgttttatacatgtattctagatatgattaaggtagaagaatcatcagaattacatgatttagcattccttttacttgtttatcctttaagtgaatatgagggcgcactagattcagcttattatcatgcagattcttccataaaacttactgacggaaatgaagtgaagagtttattacaaatgttattgcttcatgctattcctgagccagttatttcggataaaaaagcgtttgatgtcgctaaacgaattctaaaactcgatccaagtaataatgttgcacgaaatgtacttaaagatacagcaaaacgtatggataatgtagttgtagacattaatgaattgaacaatcaaagagatgcacgctaa

SEQ ID NO: 3349 - DNA, 2136 bp, Staphylococcus epidermidis
aaatatgctgctaaagtcattttagaagctgcaacaaaagcaggtgctcctaaagattgtattcaatggatagaagtgccatcaattgaggcaactaaacaattaatgaatcataaagatattgctttagttctagcgactggaggctctggaatggtaaagtccgcatattcgacaggtaaacctgcattaggagtcggtccaggtaatgttcctacttatattgaaaaaactgctcatatcaaacgtgctgttaatgatatcattggttctaaaacttttgataatggtatgatttgtgcttctgaacaagtcatggttgttgataaagaagtatacactgacgtcgttaaagaattcaaattacaccaaacatattttgttaataaaaatgaactacaacaattagaagatgccatcatgaatgaagataaaactgcagttaaacctgatatagttggtaaatctgctgtagatatagcgaaattgtcaggaattagtgttccagaaaaaacaaaattattagtcgcagaaattgatggaattggaaaagattatcctttatcacgtgaaaaattatcacctgtactcgcaatggtaactgcaaaatcaacaggacatgcactacaaatttgtgaagacatattaaaatttggtggtttaggtcacactgctgtaattcacaccgaggatagtcaattacaacaaaaattcggtctaaaaatgaaagcttgccgtgtattggtaaatacaccttctgctgtcggaggaattggaaatatgtataatgaactcattccttcactcacgttaggttgtggttcatatggtagaaattctatttctcataatgtaagcgcagtagacttattaaatattaaaacaatagcaaaacgtcgtaataatatgcaatggtttaaactcccacctaaagtttattttgaagaaaattcagttatgtatttgacagagatggataatgttgaacgtgtaatgatagtttgtgatccaggaatggttaatattggttatactgatatagttgaacaagtgctgagacgccgagaaaaccaaccacaaatcaaagtgtttaacgaagttgaacctaatccatcaactcatacagtctataaggggttagaaatgtttataaatttccaacctaatactattattgcactcggtggcggttcggcaatggatgcagccaaagcaatatggatgttctttgagcatccagaaacttcattttttggggcaaaacaaaagttcttagatattcgtaaacgtacttataaaattaccaaacctaaaaacgcaaaatttatatgtataccaacgacatcaggaactggttctgaagtgacaccttttgcagtaattactgatagcgagacacacgttaagtatccactagcagattatgcgttaactcccgatattgctatcgtcgatccacaattcgtattaagtgtacctaaagatgttgccgcagatacaggaatggatgttttgacacatgccattgaatcttacgtctctgtcatggcttcagattatacaagaggcttaagcttacaagcaataaagttaacttttgattatctaaaatcatcagttcaagaaaatgacaaacactcacgagaaaaaatgcataatgcttcaacaatggccggtatggcatttgccaatgcttttttaggaatttctcattctatcgcacataaaattggtggtgaatatggtattccccacggcagaacaaatgctattttattaccacatgtcattcgctataatgccaaagatccacaaaaacatgcactgtttcctaaatatgatttctttagagcagatactgactatgctgacattgcaaaatttttaggactcaaaggtaatacaactgaagaattagtggatgctctagctaatgcggtgtatgatttaggatgttcagttggtattgatatgaatttaaaatcacaaggcgtaactgaagagcttcttcactctactatagacagaatggctgaattagcatttgaagatcaatgtacaactgctaatccaaaagaaccgctaattagtgaacttaaaggcattatcgaaacagcatatgattatgaaagataa

SEQ ID NO: 3350 - DNA, 153 bp, Staphylococcus epidermidis
aatggtgctgcaccaataataagtgctggtaatgcaccagttggcccactgattgttccgagaagtatacttgtaaatggaattaacagtaaaattaatatgataaatggaattgctctaaataaattaacaatgaatgacacaatcgtgtag

SEQ ID NO: 3351 - DNA, 201 bp, Staphylococcus epidermidis
agcatagctgctcttttaaattatgttgttcagacattaaagttctcctccagacattctatccgtattctcttttttttcggattggaatccatctatgttgcttgttttatatacaacactatgattcaatgtcatgctaaaattaaagtatgtttaaagtttagaagatatcttacattaaatcaagtaaaaagataa

SEQ ID NO: 3352 - DNA, 1077 bp, Staphylococcus epidermidis
agtaattatttgaaagggttagccatgatgaaagaaaagctaaaatggatatggataacaacactaatcatacttgttgtctcacttatattggcttttaatttgaagagtcattataaccatgttcatgataaacagaagagcaagacaaatgttcaaattaataacaaaaatgtaaaattatatagagatatctcatatggtaaaggtatacccaacagcaaattagacattattaccccagctgatatgagcaatgatacgaaattaccggtaattttttggatgcatggtggaggatttatcgctggagacaaacaatataaaaatcaattattgtcaaaagttgcagaacaaggatacatcattgtcaatgtaaattatgcgttagctccgcaatataaatatccaacgccgctagtacaactcaatcaagctgtaaagtttataaaagagaataagcatgagttacctattgattttgatcaagttgttattgggggagactctgctggcgctcagttaactagtcaatatgtagctatgcaaaccaatgaagacttgagagatgaaatgcattttgaacagcagttcaagccttcacaaataaaggctgctgtattttttggtggtttttataatatgaaaaccgttaaagcaactgagtttccgagaatacaattatttatgaaaagttatactggaacaagtcattgggaaacagattttaaaaacttatctcaaatgtcaacgctcaatcaagtgactcacgaatacccaccgacatttctttcggttggtgacgctgatcctttttatagtcaaaataaagaatttgcgcaaggtttgaaaacagaaaatattccagtagatacattattctatgatggttcgcatcacttacatcatcaatatcaatttcatctagataaaccggaatcaaaagagaatatcaaaaaagtactgctatttttaagtcgaaacacatcatcttctggagtggagagtaacgagtcatcacaaaatcagccaactcaaaatactaatgaagtatccttatacccttttgattcttaa

SEQ ID NO: 3353 - DNA, 471 bp, Staphylococcus epidermidis
cagttttatgctataatgacatttattattgtaagggttaaggtgagtagtaaattgaataaaaatattaacattcaaacccgtcaagttttgaaacagaatggtgaaaagcagagatttgagtttactacaaaaggttcttggcaacaaaaatttgcagattttatacgttacgaagaacaaattgaagatgctaaagttaatgttacgattaaaattgaagatagcggtgtaaagttaattcgtaaaggcgacattaatatgaacttacatttcgtcgaaggacatgagacgacaacactctatgatgtacctaccggaaaaatacctttaactgttaaaacactaagccttatgcatttcgttactcataatggcggtaaacttaaaatacattatgagttatatcaagatgaacaaaagatgggttcttatcaatatgaaataaattataaggagataagcgaatga

SEQ ID NO: 3354 - DNA, 171 bp, Staphylococcus epidermidis
tgtgcaacagccataataacattctcgttgttcagagctgtgacttttaatgcgctaggtattgtagaggggtcagccataagtgaatggtatcgcatcacgttaaaatacgatggtagacctttaaaaataccctcattgctatgccttatcttggtaatatgtccatga

SEQ ID NO: 3355 - DNA, 378 bp, Staphylococcus epidermidis
acgttgaaagcaaaaatgactttctattgttttattcccacatcaaagtatttaaaaacttatttatcattaatagcttttataccaggtaattctttaccttctaagtattctaatgatgctcctccaccagtagagatgtgtgtaaagtcatcttcgaaacctaatgaaattgctgctgcggcagagtcaccaccaccaataatagtagtagcgtcttccaatttagcaatagactcacatacaccgattgtacctttagcaaaattactaaattcgaatacacccataggtccattccatactacagtatgtgcaccttgtaattctttattaaataattctactgttttaggtccaatatccattgcttcttga

SEQ ID NO: 3356 - DNA, 123 bp, Staphylococcus epidermidis
aaagtgtatttgttttataacgattactatatttcaaatgttaattctattatatttgtagtaaaaaatctttttgaaataaaaaaacgccaatgcagttactttaataatgacgaaaattaa

SEQ ID NO: 3357 - DNA, 2001 bp, Staphylococcus epidermidis
gaggcgtattttggaatggtagaacatgttccatttaagttaaagtctgaatttgagccacaaggtgatcagccacaagcgatacaaaaaattgtggatggcgtaaatgaagggaaacgtcatcaaaccttattaggtgcaactgggacaggtaaaacttttactatgagtaacgtaattaaagaggttggtaaacctacacttattattgcacataacaagacattagcaggtcaactatatagtgaatttaaagaatttttcccagaaaatagagttgaatatttcgttagttattacgactactatcaacctgaagcatacgtgccttcaacagatacctttattgaaaaagacgcctccattaacgatgaaattgaccaactacgacattctgctacaagttctttatttgaacgtgatgatgtcattattatcgcaagtgttagttgtatctatggtttaggtaatccggaagaatataaaaatttggttgttagtgtacgtgttggtatggagatggaacgaagcgaattgttgagaaagttagttgatgtacaatactcacgtaatgacatagattttcaacgtggtacatttagagtgcgtggagatgttgttgaaatattcccagcttctagagaagaaatgtgtattcgcgtagaattttttggagatgaaattgatcgtatcagagaggttaactatttaactggtgaagtaattcgagaacgtgaacattttacaattttcccagcttcgcacttcgttactcgtgaagagaaaatgaaagtagctattgaacgtatagaaaaagaattagaagagagactaaaagaattacgtgatgagaataaattattagaagctcaaaggttagaacaacgtactaactatgatttagaaatgatgagagaaatgggcttttgttcaggtattgaaaattattctgttcacttaactttaagaccattaggttcaacaccatatacattgcttgattattttggagatgattggcttgtcatgattgatgagtctcacgttacgttacctcaaattcgtggtatgtacaatggggatagagctcgtaaacaagtattaatagaccatggatttcgtttgccaagtgcgttggataaccgaccattaaaatttgaagaatttgaagaaaaaacaaaacaacttgtttatgtttcagctacaccaggcccatatgagttagaacatacagatgaaatggttgaacaaattatacgacctactggtttacttgatcctaaaattgatgtgcgtccaactgagaatcaaatcgatgatcttttaagtgaaatccaagatcgcgttgacaaagatgaacgtgtacttgtgacaacacttactaaaaaaatgagtgaagatttaactacatatatgaaagaagcggggattaaagttaattatttacactcagaaattaaaacattagaacgaatagaaattattcgagacttacgtatgggtacttacgacgcaatagttgggatcaatctgctgagagagggtatagatatacctgaagtatctttagttgtaattttagatgcagataaggaaggcttcttacgttctgatagatctcttattcaaactattgggcgagcagcacgtaatgacaaaggagaagtcattatgtatgcggataaaattacagattctatgcaatatgcaatagatgaaacacaaagacgtagagaaatacaaattgctcataacaaagaacatggcatcacgccgaaaacaattaacaaaaagattcacgacgtcattagtgctactgtggagagcgatgagacaaatcaacaacaacaaactgaattacctaagaaaatgacaaagaaagaacgtcaaaaaacaatagaaaatatagaaaaagaaatgaaaaaagcagccaaagatttagatttcgaaaaagcaacagagttaagagatatgttatttgaattaaaagcagaagggtga

SEQ ID NO: 3358 - DNA, 447 bp, Staphylococcus epidermidis
gggggcagagcattggcaagtattagagaagatgtccaatttagtaatccaaccatatcggaaagtagttttaaaataaatgaaaactttgactcagaaaatttcgaaggatttggtgatattaagttgaatctgaaaaaatattattatgaagaaaataatgagattgataataataataataataatggttcagcacttttaagtttagaaataataataggcgatattgcctggcagtatccttttatgtttaaagtagaaatcgaatctttttttgaatgggaaaatttcaaaggaactgatatagataaatttttagaaattaatggagctgctattttgtattcatacagccgtgcacatataagtcatattactaatacaagcaaatacccttcatttgatttacctttttataatttcacagacaatgattatcaatag

SEQ ID NO: 3359 - DNA, 1380 bp, Staphylococcus epidermidis
aatctaatggctataggtgtcatattaaatagagtttttaggctaaataataatccattatttgattatatatatagtaataaagaatctataaatcattgttattttattattccaactgaagagtttgaagaagaagcaaaaaagaaagcacaatactattatgggtccatacagaagtttatgtatgaactacaacgatatgatatagaaccctttttgatgtcttatgataaattaatagacttttgtaaaaaacaagctatagacaaagttgttgttgcaggtgatattatgagttatcatcacgaagaatatgacattttacatcaaaggaaacgatttaaacaagctaatattcaagtaatatcattaagagcaaatcattattttaacccccgcaaaacacataataaacaaggggaaccatataaagtatttaccagtttttatagaaaatggcgtccttacttaatgattagagatgaatatgactatcatttagaagatatttcaaaggttgtagtgaaatctcaacataaaattaaagaagattatcattcatatggtataagtgaacgtgatgttcaaaatcgttggtctgaatttttatctcaagatatcgaaaattataaagaaaacagggaatacttgcctgaagtattaacaagccaactaagtatttacttagcttatggaatgatagatattatacaagttttcaacgatttacttcaaaattatgataaaaatgaacaaaattacgaaacttttatacgtgaattgatttttagagagttttattatgtattaatgaccaattatcccgaaacagctcatgttgcttttaaagaaaaataccaacaattgaaatggtcttataatgaagagaattttaaactgtggaaagatgggaatactggttttccaattattgatgcagcaatggaggaacttaaaacaactggatttatgcataatcgcatgagaatggtagtttctcaatttttaactaaagatttgtttattgactggatttggggtgagtcatttttcaaacaaaaattaatagattatgatgcagcttcaaatgttcacggatggcagtggtcagcttctactggaacagatgctgtaccatactttagaatgtttaatcctataagacaaagcgagcgttttgataataatgcacgatatataaaaacttacattccaagattaaatcaggtagatgctaagtatttacacgatactcataaattcgagcaacaaataaaggggcaaggtgttgaaataggtaaagactatcctaaacaaatgattgatcacaaagaaagtagacaacgtgtaatgtcagaattcaaagcattagattaa

SEQ ID NO: 3360 - DNA, 477 bp, Staphylococcus epidermidis
gtaatagtggctaagaaaaaatcaaaatcaccaggtacgttagctgaaaatcgtaaagcaagacatgactacaatattgaagatacaattgaagcgggtattgctttaagaggtactgaaattaaatctatacgtcgtggtagtgccaatttaaaagatagctttgcgcaagtgagacgaggcgaaatgtacctgaataatatgcatattgcaccatatgaagaagggaaccgttttaatcatgaccctttacgtacacgtaaattactcttgcacaaaaaagaaattcaaaaattaggtgagcgtacacgagaaataggttattctattattccgttgaagttatatttaaaacatggtcaatgtaaagttttattaggcgttgctagaggtaaaaagaaatacgacaaacgtcaagcacttaaagaaaaagcggtaaaacgagatattgatcgtgcagttaaagcccgttattaa

SEQ ID NO: 3361 - DNA, 168 bp, Staphylococcus epidermidis
aaaagggaggcaatcaattcggatgaattttattgcactcccttaatgtttaagttttactttcttcaaatttattttacgacaaaacgtgactcatctaatttatttctaaattccttttgttctgctttagattttttcttaaaagttttaagaaacgcctcataa

SEQ ID NO: 3362 - DNA, 798 bp, Staphylococcus epidermidis
tttatgcattttaaacgtgttgtaaagtggggattgaatatgtatcaaaaccaaagaataaaagataaaattaacatattaggtgtaagttttgataatactacaatgctggaaatggtagaaaatattaaacaattcatatctagcaatacagatgataatttatttatagtgactgctaatcctgaaatcgtggattatgcaactgaacatgagctatatagaaatttaattaatcaagctgattatgtagttccagatggtacaggaatagtaaaagcttcaaagcgattaaaacagcccttaaaacggcgtgtgccaggaatagaacttcttgaagaatgtctgaaaatagcacatgtcagccatcagcgcgtatatctgcttggatctaaaaatgaaattgttgagtcagcagagaaaaaacttcaatctcaataccctaatatccactttgcacatcatcatggctatattcatctagaagatgaaacagtcataaaacgtataacaagttttaatcccgattacatttttgtaggaatgggatttccaaagcaagaacaatggattcaaaagcataaggacaagtttaagcacactgtgatgatgggcgtaggtgggtcgtttgaagtattcagtggctcaaagaaaagagcacctcaaatatttagaaagttaaatattgagtgggtatatcgtgtgcttattgattggaaacgcattgggagaatgataagtattcctaaatttatgttaaaggtagcaatacaaaaatataaaatgaaatcaaaataa

SEQ ID NO: 3363 - DNA, 327 bp, Staphylococcus epidermidis
ggatttaattttggaggtgacacgatgattgaaatgttcactcaaatatttattataagtgcattagtgatttttggtatggcactacttgtttgtctagtcagattaattaaaggtcccactactgctgatagagttgtatcatttgatgcctcgagtgctgttgttatgtctattgttggtgtgatgagcgttatttttaactcagtgtcttatttagattcaatcatgttaattgcaattatttcgtttgtcagttcggtctcaatttcaagattcatcggggaaggacgtgtcttcaatggaaatcataaaagacatcgttag

SEQ ID NO: 3364 - DNA, 612 bp, Staphylococcus epidermidis
cgcgttaattttatattaaaatataggcaaaataagcattttcgattaaatggagtgtttaagatggttatttatattgaaactgaacgtttaaacttaagagattgggaaaccaaagatttattaccttttcaaaaaatgaatgctaatgcgcaagtacgtagatacttccctagtttacttagttatcgtcgttctgagatagacatggaaaatatggatagcataatacaagagagtggcctaggtttatttgctgtagagttgaaagagacgggagaatggttagggtttataggtgtgaattacgtttcaaaagatagccattacccttttaaagagttaccgttttatgaaataggttggaggctaattccagaagtatggggaaatggtctagctacagaaggggcagaagccgtaatgaaatatgctagagataaaggaattaaagaattatatagttttacttctgaaaataatttgccttctagaaaagtcatggaaaaattaggaatgacttttttagacaattttgaatatccgaatcttagtaaataccatccccttaaacgtcatgtaagatattataaagagctacttccttcttga

SEQ ID NO: 3365 - DNA, 132 bp, Staphylococcus epidermidis
aaagataatttatcatgtagtgcaaatttaagttttaaccactatatattgtggttatttatatattttaaaggctatttacagattgaaaaaattttacgtaaaagtaactattttcaactgtttttataa

SEQ ID NO: 3366 - DNA, 126 bp, Staphylococcus epidermidis
atcgctttttatcattgtgttatttatcattttaaagataattacgatatgaattttagtttacaatatatttatctgatttttactttttatatttttacaaagtatttaaagtggaatttttag

SEQ ID NO: 3367 - DNA, 150 bp, Staphylococcus epidermidis
aaaatattttatttgagacatacacatcattgtcgtttttatggtgaaaataaaaaaattagtaatactttattatatgtgaatcaatttaatgttatagttatttttaaacctctaacaactgtaatttcatcacaagaacaaaaataa

SEQ ID NO: 3368 - DNA, 771 bp, Staphylococcus epidermidis
gccactctttattggctaaggtatcacttaaagaaatcatcgcttattttagagaccgtaataaccgaggtgaagataagcatgacccacttactaatcgtggatgatgaaaaagatattgtagacatttgtcaaacgtatttcgaatatgaaggatatcaggttacgacaacaacatgtggtaaagaagcactaaaattattatcttcagatatagatattatgattttagacattatgatgccggaagttagcggatacgatattgtcaaaaaaatgaaagatatgcaacttgatatacctttcatatatctaacagcaaaaactcaagaacatgacacgatatacgcactgacgttaggtgctgatgactatattaaaaaaccctttagcccaagagaactagtattacgtactaataaccttctcgctagaatgagtaaatcaaatcattctaataaaattgagcaattagaatttgatggtttagttttaaaaaatttaagcaagacacttaccattaacaatatagagatacctatgcgcattaaagaatttgaattgctatggtatcttgcttctagagaaggtgaagttatttctaaatccgaacttctagaaaaagtatggggatatgactattacgaagatgctaacactgtcaatgtccacatacatagaattcgcgagaaattagaaaaacatgattttttaccctacactattacaactgtgtggggccttggttataagtttgaaaggagccgataa

SEQ ID NO: 3369 - DNA, 165 bp, Staphylococcus epidermidis
tatagaaatttaaaatcaaagtttaaatataaatcgtcaaatcacactagcatatttgtaagcatactgtctattaaatactcatttaattggttaattcaaaatttaagcaaacaaaataagctgagacacttattaagaatacgaactccaaagcttgattaa

SEQ ID NO: 3370 - DNA, 207 bp, Staphylococcus epidermidis
aaagaggtttatatgttatacgtaattataggcttttttataataggaatcggactatatatttttagtttctttttagcacaaaatcaaggattatcttataaaagtcattgcagaaatttttctgcagtttttatatcactcggtgtattatgcttaatgggatatctcgttcattatgtatctaaacactatttaggcatatag

SEQ ID NO: 3371 - DNA, 183 bp, Staphylococcus epidermidis
ctgttgtattactccaagaaggttaaaagtaatggactttcaggtgctattagtggtggcgctgaacaattgtttggtaaacaaaaacaacgtggcgtcgatttattcttgcatagattaacaataattttagctattttattctttgtacttatgttttgtattagttacttaggtatgtag

SEQ ID NO: 3372 - DNA, 183 bp, Staphylococcus epidermidis
aaaactcattacattgaactttactttattacaatttatctaataaatattaagaaaagtaacgaaatatgtcttataaatagcgatatatcaactttctttaataaatgttcagaacaatacattattttaacaatgttacaagataataacaaagcccacaaagtcaaatatttttgttag

SEQ ID NO: 3373 - DNA, 132 bp, Staphylococcus epidermidis
attatgaatttaatagtggacgtccttctgttaatgaagaacaagaagatgacgaacgtgattaatatttcaaaagataagttgtgggatagaacaccaagtgagttctatcccactttttgttttatataa

SEQ ID NO: 3374 - DNA, 144 bp, Staphylococcus epidermidis
aataagcattacttttggtttgtatattgttttatttcaaaaaataaagtaaatcaatttaataaattgaaaaatagaaggctatctttaattttaaaatatatgattctacataaatgttactataagaagaatcactcataa

SEQ ID NO: 3375 - DNA, 348 bp, Staphylococcus epidermidis
atcatgaatttaatattactccttgtgataggatttttagtgtttattggaacttatatgattttatctattaatttaattcgtattgttattggtatttctatttatacacacgccggtaatttaattattatgagtatggggaaatatggacctcatatgtctgaaccgctaattcaaggtcatgctcaaaactttgttgatcctttattacaagctatcgttttaacagctattgtgattggatttggtatgactgcgtttttattggtgttaatatatagaacttacagagtaactaaagaggatgaaataagtgcattgaaaggtgatgaagatgatgagtaa

SEQ ID NO: 3376 - DNA, 144 bp, Staphylococcus epidermidis
ttgaaaaattatagcctcatggattctatcttatataaaataaagttctattcccttttggatataaataagaatagttacctttttgtgatatgccaattcagaaaaaaagcgacagtgcttgaatctatgtatgctcaataa

SEQ ID NO: 3377 - DNA, 249 bp, Staphylococcus epidermidis
tggatttgttacaaatatttagtgcaaaagcacgtggaggtattctatatgaataacggtacagttaaatggtttaatgcagaaaaaggatttggtttcatcgaaagagaaaatggcggagatgtattcgtgcatttctcagcaatcgttgaagatggatataaatctttagaagaaggccaaagcgttgaattcgatatcgtcgaaggtgaacgtggtgagcaagctgcaaacgttgttaagatgtaa

SEQ ID NO: 3378 - DNA, 435 bp, Staphylococcus epidermidis
cattattgttacaaaaggtcctgttttaaatggttttttggtcactgtagtttggcaattgatcatgacactgtacttcaaattgaaggtccaggggataaaccaatgacggaagattttgaatcttatcgtgacagatatggaaaaggtaaaaatgaatggataaaagtctatcgatgttcacaccctaacgctggaacaaaagcagctcaatgggcaaagaaacattatgagaatagcgatagcgaatatcttgttacattcaacttaaaaagtgaaacatttacatattgcactaaaattatatatcaagcatataaatacggcgtagataaaaattccgtaagtgatcacggtttatatattatttcaccctatgcgctaacagataattttacagatgaatataaattaaaattagtaaaaacatattaa

SEQ ID NO: 3379 - DNA, 144 bp, Staphylococcus epidermidis
attcaaagttattttgttttcgaaatcattttacacttaagaatattttttgattactttagaactagaaacccaattactttagttcaatactataatttagttaacaaatacataggaggtgagtcacatgttcatcattaa

SEQ ID NO: 3380 - DNA, 135 bp, Staphylococcus epidermidis
aattgtggttatgtaaattttgtgatattttcaagtagggacaaaactggatgttggcgaacatcaataaatgattactatatattaaatttacacaatttttacaatataagaattgctagttactttttataa

SEQ ID NO: 3381 - DNA, 129 bp, Staphylococcus epidermidis
ccacaattctatttacaaattcttaacaaactagatattaaatttttacataagtgtctcataatcttattaaaaatgatgagcgataaaatcatggaaacacttttatccactccaactttaaaataa

SEQ ID NO: 3382 - DNA, 144 bp, Staphylococcus epidermidis
atacaagttctttttcatcttagtcatcgactaccaatatataacaaaatcctgagacaaaatttagtgtctcaggattttgttatatattatttaattaaaaaatttcatttcgtttccattcatttctattactttttttaa

SEQ ID NO: 3383 - DNA, 126 bp, Staphylococcus epidermidis
agtaaagttcttatgtgggacattaaaaataaatttgcgataaatttcaaaattattggtatgcttactatattagaaaaaaaggggggttcctatgaaaaaacaattattcattctttattttaa

SEQ ID NO: 3384 - DNA, 153 bp, Staphylococcus epidermidis
caacctaactacaatccaaataacaaatatttgaacatgtcaaatcaagaatggagaaataaaacaaggaatagactatcatctagtgagatgcaaattcgtgacgaaattctcaatgataattatgaagagataacgcacagaaagttctag

SEQ ID NO: 3385 - DNA, 219 bp, Staphylococcus epidermidis
gtcatgttatattctttacacataaagcacctcgttaaattagtttattggtatttattaaattatacgaaagggccatattttttaaagtattttaatataaaattacatataagcacaaagtattttggcgagactcttgagagaacaggacaagctgaagactacaggctgaagctgtccgataagaaagcgagccaacaatacgaagtattgtaa

SEQ ID NO: 3386 - DNA, 123 bp, Staphylococcus epidermidis
tttacaatatatttatctgatttttactttttatatttttacaaagtatttaaagtggaatttttagaagacttaactctttgttttaataaatgtaatgaattattatggcttatcgtttga

SEQ ID NO: 3387 - DNA, 210 bp, Staphylococcus epidermidis
gactatcaatatgtcattctatgtattttgttaatgatgaacaatgatgaacaacaaaaaaatgaaagcgtttgttttacgtactatatttctgtgcaaaccccaaaagttcttttaatcttacaaaagttattataccacgtgaaaaatagggttaaaatgacatttttacaaaacttatataaaaaaccacgcccttccactcattaa

SEQ ID NO: 3388 - DNA, 144 bp, Staphylococcus epidermidis
tatccacaatatccaattaatacgagattttataaaaaaccaaaaccatcgaaaattattcatgagctaagtatcctttaccaactttggtttcaattgcactatccatgtcaatttctgataatttttttcttaatctattaa

SEQ ID NO: 3389 - DNA, 558 bp, Staphylococcus epidermidis
acggagggatataaaatgaaattgaaactattaggaacattagcactctcgtcaataatattaacagcatgtggacaagaaaatgtaaaaaaaacagaaagcaatccaaaagaagaacaaaataaaacggataatatgcaaactaatgggagcgtaacaaattctaatagtaatcaaaaacaaaaaacagctcaaaaacaaatttccgctcaagaagcagaacaaattgtctcgaactattacattaataaagggattaataagcaacaagttcttgaatttaaaacaaatatagatagaagcaatgctaatgaatattatgttgaacaccttgtaagagatgcagccggaactcctataaaattttgtgctgtagtaaacaaaagtacaggtgaagtgatcaatcgatttaatgacatgaatgaggaagaaatgaaggaatttgaggaatttaaaaaaagaagtcctaagtaccataattctggtgaagaaaaaaataaaatgcaagaaaattcttcatcttccgaacaacaagaagtccacaattctgttatataa

SEQ ID NO: 3390 - DNA, 123 bp, Staphylococcus epidermidis
attgacttgtatattatagactataatattgccgaagttgaattaagaattcttatcagtttattgaataaggtaataatgattaatagaatcagggttactaatacacatatgtattcttag

SEQ ID NO: 3391 - DNA, 159 bp, Staphylococcus epidermidis
aattttatgtatcacataaattatagatactcgataagcgaggcacttatgcctctatttttaatagtttttaaaaattattacttaattgagttgttcttcaccttggcgttgtttctctttagctgcttcattcacttgctcatcagcatgatatga

SEQ ID NO: 3392 - DNA, 147 bp, Staphylococcus epidermidis
agcggtgcgtattaccttgcacaatgcattagcattagtaggtgttacagcaccagaatctatgtaaaacttcataaaatagatacacgagagcctgtgacatatttatatgtacaggctcttacattatttagtccttattattga

SEQ ID NO: 3393 - DNA, 219 bp, Staphylococcus epidermidis
gtgttcaagtatagttttaaagaaggtaatataatgaaaatgaatccaagatatgttaaagtgttttttctatatttagtaagcacatttatttctaatcgcttaacaacgaataaatctttatgcaaaacattaatgcaaggcattttaggttatggtttatttgcattaggattaaagtatttaactattaagaaaaaacaacatcaagcgcaatag

SEQ ID NO: 3394 - DNA, 2169 bp, Staphylococcus epidermidis
agtttgaagtacaagggacaaataaagacattattgaatttaaggataaggtgggcaatttcaatgaaaaccatggaagaaaagaaatacaatcatattgaattaaataatgaagtgaccaagagaaaagacaatggtttctttgatttagagaaagatcaagaagcattgaaagtgtatcttgaagaaatccatgataaaatgatttcttttgatgatgaaatcgaaagacttcattatcttgttgataataatttttattttaatgttttcgaaaaatatagcgaagcagaattaattgaaattactgaatacgcaaaatcaattcacttccaatttgctagttatatgtcggcaagtaagttttataaggattacgctttaaaaacgaatgataaaactaagtttcttgaggattataatcagcacgtcgcaatcgttgcactttatttagcgaatggtaatgttaaacaagcaaaacaatttatttctgcaatggtggaacaacgttatcaaccggcgacaccaacattcttgaatgcaggtagagcaagacgtggagaacttgtttcatgtttcttattagaagtagacgatagcttaaattctatcaatttcattgattcaactgcaaaacaacttagtaaaattggtggtggtgtggccattaatttatcgaaacttcgtgcacgtggagaagcaattaaaggaattaaaggtgtagctaaaggtgttttacctgttgctaaggcacttgaaggtggatttagttatgcagatcaattaggacaacgtcctggcgctggggcagtgtacttaaatattttccattacgatgttgaagagtttttagatactaagaaagtgaatgcagatgaagatttacgtttatctactatttcgactggtcttattgtaccttctaaattctttgatttggctaaagagggtaaagatttctatatgtttgcacctcatacagttaaacaagaatacggtgtgactttagatgatattgatttagaaaagtattacgacgatatggttgcaaaccctaatatcgataaaaagaaaaaagacgcacgtgaaatgttaaatatgattgcacaaacacaattacagtctggttatccatatcttatgtttaaagataatgcaaacaaagtacatgcgaattcaaatattgggcaaattaaagtgagtaatttatgtactgaaattttccaattacaagagacatcagtaattaacgactatggaattgaagatgaaattaaaagagatatttcatgtaacttaggctcattgaatatagtgaatgttatggaatcaggtaaattcagagattctgtgttcacaggtatggatgctcttacagttgtaagtgatgaagcaaatattcaaaatgcaccaggtgtaaaaaaagcgaatagtgaactacattctgttggactaggagtaatgaacttacatggttatctagctaaaaataaaattggctatgaatctgaagaagcaaaagactttgctaatatattctttatgattatgaactattattccatcgaacgttcaatggaaattgcaaaagagcgtggagaaaagtatcaagactttgagcaatcagactatgcaaatggtaaatattttgaattctatacatctcaagaatttgaaccaaaatttgaaaaggttcgccaactttttgatggtatcgatatacctacttcaaatgattggaaagaattgcaaaataaagtagaacaatatggactttatcacgcttatagattagctattgctccgactcaaagtatttcttatgttcaaaatgcgacaagttctgttatgcctattgttgaccaaattgaacgtcgtacgtatggaaatgcggaaacattttatccaatgccatttttatcaccagaaacaatgtggtactacaaatcagcatttaatactgaccaaatgaaacttattgacttagtagctacaattcaaactcacgtagaccaaggtatttcaacgatactttatgttaattcagaaatttcaacacgtgaactttcaagattatatgtatatgcacaccataaaggccttaaatctttatactatacacgtaataaattattaagtgtggaagaatgtacaagttgtgcgatttaa

SEQ ID NO: 3395 - DNA, 648 bp, Staphylococcus epidermidis
atgttagatttcattaaccatttgcttagttatcaatttttaaatcgtgcattaatcacatctattttagttgggattgtatgtggaacgatgggtagcattattgttttacgtggtctttctttaatgggtgatgccatgagtcatgctgttttaccaggtgttgctttatctttcttatttaatattccaatgtttatcggggcacttgtaacgggaatgcttgcaagtttgtttattggttttattacttcaaacagtaaaacaaaaccagatgctgcaataggaataagtttcactgcattcctagcatctggcgtcataattattagtttaatcaatagtacaacagatttatatcacattttatttggcaatttattagcaattacacatcaatcattttggacaacaattgtcattactgtactggttattttacttattattatcttttatagacctttaatgatttcaacatttgatgcaacttttagtcgtatgagcgggctgaacacaacattaattcactactttgtcatgttattactccgcacttgtaactgttgcgagcatacaaacagttggaattatccttgtagttgctttactaatcactccagcttctacagcttttttaatcagtaa

SEQ ID NO: 3396 - DNA, 1032 bp, Staphylococcus epidermidis
attatagatttacattggttcaaaactctttattttatacataaatatgacaggaggattttaatgaaggcggtaaattggaacacccaagaagatatgactaatatgttctggcgtcaaaatatctcacaaatgtgggtggaaacagaatttaaagtatcaaaagatatagcaagttggaaaacattaacagattctgagaaaaatacttttaaaaaagcgcttgcaggtttaacaggtttagatacacatcaagctgatgatggtatgccattaatcatgcttcatactactgatttaagaaagaaagctgtttattcatttatggctatgatggaacaaatccatgcgaaaagttattctcatatcttcactacattattaccatctagtgaaaccaactatttattggatacttgggttattgaagagccacatttaaaatataaatcagataaaattgtagaaaattaccacaaactttggggtaaagaagcatcgatttacgatcaatatattgctcgtgtttctagtgtattcttagaaacatttctattctattctggcttctattatccattatatctcgcaggacaaggaaaaatgactacgtcaggtgaaattatacgtaagatacttttagatgaatctatacatggagtgttcacaggtttagatgcacaaagtctacgtaatgagttatctgaaagtgagaaacaaaaagctgatcaagaaatgtacaaattattaaatgaactttatgataatgaagtttcatatacacatttattatatgatgatattggtcttgctgaagatgtattaaattatgttcgatataatggaaataaagcattatcgaatttaggttttgaaccatatttcgaagagagagagtttaaccctattattgaaaatgcactagatacatctacaaagaaccacgatttcttctctgttaaaggtgatggctatacattggctttaaatgttgagcctctacgtgatgaagactttgtttttgataattaa

SEQ ID NO: 3397 - DNA, 126 bp, Staphylococcus epidermidis
ttaatatttcaaaagataagttgtgggatagaacaccaagtgagttctatcccactttttgttttatataaggatactcatcatttaaggaataataaattgctttatattaaaataacacaatga

SEQ ID NO: 3398 - DNA, 132 bp, Staphylococcus epidermidis
tcattgcttcacacttttatgattaaaaatgtttattttaatcgtgagaagtttaaggttaaaaaatacatgaacaagtatatatgttcatccgagttgactaagttaaagatgcacgcttatattaaataa

SEQ ID NO: 3399 - DNA, 681 bp, Staphylococcus epidermidis
caattgattcagtacccgaaaatgaagttcaggaatttcacgataaaactaaaattttggagcggttataatatgcatttatttgaaacaatgaaattggataagggattcattcctcgtcttgactaccattatcaacgtatttcaacttctagtgagcatctaggatttcaatttgatcatctattttggaagcagtttattcataatataaaaaccttgcattcaaaaggcgtatttcgtttgaaggtgacgttaaacaaagaaggtgaattaaactatgagttatttccgatacccgataaacctttttttaccgctcgactagttcaacaaaaaaagaatattgataaagtaatcataactaataaaacaacagaacgtgattatttaacacataatcatttcacagacttaatactgatctatgatgaagatggtaaaattttagagtttgacattggcaacgtgatgatacaagaaagagataaattgtatacaccaacatataaaggagacatgctccccggctgtatgagacaatctcttatagatcaaggcaaagttatagaaaaagatttttatatcgaagaatttaaagaaaaaatcaaatcgagtcaaatcaacgtctatttaatcaatagcttaagagaggttgtcggtgttaaagtatatgtataa

SEQ ID NO: 3400 - DNA, 1137 bp, Staphylococcus epidermidis
caaatagttcagagaaaaggatgtcatttaatgaaaatcagagtcatcgtcccttgctataatgaaggcgaagtcgttttgaaaacttatgacaaattaactgaaataatgaagaaagatagtttaatcaaaaattatgaatacgatttactctttattaacgatggtagtacagatacgacaatacatcatatcaagaatattgttgcgtatgataaccatgttaaatatctttcattcagtcgaaactttggcaaagaagctgcaatgattgctggctatcagcatagcacaatgcacgacgcggtgattatgattgatggagatttacaacatccgcctgaatatattccacaaatgatagagggttacattgaaggttatgatcaagtggttgctaagagaaatcgtcagggagagaattttgtacgtaaaactttgtctcgttgttattataaattaattaatgcatttgtagaggatatccaatttgaagacggcgttggtgattttagattactcagtcgacgtgcagttcaagctttaacaacacttgatgaatataatcgtttctctaagggtctatttgaatggataggttatgaaacaaaagtatttaaatatgaaaatgtgacgcgtgaagatggagaatctaagtggacttttagaaagttactcaactatggtattgatggactcatctcttttaacaataagcctttacgcatgatgatatacttaggtatgttcacgttttctatcagtattttatatataatttatttattaataaatattttgattaatggtataaatatacctggttattttactacgattgctgctatattattgttgggtggtattcaattaatgtctattggcgtagtaggagaatatattggtcgtatttattatgaagttaaacatagaccgaagtatattgttgaaaactctaatattcagactgagaatctcgacatgagatataatgctttaaacctgaataaaaatagaaacaacaagcgtagtaatgatttatataaattaagttctttttataaagttaaaacatatagtgatacgtatgcatcaaattattctcaagatgaaggttttaaagagcgtgtacattaa

SEQ ID NO: 3401 - DNA, 150 bp, Staphylococcus epidermidis
tggaaagctcactttctcaatagccaatctttagacaaaaaagaaaatatcccaagaagttcaaataatgtgatattatgcactttaacctttaaaattttcatgaaaggagattattatgaaaaaattcaaatggataaatatatttaa

SEQ ID NO: 3402 - DNA, 126 bp, Staphylococcus epidermidis
tataaatgtcacctatcacttcaatcagatttacaattattcaacatcaatcgtaatgtttgtttcatacaacatcacaagctttcaaaagctctttatatcagtgtttataaccatatatcttaa

SEQ ID NO: 3403 - DNA, 123 bp, Staphylococcus epidermidis
aactatagtcataacggcagaattataaatagtattagtgaaggtatttctacaacgttatcaactttcatcacaaaaagacataaagataaaactgggataataaaatttagtatccattag

SEQ ID NO: 3404 - DNA, 225 bp, Staphylococcus epidermidis
aatggattccactgtaaaagtgttgaagatattacagaaacacaagctattgcaaataatgaagttaaaggtaaagatttgattaagcatatcaaaattactttgggtgacttcaaagattttcaagttaaacatgattttgatgatgcgaacttattgaatatgattgcacctgtagctacaatggcttcaaaagtgaaagatatgccgagtgattgctactaa

SEQ ID NO: 3405 - DNA, 261 bp, Staphylococcus epidermidis
gcagtactccatttaacacctttcgcacgatttgaagcacctacacctagaatagatgaagacacaacgtgtgtagtagataatgggaaatgtaatgatgacgctacgaaaatcgttaatgctgaagaaatatcagcggctgcaccgttagcaggtctaattttcataatatttccgccaacagttttgatgattttccaaccacctactgctgtacctaatcccatagctgttgcacacgcaactttaacccatacttga

SEQ ID NO: 3406 - DNA, 123 bp, Staphylococcus epidermidis
attcagtcccaccctttttatgtttatataatccaaaaaattagtaatgaaagtaagaatgaaataagtgaaatagttaaacagcctaatatacagccgcatcctgaatgtgtgcaaccataa

SEQ ID NO: 3407 - DNA, 1128 bp, Staphylococcus epidermidis
caaattttacatagcgtgaggtacaacttattcaatgaaggtgaactgatgtatacactattacttatagcttttactatgatagtcagtttaataattacacccattattattgtaatatcaaaaaaattagatttagtagatcgtcctaatttcagaaaagtacatacgaaacctatctcagtgatgggaggaacggtcattttattttctttcttaatagggatttggctcggacaccctattgaacgtgaggttaaaccgcttatattaggtgcaattacaatgtatatggttggattgattgatgatatttacgatctaagaccttatttaaagttagcaggtcaaattgttgcagctttaattgttacgttttatggaattacaatagactttatttcattgccaattggtccaacgattcattttggcatattcagcattcctattacagtaatatggattgtagcaattaccaatgctattaatcttatcgacggacttgatggacttgcctcaggcgtctcagcattggcattaatgactattggattcatcgctattttacaagcgaacatatttattatcatgatttgctgtgtacttttagggtctttacttggtttcttattctataactttcacccagcgaaaattttcctaggtgatagtggtgcattaatgataggatttattatcggtttcttatccttactcggctttaagaatatcacatttattgcattattctttcctatagttatattagcggtgccatttattgatacattatttgcaatgattcgtcgaatgaaaaaagggcaacatataatgcaagcggacaagtcacatttacatcataaattacttgctttaggatatacgcatagacaaaccgttttacttatttattcaatagcgattatgtttagtttatctagtgttatcctctatttatcccaaccgttgggtgcacttatgatgttcattctcattgtctttacgattgagttgatcgttgaatttactggattaatagatgataattatcgaccaatattaaatttaattacaaaaaaaggaaatggtaagcaacatcattatgatgagcatcaccgttcataa

SEQ ID NO: 3408 - DNA, 852 bp, Staphylococcus epidermidis
ggagtaacacacatgaatataacattaggatatatcgatcctgttgcctttagcttgggaccaatccaagttcgatggtatggaattattattgcttgtggtatcttacttggatacttcattgcacaagcagcattgaaacaggttggattacataaagacaccttaatcgatattatattttatagcgcgattgttggattcatagttgcgagaatatactttgttacatttcaatggccatattacatgaatcacttgagtgagataccaaaaatttggcatggtggtattgccatacatggtggcttaattggtggacttatctctgggattattgtttgtaaaatcaaaaatctacatccgtttcaaataggagatattgtggcaccaagtattattttagctcaagggataggacgctggggaaactttatgaatcatgaagcgcatggaggtccagtatctagagcttttctagaacatttacatttgccagactttattattagaaatatgtatattgaaggccaatattaccacccgacgtttctatatgagtctatttgggatgtaataggttttgtcattttaattactttaaggaaacgtctaaaacttggagagacattctttggttatcttatttggtattctgtagggcgctttttcgttgaggcgatgagaaccgatagtttgatgcttacgagtcatatacgtgtcgcgcaacttgtttctgtcgtgcttattatgattagtgtgatattcgtaatttatagaagagttaaataccaaccaataaaatatgaaaattcaggaccattaacatggccgattaaaaaggctaagtga

SEQ ID NO: 3409 - DNA, 1056 bp, Staphylococcus epidermidis
ggagttgcacatatgaaaaaaacagtcttatttttattattgtctctagttttagttttaacggcttgtagtaatagttcgaataataattcaacttcgaaaaagaaaaatagtgattctaaagaaactgtaaccatcaaaaatagttttgaagcaagtggtaaagaaaataatggcagtgataagaaaaaaatctctaatactgtcgaagtaccaaagaatcctaaaaatgccgttgtattagattatggagcgcttgatgtgttgaaagaattaggtgtggctgataaagtaaaaggtttacctaaaggtgaaaataaccaatctttacctaaatttttagatgaatttaaagatgataagtatattaatactggaaatttaaaagaagtgaactttgataaagttgcatcagctaaaccagatgtgatttttatttcaggaagaacagctaatcagaaaaatttagatgaatttaaaaaagctgcaccaaaagctaaagttgtatatgtaggtacaagtgatgacaacttaattaaagatatgaaaaaaaatacagaaaatttagggaaaatctacgataaagaagataaagctaaaaaaattaataaagatttagatagaaaaatatctgatatgaaagataaaactaaagactttaataagaaagtaatgtatttattggttaacgaaggtgaactatcaacgtttggaccaggaggaagatttggtggtttagtgtttgatacattaggatttaaacctgcagacaaaaaggttagcaaaagcccgcatggtcaaaatataaataatgaatatattaacaagcagaatccagatgttattttagctatggatcgtggttcagttgtaggtggtaaagcaacaacaaatcaagttttaaaaaacaaagttataaaaaatgtaaaagcagtaaaaagtaatcatatttacgaattagatccaaaactatggtatttctcttcaggatcttcaacgacaactatcaaacaaattgatgaattaaatgaagtagtagagaaagttgaaaaataa

SEQ ID NO: 3410 - DNA, 726 bp, Staphylococcus epidermidis
gtaggacaacacctcagacttcttgggaaaattggacaatgtagcatgcgagatataacaatcatgcgaagatttgtagggggagaaatcatgttatcaatagaaaaattatatcaaattctatatcaaaatatgggccctcaatattggtggccagcagaaacgccaatagaaatgatgcttggggcaattctagtccaaaatactaattggaacaatgcagatatagcgttatcaagattaaaagaagaaacttcttttaatgcacagacgatattgaaaatgcctttagaatcgttgcagcaagtgatacgttcgagtggtttctataaaaataaagctaaggctatacaggcattgttactatggttaaatcaacatcattttgattatagtagtatagctaagttatacggtgatagcttaagaaaagaattactcaccatccgtggtataggtgaagagaccgccgatgtcttaatagtatatatttttaaaggtaaagaattcatacctgatagttatactagacgtatttttagaaaattgggatatcaacatacagaaagttatcataaattgaaacaggaattaacacttcctgaatcattttcaaatcaagatgcaaatgagtttcacgctttattagataattttgggaaaaattattttaatggtaaggggaaacaacgctatacctttttagatacctattttaaaaaataa

SEQ ID NO: 3411 - DNA, 783 bp, Staphylococcus epidermidis
ctagtgaaacattatcaggcatacttaatcgatttagatgggacaatgtataaaggcacagatgaaattgacggtgccgcacaatttatagattatttaaataataatcatatcccgcatctatatgtaactaataattctacaaagacacctgttcaagttactgagaagttacgtgagatgcatattgatgctaaaccagatgaagttgtaacttcagcattggcaacagcggattatatctctgaacagcatccaaatgcaactgtatatatgattggtggtcatggactcataactgcactaactgatgcaggactttcaataaagaatgatgaacatgttgattatgtagttattggtttagatgaaaaggtaacatatgaaaaattatcaatcgcaacattagctgtacgtaatggagctaaatttatatctacaaatccagatgtatccatacctaaagagagaggttttttacctggtaatggtgctattacgagtgtggtcagtgtctctactggcattcagccagagtttattggtaaacctgaaccaattataatgtctaagtctttagatatacttggattagaaaaatcagaagttgcaatggttggtgatttatatgacacagacattatgtcaggtattaacgtgggtattgatacgatacatgttcaaactggtgtgagtacgtatgaagatattcaatctaaagaaataccgcctacgtattcatttaaagatttaaatgtagctattgcagaattagaaaaataa

SEQ ID NO: 3412 - DNA, 681 bp, Staphylococcus epidermidis
ttcgttatgcaaatattattagtcgaagacgataatacgctttttcaagaattaaaaaaggaattagaacaatgggattttaatgtcgttggtgtcgaagattttagtcatgtgatggagacatttgaaacatttaatccagaaatagttattttggatgttcaattaccgaaatacgatgggttttattggtgtcgaaaaatgagacaacagtcgaacgttcctattttatttttatcatcaagagataatccaatggatcaagtgatgagtatggaacttggtgcagatgattatatgcaaaaaccattttatacaaacgtcttaattgctaagctacaagctatttatagacgcgtttatgaatttggagttgaagaaaagagaacgttaagttggcaagacgctactgtggatttatcaaaagatagtattcaaaaagatgataaaactatctttttgtctaaaacagagatgattattttagagatgttaatcaataaacgtaatcaaatcgtgacacgagacactctcattactgctttgtgggatgatgaagcttttgttagtgataatactttaacagttaatgttaatagattaagaaaaaaattatcagaaattgacatggatagtgcaattgaaaccaaagttggtaaaggatacttagctcatgaataa

SEQ ID NO: 3413 - DNA, 156 bp, Staphylococcus epidermidis
gaatggacgcaaacgttctataacttctgctacttgatcaaacattgttggattctcagtaggcatgtgacatgtctcctttcagagcaattatttcataatcattattattacattataatagataaagtagtaaaaatctataaaacaagatag

SEQ ID NO: 3414 - DNA, 138 bp, Staphylococcus epidermidis
ttcgactggcaacagcctttttctatagacaatcatttatattataaaatgtatataaacatttcaattaacaataattttattttaacacgttgcaatcatttttttctcgcaatcaaacacgtttttaaaaaataa

SEQ ID NO: 3415 - DNA, 171 bp, Staphylococcus epidermidis
tttatttttaataaattcaactcagattctgatatattagcacgaataatacgttcgttgctattaatttgcactatcttttcgtttggttttgaagggatagaattaatatatgaaatacttccattaattggtgaaaataaagtggatttaattgaggatttagtttga

SEQ ID NO: 3416 - DNA, 687 bp, Staphylococcus epidermidis; identical to SEQ ID NO: 2404

SEQ ID NO: 3417 - DNA, 141 bp, Staphylococcus epidermidis
tctaattttaattctatagcttttaccctatattttcaagctacaatagggatagtttgtgaaaagtttaatttaatttcggatggcaatatgaaattaacattgctctggatttccagcgactttagctgttttaaatga

SEQ ID NO: 3418 - DNA, 531 bp, Staphylococcus epidermidis
caaaattttaaaatttatgttgaaaaaaattttaactcgggttactttctcagtggaggcgataatatgaaatataagattgaaaaattggatgacagtagcgtcgtttatatgagaatgataggtacttatcaaagtgataaaaactttgaaatgatgaagacttttaagcattggattcagactaatcattattggaaatatgttgagaaatacggtgtgttaggtatagcattagataatcctctccacgttcaaagtaatcaatgtagatatgacgttgttttgagaatagatgaaacagtaaatgatcagacaatatctaaaagagattttacaggtggcatatatgctgtgtttaaagttagtcatacaaaaataaatatagagaagttctttagcaatttagaaaatattttaaatgaaagtcatttgcgtatgagaaatgaaccaattatagagagatacattgaagaagagggaacagataaagtgtgtgaaatgttagtgcctatctatgaagtaaattaa

SEQ ID NO: 3419 - DNA, 264 bp, Staphylococcus epidermidis
gaggcatttaaaatgactgaagtagatgttgatgtagcaataatcggtgcaggtcctgccggtatgacagcagcagtatatgcatctcgtgccaatttaaaaactgtcatgattgaacgcggtatgccaggcggtcaaatggcaaacactgaagaagtagagaattttccaggatttgagatgatcacaggtcctgacttatctactaaaatgtttgaacatgctaaaaaatttggtggcggaataccaatatggcgatattaa

SEQ ID NO: 3420 - DNA, 135 bp, Staphylococcus epidermidis
ttacaatttaataatgccacacacatattattcattcaactattattacaaagaataaatgaattaaaattcgtttttaaatatacaaaacaccattttaatttatatttttttattaatgttcactttctctaa

SEQ ID NO: 3421 - DNA, 492 bp, Staphylococcus epidermidis
tgtagatttaaaataatgatgactgctaatgattggatagaccggttggaattaatttcgcatcctgaaggcggatattttaaagaaacaatgagaggcgacggtaaaggaagagcgtcttttagcagtatttattttctattaacacagcgcgatatatcacattttcatagaatagatgcagatgaagtatggtattatcatgctggtcagacgttgaagattcatatgataacccctaaaggtgaatatcatactgttaaattaggtagagatatagattgtggtgagtgtttacaatattgtgtgccaaaagggacaatttttgcttctactttagatagtgcagagggatatagtctagttggatgtatgtgtcaacctggatttgaatacgagcattttgaacttttaacacaagaatatttgattcgtcaatatccacaatatgaaagcataataaaaagattagctatatctcaagaagattaa

SEQ ID NO: 3422 - DNA, 123 bp, Staphylococcus epidermidis
aacttgtttaatgtgcattttattataatgattcatcaaaatagtatcggctgtatgacacctcggaacattcacaacttatttctatactttgcttatggctcaatcattttagaaacatga

SEQ ID NO: 3423 - DNA, 171 bp, Staphylococcus epidermidis
aaatatttcctcatcaaaacattctctatattcttctatcaattcaaaatattgttggtcgactttaatcatattttcaccttacaaaaaaatgaaatagaggcactaagtatcaaaaataccataaatcacttaccgatatcttcaatacacacatttatcaaaatataa

SEQ ID NO: 3424 - DNA, 189 bp, Staphylococcus epidermidis
ttgaaacttttgtttgattcaatttcaaaattatcaattaatgagacagttggtgatggtgctgaaataaatgacgttgtaaataaacgtgatgaatataaagagagtatacggtattataataatcatttagttttagtgaagtataatgaaaaatctatatgtaagttaaaatatcttcgaaattag

SEQ ID NO: 3425 - DNA, 207 bp, Staphylococcus epidermidis
atacctattaaaccaagtgttggattaaaagcacgtgatttgcttggcagataccatagtttatttacagaaaaggtagatttaaatggagcaacaccagtatttattgatagtattgatgaagatgatgagaagaatgagagagatattgaaaatttaagtaaacaatatccgaatgcaaagtttcatattgatgatattaggtag

SEQ ID NO: 3426 - DNA, 1362 bp, Staphylococcus epidermidis
agtacaattaagtatataaattttaaagagggggatcatgttatggaattaacaatatatcacacgaatgatattcatagtcatttaaatgaatatgctcgtattcaagcttatatggcaaaacatagaccgcaacttgaacatccctccctctatatagatataggtgaccatgttgatttatcagcacctgtgacagaagctacggtaggacataaaaatatagaacttttaaatgaagcacattgtgatattgcaaccattggaaataatgaaggaatgacaatttctcatgatgctttacaaaatctatataacgacgcggattttaaagtgatttgcacgaatgtcatagatgaagagggacatcttccacatcatattacctcttcgtatatcaaagaaataaaaggaacacgtattttatttgttgcagcaacggcaccgttcacacctttttatcgagcactggattggattgttactgacccattagcggcaatcaaagatgaaatcaatgcacatcaaggtgaatatgatcttttaatggttatgagccatgtcggtatcttttttgatgaaaagttatgccaagagattccggaaatagatgttatctttggtagtcatacgcatcatcattttgaacatggagaaataaacaatggtgttttgatggcagctgccggaaaatatggctattatttaggtgaagttaatattacgattgaaaatggaaaaatcgttgataaaatcgccaaaattcatcctattgaaacacttcccttagtcgagacacattttgaagaagaaggaagagcacttctaagtaaaccagtagttaatcatcatgtgaacttagtcaaaagaacagatgttgttacaagaacatcgtatttactggctgaaagtgtatatgagttttcaagggctgattgtgcaatcgtaaatgctggacttatagttaatggcattgaagctgataaagtgacggaatatgatatacatcgcatgttaccccatccaatcaatattgtaagagttcgattaaccggtaaacaattaaagcaagtgattcaaaaaagccaaaagcaagaatatatgcacgaacatgcacaaggtcttggttttagaggggatatatttggaggatatattttatataatctaggctttattgagtcagaagaccgttattttataggcgatgaagagattcaaaatgataaacaatatacgttaggtactgttgatatgtatacatttggaagatatttcccattgctaaaggggttatctacagattatattatgcctgaatttttacgtgatatttttaaagagaaattactaaaattataa

SEQ ID NO: 3427 - DNA, 1296 bp, Staphylococcus epidermidis
agtaaaattaaatattacggtagactgatttctccaacgcatcaacttgaagatgaatcagtatctcaagtttcaaaaggtgttataaaagacagtgagcgttggtattgtattcaatgtggaaacacttccttgcaatattttgtgacttacaattcaacgatattggataaaacaatcacatactgtagacgatgcattcaattaggcagaatggatagtattacagatatatgtctcgtaaaaagttttcaaaaagcaacaaaagcgaattatcagttaccctttgaattatcaaagcaacagcaatacgcttcagaaactatcgttcaagctataaaaaataataatgacctcttgttatatgccgtcacaggagcagggaaaactgaaatgatgtttgagggaattaggatagctcgtcagatgggacataatattgctattgtatcacctcgtgtagacgttattattgagataagtcatcgaattaaagatgcttttatcgatgaacatatagatgtgctacatcaatctagtagacagcaatataatggtcattttgttattgctactatccatcaattattgaggtttaaacagcattttgatactgtatttctcgatgaggtagatgcttttccgttgtctatggatccacaattatcaaatgcaatacaacttgcttcaaaatcgaatcattcacatattttcatgacggccacaccaccgcgtcattttttaaaacaattccccccagaaaaaataattaagttaccagcccgttttcaccgatccccccttcctattcctaagttcaaatatttcaaattaaaatcaacacgaaaacaaaatttattacttaatatatttagatatcaaattaaccaacaacgttttactttggtctttattaataatatagaaattatgaataaaatgtatcaacagtataaaatggacatccctgatttgatttgcgttcacagtgaagatgatttacgatttgaaaaaattgaagctttaagacgaggacaacacaaaattgtattcactacaactattttagaaagaggatttacaatgacacacttagatgtcgttgtagttgatgctggaagttttcaacaagaggctttaattcaaattgctggtcgcgtaggacgtaaacagcagtctccaagtggcttagttttatttcttcatgaaggtgttacattatcgatgattttagctaaaagaaacattatttcaatgaatcgtttagcaattaaaaggggatggattgatgcgtaa

SEQ ID NO: 3428 - DNA, 453 bp, Staphylococcus epidermidis
attaaagttaatcttaccaataaaggaggattaactatggaattatatagtatgcctatgtttaataaatttttagttaacgacatagagaaatcatcggaatggtatcaagagaatttaggttttaaaagtatttttaaatttaaaaatgaacaaaatcaaattttaatggagcatttacgattagcaaaatatcaagatttgatgttaatttctggcaaacagtttgaagtcggtaatgcagtttatacaaatatacttgtaccaaatattcgaattttaaaacaacgaatatcttctcaatatatcgtggaagatcttgaaggaaaaccatggaattctattgaaatgacaattaaagatttagataatcatttaattacgcttacacaaagtaacataaaaaatgaagaatttaatgctttgatgcaacatacttcaaaaactttttaa

SEQ ID NO: 3429 - DNA, 1101 bp, Staphylococcus epidermidis
ctaatggttaataaaggagtcggtatggaaatgtttgaagctatcatatataacatatctgtcatggtggcaggtatatatttatttcataggttacaatattctgaaaataaaagaatgattttttctaaagaatatgtaacagtactaatgacattcgtttctttacttttagcggcataccctatcccatttcaaaacgaatacctcgtccatttaacatttgtacctcttttgtttttaggacgttataccaacatgatatatacactcacggctgcttttatcgtatctttagtcgatgtatttatctttggaaactcaattatttatggtattacattaatcgttattgcaggtattgtcagtgcagtgggaccattcttaaagcaaaacgatatcatttctttacttattttaaatttgattagcattatcattttgttatttttagcattattaagccctatttatgaactcgtagagattttagtgcttatccctatttcatttattattacaattgcttcagcaataacattcgttgatatatggcactttttctctttagtcaatcgttatgaaaatgaagataaatacgattatcttacaggtctaggtaatgtgaaagaatttgatagacacttaaatgaggtctcaagtaaagctgaagaaaagaaacaaagtttagccttacttctcattgatattgatggctttaaagatgtaaacgatcattattcacaccaatcaggagatgctgttctcaaacaaatgtctcaactattaaaaaactatgtcccaaaccagttcaaaatatttagaaacggtggcgaagaattttctgttgtaataagagattacacactagatcaaagcgtgaaattagcagaaaatattcgaagtggtgttgaaaaatcttctttccacctaccaaacaaagaagtaatcaagctatcagtttcaattggtgtaggatacttaactcaagaagatcgtaaatctcaacgtaaagtatttaaagatgctgatgacatggtacatgtggctaaaagtgaaggaagaaataaagtcatgtttaatcctattgtcaaattataa

SEQ ID NO: 3430 - DNA, 141 bp, Staphylococcus epidermidis
agctcttgttttagaataagcattataaatgttatatttcaaaagcgaacaaatgtttgtattgttcttatagaatttgttaaaatagaaaatgatattcatgaaaaagtaattgatttgagatgtgtaaaatctttataa

SEQ ID NO: 3431 - DNA, 156 bp, Staphylococcus epidermidis
tgtagattcctcatacaaataaatgtctatttcgaactgccaacaaagattttgtctttgttggcagtttttatgagtgattcttcttatagtaacatttatgtagaatcatatattttaaaattaaagatagccttctatttttcaatttattaa

SEQ ID NO: 3432 - DNA, 1242 bp, Staphylococcus epidermidis
ctgcaatctaaaaataggatagaggtcgagaagatgtttacagcattattgcaaataaagaattataaattgtttgtggtcaatatgttgttactaggtatgggaatagcagtgactgtaccttatttaattttatttgctacaaaagatttggggatgacgacaacacaatatggactgctacttgcacttgctgcgataagtcagtttatagtcaattccattattgcaagattttctgatacacatcatcttaatagaaagattctaatcatcactgctttgtttatgggggcagtgagcttctcaatttatttctacgttcatcaaatatggttattcatcgtgttatatgcgttgtttcaaggattatttgcaccagcaatgccacaattgtatgcctctgccagagaatcaatcaatgcttcaagttcacgtgatcgtgctaagtttgctaatactgttttacgttcaatgttttcacttggttttttatttgggccatttataggtgcacaacttattgagttaaaaggttattctggattatttggtggcacaatagctattattttatttactttaattttacaagtgtttttttataaaaatttaccggtaaaaaatcaaatttctgaacaacagcatattgagaaaatcgcaccaaatatgtttaaagataaatcattatttattccatttatagcgtttatattacttcatattgggcaatggatgtatacgatgaatatgccactttttgtgacagattatttaaatgaaaaggaaagatatgtaggctatttagcaagtttatgtgcaggtttagaagtgccgtttatggttatattaggtatattatcagctaaattgccaactcgaactttattgataattggttctgtatttggtggcgcattttactttagtattggtgtatttaaaaattttcatatgatgcttgttggacaaatatgtttagccatctttctagcaatattactaggtcttgggattagttattttcaagatattcttcctgattttccaggttatgcatcaacactttttgccaatgccatggtaataggacaacttggtggtaatttgctaggtggtgtgatgagtcattgggttggtttggaaaatgtattctttgtctcagcaagttctatcttcgtagggatgatactcatcttgtttacgaaagatcaaaaaattacaatagaagatgtggagtag

SEQ ID NO: 3433 - DNA, 1194 bp, Staphylococcus epidermidis
ataatggctaaaaaaatcgtttcagacttagatttaaaaggtaaagttgttcttgagcgcgctgattttaacgttccaattaaagatggtgaaatcactaatgacaacagaattgttcaagcattaccaacaatcgaatatattattgaacaaggtggtaaattagttttattctctcacttaggtaaagttaaagaagagagtgataaagaaggactttcacttaagcctgttgctgaaaacttatctaagaaattaggtaaagaagttatattcgttcctgaaacacgtggcgaaaaactcgaaacagcaattgaaaacttaaatgaaggcgatgttttattagttgaaaatacacgtttcgaagatttagatggtaaaaaagaatctaaaaatgatcctgaattaggtaaatattgggcgtcattaggtgatgtatttgttaatgatgcatttggtacagcgcaccgtgaacatgcgtcaaacgtaggtatttctactcatctagaaacagcagctggttacttaatggaaaaagaaattaaatttattggtggcgtagtgaatgatccacaaaaaccagtagttgctattttaggtggcgctaaagtttcagataaaattaatgttatcaaaaatttagttaatatcgcagataaaatcttaatcggtggcggtatggcttatacatttattaaagcgcaaggtaaggaaataggtctttcattattggaagaagacaaaattgattttgctaaagacttgttagagaataatggcgatcaaatagtattacctgtagattgtaaaatcgctaaagaattttctaatgatgcaaaaatcactgaagtatctatcaatgaaatcccttcagatcaagaagcaatggatattggacctaaaacagtagaattatttaataaagaattacaaggtgcacatactgtagtatggaatggacctatgggtgtattcgaatttagtaattttgctaaaggtacaatcggtgtatgtgagtctattgctaaattggaagacgctactactattattggtggtggtgactctgccgcagcagcaatttcattaggtttcgaagatgactttacacacatctctactggtggaggagcatcattagaatacttagaaggtaaagaattacctggtataaaagctattaatgataaataa

SEQ ID NO: 3434 - DNA, 123 bp, Staphylococcus epidermidis; identical to SEQ ID NO: 2408

SEQ ID NO: 3435 - DNA, 528 bp, Staphylococcus epidermidis
gaggaacataaggagacatgcagaatgaagcatcaaaaaaatcagagcaggtttaaactactaatagctggcataatagcaggacttttatctggtgtagtcaaactaggttgggaggtaatgttcccaccccgaacacctagtagagatgccactaacccacctcaacaactcttacaattactaggaataccgtcaaatattacccatctcacatacaatttttctgagcatgcattaccttggataagttttatcgtacactatagtttttctatcgctattgcaataatctatatttatatcgcaaagaaatatacaaaaatcacactaggttatggtgctttatttggtatagttatttggattgtttttcatttaatcttaatgccaattatgcatgtcgtaccgaatgcttttgatcaaccattttcagaacacctatcagaattttttggacacattgtttggatgatggttatagaaatggtcagaaggtatttctataatattcaattaaataaataa

SEQ ID NO: 3436 - DNA, 843 bp, Staphylococcus epidermidis
tatgggcataaaagactgagggaaagaggtaaagatatggcaaattcttgtttgcatatactttcaaaaaaagaatatacggcaacacgatgtcaagacggcattttattattttggcctatcgaagggagtatgcactttcaacaatttatgaaagaaaggatactctcagatgagttatatattgtgaataatatggatgtgtttagtatcagtgacaatggcatcacactagaagtatatatttctagtgattggtttacagagttaggctattctttttttaattaccattatatttcggatttaatacaatctaagaaagaaattaaagaactagttgctcaacttacgttgaattttttagataatgatgtggataaagagcaagatattatcaataaaattgttcatattcttgctaatgaggctattattgacaaaaaaattgctgaagaccaatatatgtatgattattatggtgagttaaaggatgaattgaattatatatataatcacatcgaagaaagacttactctaaaagatatttccaataaattatatgtttctaagtccaacctttctacgcagtttcatttgttattaggtatgggatttaaaaaatatatagatacacttaaaattagtaaatctatagagatgctacttacgacaactaaaacgataagccaaattagtgaaacgttaggatttagtaatgtatctacatattctagacaattcaaaaattatttaagtgtaacgcccaatgcatatcgtgcaatgaaaaaatatgataagtacaatggatgttctgatgatgatgtttcagaacacttttaa

SEQ ID NO: 3437 - DNA, 168 bp, Staphylococcus epidermidis
tttgctaataaatatggcaaggttaaggcgattgcgagtgaaatggttccatgtacaccacatagagtcatgattagtgcatataagctacgcttaggtttactctcagtaactttatcttcatcatttttagaaatcattttttggaatggactgacagataaatag

SEQ ID NO: 3438 - DNA, 132 bp, Staphylococcus epidermidis
tgcaccaataacccttgtaacctctttacacttttaaaatttattcacgttagtcatattccatcaatcgaatgtgataacgtgaatttttttaatttgataaaactaacaattttgttatatccactgtaa

SEQ ID NO: 3439 - DNA, 228 bp, Staphylococcus epidermidis
gtatcaaataaacataatcatttattatttaataactttgtagtttatattattgacttattattttcaagttttttattatatggattatcatttccaattatacaaaaactacaaatccccatccgtgaaggtgcttttatgaatcacaatttcatttgtacaagaactactaactttcctttcaagaaggaagtagctctttataatatcttacatgacgtttaa

SEQ ID NO: 3440 - DNA, 1044 bp, Staphylococcus epidermidis
ctcatgaataattttcgatggttttggttttttataaaatctcgtattaattggatattgtggatattatttctcaacattattttattaggtgttgcctacatagattatgagatttcagttgaaagtgtattttatatagtgatattaaacgtaggattgagtatacttttcttattatttacgtttgttaaagaagtccgtctatctaaacatttttatgaagataaagaaattgaagaaattaagcataaagatttggcagaaaccccatttcaacaacaagtcatagattatctgtatcgtcatatagccgctcaaaaagagaaagtagtcgaacaacaattacaaattaaaaatcatgaacaaacaattacagagtttgttcatgatataaaaacacctgttacggctatgaaattattgatagatcaagagaatgatgatcagcgtaagcgagcgttattatttgaatggtctcgtattaatgagatgttagataagcaattatatttaacaaggcttgaaacacatcatcgtgatatgtattttgattatatttcattaaagagaatggttatagatgaaatacaagttactcgacatatcagtcaggcaaaagggataggttttgaattagattttaaagacgaacaaaaggtttatacagatgttaaatggtgccgtatgatgattaggcaagttctatctaactctttgaaatatagtgataattctacaataaatttaagtggttataacatagaaggacacgttgttttaaaaattaaagactacggtcgtggaattagtaaaagagatttaccacgtatatttgatagaggatttacttctacaacagaccgcaacgatactgcgtcttctggtatgggattataccttgtacaaagcgtgaaagaacaacttgggattgaagttaaagttgattcaatagtggggaaaggaacaacgttttatttcattttcccacaacaaaatgaaatcattgagcgcatgtctaaagtgacaagattgtcattttaa

SEQ ID NO: 3441 - DNA, 957 bp, Staphylococcus epidermidis
aatatttgtaatagtaaaggatatattaaaatgaaaaataataaaaatgaaaagttgaaaatcacaatcgttagcggtttcttaggcagtggtaaaactacgttcctgacacattatattaatgaattattaaaaattgatgagaaaataacagtaattatgaacgaatttggatcatttgatgtagatggtaaccatttgagtgaattagtcaaagtgtatccattgttgaacggttgtgtttgttgtgatatgaaatcagatttagttcaacaaattgagatgctcagtcacaaccatgaaacggaccatattataatagaagcaactggtatcgcgcatcctattgaattgattatggcgtgtcaagatcctcgcatagttcagtttgttgaacgtccccacgttgttagtattgttgatgcacttcgctttttacaaagacaacagtatactgactccacaaagcgtctcatggaagaacaactcgaggtaagcgatgtgctcgtcgttaataaattagatttaatatctgttgaagacagagatgctttaaagaaccaacttaacgaagtaaacaaatatagttcaaaaatatatactacttatggacaagttaatatcgaggagttgtcacaatttcgtgatcaattagtaatgacacacacacattctcatcaccatggtataaatagtatgcaatacacatttacaacagctattgaccgacaattattttaccaatttattttgcgtatgcctgataatgttttaagattaaagggatatgtacaatttaaagatgaacccaatgtgacatatgagtttcaatattcatttggtatgccggattatgaagttattaatggggattatccgttaacaatagtattgattggtgaacaacttgatgttaacagactaaaaaataaactcgatgttttgcaattctcataa

SEQ ID NO: 3442 - DNA, 297 bp, Staphylococcus epidermidis; identical to SEQ ID NO: 2411

SEQ ID NO: 3443 - DNA, 639 bp, Staphylococcus epidermidis
ttttctagtaaaaagaagaaaaccgtgcctatcaaaattaataatccagtggtagttaacacgagtttagagtgtaaggataattttctaaaacttttggcgttccacaaatcaaccacgactaaatgtcccaaacctcccaaaatgataagtattggaatagtgataatgattaccggatcatttgaaaaatcgattaagttgtttttaaaaagggcgaatcctgcgttgttaaatgcggaaactgaagtgaataaacttaaaaatagacctttacctatgccaaattttggaataaacgataaacatagacaaagtgtaccaaataattcagtggcgatgctgtatatggctagatgtttaataagtttaattacaccaccgggttcgtcaatattccaagtaatcataaataaaattctattgttaattgatattttcttatttaaaaagatgagagttagcattgctacagtgacaatacctaatccaccaatttgtataagtaataagataatgatttctccaaaaatattaaattgtgttccaacatcaactggtgatagacctgttactgtgaatgcgctagaagctacaaacaatgcgtcaataaagttaatgggtttcttccctgtatag

SEQ ID NO: 3444 - DNA, 699 bp, Staphylococcus epidermidis
aacatgggtaaatcttatggtgaaatatttcacgaaatggtgacaatgccaaatgttcagtggccagaggtttggcaggcaattttagaaactctatatatgactgttgtttcgacgctttttgcatttgtctttggacttatattaggggtattactctttttatctgcgaaaagtaactcattggctgctaagattttctacacgattgtgtcattcattgttaatttatttagagcaattccatttatcatattaattttactgttaattccatttacaagtatacttctcggaacaatcagtgggccaactggtgcattaccagcacttattattggtgcagcaccattctacgctagattggtcgagattgcttttaaagaaattgataaaggtgttatagaggctgcttggtcaatgggagcgaacacttcgatagttgtgagaaaagtgctacttcctgaagcaatgcctgctttaatttcaggtattaccgttactgcaattgctttggtaggttctacagctattgcaggtgttattggcgcaggcggtttaggtaatttagcatatttaacaggatttactcgaaatcaaaatgatgtcattttagtttcaacagtatttattttaattattgtatttataatccagttcctaggggattggcttacaaataaaatcgataaacgctaa

SEQ ID NO: 3445 - DNA, 1062 bp, Staphylococcus epidermidis
ttgcctctcaagtacctttgttacaaagatataaggaggaaggtagtagtgaaagacttaattaaagttcaacaaaagcttatacctgatcttatagataagatgtatagacgcttttatattttatctactatctctcaaaatcaacctgtaggaagaagaagtctaagtgaacatatggatatgactgagagagttttacggtcggaaacagatatgttaaagaagcaagaattaattcgtgtcaaacctacgggaatggaaattactaatgaaggtactgaagtattagcacaactaggtgaatactttaatgtttatagcgatgaccataaattggccagtgctatcaaagataaatttcatattaaagatgtacatgtcattccaggagattccgattctaatcgaactgtaaaacgtgaaatgggtcaacaagctgggcaacttttagaaggtatactttatgaagatgctattgtctctgtaactggtggttcaacaatggcgtgcgtgagtgagtcgatacatttattaccgtttaacgtattctttgttccagctagaggtggacttggagaaaatgttgtttatcaagcgaatacaatcgcttcgagtatggcccaacaagctggtggctattatacaacactctatgttccagacaacgtgagtgagtccacatacgatacgttaatgttggaaccttctgtcatgcatacactagataaaatcaagcaagctaatataacaatacacggcattggtgatgcgctgaagatggcgcatcgacgtcaatcatctcaaaatgtgattgataaccttcaacatcatcaagccgttggagaagcttttggatattattttgatgctcagggtcaaatagttcataaggtcaaaacgattggccttcagctagaggatcttgagaacaaagactttatctttgcggttgctggtggacaatcaaaaggagaagctattaaagcttatctttcaattgcaccggaaaacactgtattgattacagatgaagccgcagcaaaagtcattttacaatag

SEQ ID NO: 3446 - DNA, 153 bp, Staphylococcus epidermidis
ttcgtttacaaagtctttagcttcttgaactgttttattcattttccagtttccggctataattggtgttctcattcattacactccttaatttttagtgttaaatttgtaagcttttatccaaatacttgcttatttcgaaataaacgttga

SEQ ID NO: 3447 - DNA, 138 bp, Staphylococcus epidermidis
caaaactacaatcgcactaataaatttggagataccgctcatattgtttacctctctttcattcttaaacacgaatttatcttaaaaacaatactattgaatcattgtaaaaaatcaaatctcaactattttcaataa

SEQ ID NO: 3448 - DNA, 762 bp, Staphylococcus epidermidis
tcacaggtcctgacttatctactaaaatgtttgaacatgctaaaaaatttggtggcggaataccaatatggcgatattaaatctgttgaagataaaggcgactataaagttatcaatttagggaataaagagataacagcacatgcagttattatctcaactggagcagagtataaaaagattggcgttcctggtgaacaagaattaggaggacgtggagtaagttattgtgcggtttgtgatggagcattctttaaaaataaacgtcttttcgtaattggcggcggagattcagcggtagaagaaggtactttcttaactaaatttgcagataaagtaacgattgttcaccgtagagatgaattacgtgcacaaaacatcttgcaagaacgtgccttcaaaaatgataaagttgactttatttggagtcatacacttaaaacaattaatgaaaaagatggtaaagttggttcagttacacttgaatcaactaaagatggtgctgaacagacttatgatgccgacggtgtattcatttatattggaatgaaaccactcacagcaccatttaaaaatcttggtattacaaatgacgcgggatacattgtcacacaagatgacatgagtactaaagtacgaggtatttttgctgcaggtgacgttcgtgataaagggttacgtcaaattgttactgctacaggagacggtagtattgcggctcaaagtgcagctgattatattacagaattaaaagataattaa

SEQ ID NO: 3449 - DNA, 150 bp, Staphylococcus epidermidis
acgtcaaacaacacaatatacattttatattttaattttacaattcattatatctatgtttcaaatataattcaattcaaattttatgtcttgcttagaattgtatttaaaattttacatattcaaatcatatgtcaacaactcaattag

SEQ ID NO: 3450 - DNA, 450 bp, Staphylococcus epidermidis
agaggtgacaagcgaatgtattttgtagataaagataaactaactcagaaaatcacttacttacaaaagctcactgaagattacaatgataataaaaggaacctatatgcttttgaacgaattggtcaaatgttaattgaatcttctgtagatattggcaatatgattatagatgggtttattttaagagatcctggtaattataaagatgtaatagatattttagaattggaaaatgttatttcaaaagaaacacaatcacatatcaatcgaactattgatgttagaaaacagtttgcacatcactatatcgatttaaatatgaataaaattgagccgttatttgatgatgcactaccatactataagcaatttattcaagaagtaggacaatttttagaaaatgaaaatgtaccaattaccgcatttggaaaaggagcgaataactag

SEQ ID NO: 3451 - DNA, 1047 bp, Staphylococcus epidermidis
tactttttaaatatcattttaaaggaggccattataatggcaattaaagtagcaattaatggttttggtagaattggtcgtttagcattcagaagaattcaagatgtagaaggtcttgaagtagttgcagttaacgacttaacagatgacgatatgttagctcatttattaaaatacgatactatgcaaggtcgtttcactggagaagttgaagttatcgaaggtggattccgtgtgaacggtaaagaaattaaatcattcgatgaaccagatgctggtaaattaccatggggcgatttagatatcgacgtagtattagaatgtactggtttctatactgataaagaaaaagcacaagctcacatcgatgcaggtgctaaaaaagtattaatctcagctccagctaaaggtgatgtaaaaacaatcgtattcaacactaaccatgatacattagatggttcagaaacagttgtttcaggtgcttcttgtactactaactcattagcaccagttgcaaaagttttaagtgacgaattcggtttagttgaaggtttcatgactacaattcacgcttacactggtgaccaaaatacacaagacgcacctcacagaaaaggtgacaaacgtcgtgcacgtgcagcagctgaaaatattatccctaactcaacaggtgctgctaaagctatcggtaaagttattccagaaatcgatggtaaattagacggtggagcacaacgtgttccagttgctactggttctttaactgaattaactgtagtattagacaaacaagatgtaactgttgaccaagttaacagtgctatgaaacaagcttctgacgaatcattcggttacactgaagacgaaatcgtatcttctgatattgttggtatgacttacggttcattatttgatgcgactcaaactcgtgttatgactgttggagatcgtcaattagttaaagttgcagcttggtacgacaatgaaatgtcttacactgctcaattagtacgtacattagctcacttagctgaactttctaaataa

SEQ ID NO: 3452 - DNA, 258 bp, Staphylococcus epidermidis
ctttggttaaaaagtacaagtaaggtgatgaatatgaaagactggacaattaacaatcattccaaacgacaattgattattcaaagtaatcatgatgatatttcgattatagaaccattgcgaaatggttcttttaaaatacttgctgaatttaatgcgttaaatacagattacattcaagtttatgaccacacacttgttgtttctatacatgagaaagagattagtgtgttagatcgatcttcacagtcaatttaa

SEQ ID NO: 3453 - DNA, 129 bp, Staphylococcus epidermidis
gatatactaaactcatttaacccctccttttctttttacatttatattaagtgtaatcatttattaagtgtaatcattgtatggcgatttgaaacatatcgtatttcaataaatctcaatatttcttaa

SEQ ID NO: 3454 - DNA, 1056 bp, Staphylococcus epidermidis
tacgaactaaatcttaaggagaaatgcatcatgattattgcaattatactattaatatttgtttcatttttcttttcaggtagtgagacagcattaacagccgcgaatcgcactaagtttcaaactgaagctaaaaagggtgatcgtaaggcgcaaggtttaacaaagttattagataaaccaagtgaatttatcactactatattaatcggtaacaatgtagcgaatattattttacctacactcgtgacaatcttagcgattgatattggagtgaatgtgggaatagcatcagcaattgtaacaattgtgattatacttatttctgaagtgattcctaaatcaattgctgcaacatttcctgataaaatttcaaaacttgtgtatcctatcattcatatatgtgttattgtactcaagcccattacaatcttattaaacaagatgacagatggtattaatcatttactatctcgaggccaacctgttgaaaaaagattttctaaagaagaaattcgtacattattaaatattgcgggtagagaaggtgcatttaatgagatagaaaatactcgacttcaaaacgttatggactttgaacaattgaaggttaaggatgttgataccacgcctcgtattaatgttgtagctttttcaaaggaagtaacatatgacgaagcttatgatacagtgatgaataacccatatacaagatatccagtatatgatgaaaatatagatgatatcatcggcgtattccactcaaaatatttattagcttggagtaaacataaagaggagtcaattactaattatgcatcaagccctttatttgtaaatgaacataatagggcagaatgggtattgcgtaaaatgaccgtttcacgaaaacatttagcgattgttttagatgaatttggaggtacggatgctatcgtatcgcacgaagatttaatagaagagctacttggtatggatattgaggatgaaatggatcgtgaagaagaaaataaattaaaacatcaaaaatttccgcaaagcatgatgcatcgttaa

SEQ ID NO: 3455 - DNA, 135 bp, Staphylococcus epidermidis
tttaatataaaaagctctaagattctttgtgtaaaagtcatcttaaagctttttaagttaatctatcattttattactagtcatacaccttactattcaacgctgtctctctctaatactggttttaagtattga

SEQ ID NO: 3456 - DNA, 129 bp, Staphylococcus epidermidis
gtcttcataaattcgtgtgctaagttgacagttaataagccaagaaatgttacaggacctattaatgcagtagatatagagacgagtaaagcaaccaaaataagaaacatacgcgtcatattctcataa

SEQ ID NO: 3457 - DNA, 141 bp, Staphylococcus epidermidis
aacttaataaacataggctggggcattgttttgatatgttcacttcaaagtagatatgacattaatcaagctttggagttcgtattcttaataagtgtctcagcttattttgtttgcttaaattttgaattaaccaattaa

SEQ ID NO: 3458 - DNA, 507 bp, Staphylococcus epidermidis
gatagaataaatcttaagagaaatgtgggtaaggagatgaaattgaaaaacttatttttaagttctgttgcagttattttatcaatttgtttagtacttttattatttttagctacaaaccaaaatgcattagcgaaagtccataaaacaatttgtacttttactaaagtgaaaacagtatctcataacgatatattccctaacttaaatatgaatcatgttgctgaagcttcagaaaaaaactctgatcaccaaaagaatgttaataaaacaaatcaacaaagtgtaagaacgcaagcatcttatgatttcaacccacaggaatgtaaagtaattgctttgaattacgctgagaatcatttaagcaaaaaatataatatagagcgtactttcaacgagtcgcttcattcagtatatgtattttctagtgaaaataaacttcatcaaactaaggttaaagtcaataaaagtgggactgtacatgcatcaaacatcaataatcattaa

SEQ ID NO: 3459 - DNA, 132 bp, Staphylococcus epidermidis
aatgtgataaattcatttcaaagtcatcattttccaattgacaaaaatataaaattaattttaaaaacaatttttaaatatgttgtcaataatgttttttatagtaacaaaacgattattgcgtatttttaa

SEQ ID NO: 3460 - DNA, 123 bp, Staphylococcus epidermidis
gattatgtaaatacacagtatttaactagaatgtatgacaaggaaattgataaaatgatagcaaatagttcagagaaaaggatgtcatttaatgaaaatcagagtcatcgtcccttgctataa

SEQ ID NO: 3461 - DNA, 261 bp, Staphylococcus epidermidis
tttatagtaaagggatgtgatgttgtgatgaataaaaatctattaaaaaaatacttgaatgatgatagtttcaaatcagttgtcgttgttatagggaataagagaatcgtattagagaatgatattcatgttgattatgaaaacgaagttattatttatccatgtaaaaattgtacacgtattataccgtttagttcaatttcctatttagaacttattgataagcaagaccaatttattaactattttaaagaaggatga

SEQ ID NO: 3462 - DNA, 225 bp, Staphylococcus epidermidis
tttctttcaaaacttcttggaaagcttgcttatcaccatagacttttgacaactgtcttacctctaatatcgacaaataatcactcctgtcatacttcaaccaaattatctttttacgaagacaaacttaatgtagactatcatatcttctttaatttacatcttttattatatcgattatttattacaattgtgataatagtaagtaacaaaacgcacgtttaa

SEQ ID NO: 3463 - DNA, 444 bp, Staphylococcus epidermidis
gtaactacaaaggagtctatcatgagaaaatggttaaccttactattaattacaacattggtgttaactgcatgtggtaaaagtaacgaaaaagcttctttagaaaaaagcattgatcagttgaaaaaagaaaataaggatttaaaaaaacagaagaaaaagttacaagagcaaaaggataagcttaaacacaaacaggatagtctccaagaagatgtaaatgacttgcctgctaaaagcacatcccgagataagaaaaataaagataatcatgatgcaaaagaaaagtcttcagataatcaatcgacatctgctaatcatgatgatcaaactaacaaaataaaaagcaatcaagatgaacatgacagtcaatcctctaaaccacatacacagcagaagccctcacagaatgatagaaaaaataatcatcgacaagaacgatag

SEQ ID NO: 3464 - DNA, 138 bp, Staphylococcus epidermidis
ctacaaacaaatgtagaatgcaatttaattattatgaaatttaaaaagataaacaaaattaaaatcgtcataccgactgatagtcaggacattgaatactttgttataatgtttaaactaataaagataagaaggtga

SEQ ID NO: 3465 - DNA, 168 bp, Staphylococcus epidermidis
actaatgcaaaatatttttatagtttgtcgtggcttactctcatgaagtttatcaataacttaacaatcccttttattaaaaatcaaacgataagccataataattcattacatttattaaaacaaagagttaagtcttctaaaaattccactttaaatactttgtaa

SEQ ID NO: 3466 - DNA, 165 bp, Staphylococcus epidermidis
ttaatcgcaaaaatatcaatcatgctattgattaaaacagataataatatggagctaaacttaagctgtctgaaacgatgtcggtataaatcgaagccaagaattagcaagacgatggcgatgttaattaatatatatataatcatgttgaactcctattcgtaa

SEQ ID NO: 3467 - DNA, 759 bp, Staphylococcus epidermidis
aaatatcaaaaatatcttaaaatacttaataaagtagtaccattaaatgacgacgaaacctttaaattaggaatcgtattgagttatttaaaacagtatcgtgcttctcaaaatttactttatccactttataaaaaaggtaaatttgtctctattcaaatgtataatgcattgagtttcaatttttattacctaggaaataaagacgaaagtattgagatgtggaacaagctcactcaaatttctgaagttgatgttggttatgcaccttgggtaattgaggaaagtaaaacggtatttgaatcacgagtgttaccattattactagatgataataatcattatcgactttacggtatttttttacttcatcaattaaatggaaaagaaatactaatgactgaagatatttggtcaattcttgaatcaatgaatgactatgagaaactttatctcacatatttggtacaaggactcacactcaataaattagattttatacacagaggtatgcaaaggttgtataattttaagaaattcaaatataacacgtctttatttacagattggattaatcaagcagaaatgattatagctgaaaatgtagatttagtagatgtcgatagatatgtagctgcatttgtttacctatcgtatcgtcgttctagccaaccacttaccaagaggcaattgatggacgattttaatgtttctagatacaaactgaataaagcaattgaatttatattgagcatataa

SEQ ID NO: 3468 - DNA, 681 bp, Staphylococcus epidermidis
atggcacaaaaagaaaataacatcattccaatgatttttgatgaggctttttatcgtaaaatggctacccaaaagtggcgacaacaggactacaagaaggcggcagaatattatgaaaaagtgcttgagttgtcacctaaggattttgatattcaacaacactatgctcaatgtttagttaaattaaatatcggcaaaaaagcagaacgtctattttatgagaatattgttaaagactttcatgtagcagaaagtttctatgaactaagtcaattaaatatagaattaaacgagccaaacaaggcattcttgtttggtattaattatgtaatattgtcagaggataaagattttagagaaatgcttgaaaaaacattcgaagtcacgtatacaaatgaacaaaaaattgaattagaagcacaattgttttcaacacaacttttatttcaatttctcttttcgcaaggtaggttagaagaagcccgaacatatattttgaatcaatcttacgagatacaacagcatagggtgattaggaatttacttgcaatgtgttatttgtatctaggtgagtatgatagcgccaaagcaatgtttgaagaacttttaaaggaagataattcagacgtgcatgcactttgtcactacacattattactttataataaaaaagaagcataa

SEQ ID NO: 3469 - DNA, 390 bp, Staphylococcus epidermidis
atgattaaaaagacataccaaaagggcgttaaaatcatcgttgatatgagagataggataataataattgtacctgttgtcattggtcttttaattttacgaaatagtgaaagacgttcaacttcgtctattttgaaagtacctacaaaaagtaaaatcgcccctattataaatatcgtgggtgataaatatgggatggacatgtacaccgattgtgtgctcgatttatctgtaataaattgcaataagcttataacaatggctagtattatagcaataaacttttggtcagaaattacaaaaggatatagcttgaaatttaaatatatttgtaaaagtgtccatatcataaatagcgtgacggtaaacatcgtaataaaattgaattga

SEQ ID NO: 3470 - DNA, 243 bp, Staphylococcus epidermidis
aatcataaaaagacatttgatttcagccccttttttaaagtgttaaaaacacttgagtcacctacttatatactttcacctattaatcataccagattgctcgagtttttatgtgcaaaaaattcttttttgcactatatacataaactttttttgctaataatgataattttcatttatttttgttcttgtgatgaaattacagttgttagaggtttaaaaataactataacattaaattga

SEQ ID NO: 3471 - DNA, 1068 bp, Staphylococcus epidermidis
tcaatgaaaaacttagtattactaggcgggggctatggtaatatgcgaattatgtcgcgcattttacctcattcaattcctgagggatatcacttaactttaatcgaccgcatgccattccacggtttaaaacctgaattttatgcacttgcagcaggaactaaatctgacaaagaggtgcgaatccaatttccagatagcagtcaaattaatacggtttatggggaaatcagtgatatagatttggacgaacaaatgataacagttggaaattcaaaaatagattatgacgaacttatcattggtctagggtgtgaggataaatatcataatgtccctggtgctgaagcatatacacatagcattcaaacattatctaaatcgcgtgaaacataccatagaattagcgagttacctaaaggggcacgtgtaggtatcgttggggcaggtttaagtggcattgaattagcgagcgagctacgtgaaagtcgatcagacttggaaattttgttatatgatagagggcctcgaattttaaggaattttccagagaaactgagtaaatacatatctaattggttttctaaacacaatgttactgtagtacctaattcagtcatcgacagagtagaacccggaaaaatttataataatggtaaaccagaaaatattgatttagtcgtttggacagcaggcatacaacctgttgaaattgtgcgtaatcttcctattgatatgagtaccactggacgcgtgattattaatcagtaccatcaagtcccaacctatagaaatgtttatgtcgtaggtgactgtgctaatttaccacatgcacccagtgctcaactagcagaactacaaggtgaacagattgctgaggtgttgaagaagcaatggaataacgaaccacttccagataaaatgcctgaaattaaagtacaaggctttttaggctctttaggtgacaaacaaggttttgcttatatcatggatcgaacagttaccggacgattagcctctattctaaaatcaggtgttctgtggcgctataaatatcataatggttaa

SEQ ID NO: 3472 - DNA, 1197 bp, Staphylococcus epidermidis
ttcaaagaaaagaagggttcaatcatgtcagaatatgttttaacgaatggcatcgtatatacagaaaatgaaatgattaacaatggatatgttcatattaaagatgggaaaattttagacgttggtaagtgtccttttcatccgtcatcgtcgcataatacaattgacattattgatgtaaaaaaacgacatatactgccaggatttatagatattcacatccatggggggtatggtgaagatgccatggatgcatctgaacaaggcttacaacatttagcagaatcactcctttctgaggggacaacatcttttttagcaacaacaatgacacagtcaacagtcaatattgagcgagcacttcaaactattgctaaatatactcaacaacaagatgttacaaatgctgccgaaattgtgggagtacatcttgaaggtccatttatttcagaacataaagtaggcgcacaacatcctcaattcgtacaacgtcctacggttgataaaataaagtcgtttcaggaagtagcgaatggactaattaagattattacgtacgctcctgaagttgatggagcaacagaaacgttaaagacaatgaaaaatgatatcattttttcaatcggacatacggtggcaacgtttgatcaagcgaatacagctgtgagtcatggtgccaaacacatcactcatttgtataatgcagcgaccggctttcaacatagagaaccgggtgtatttggtgcagcctggttaaatcaagggttgcatactgaaatgattgtggatggtgttcattcacatcctgcatccatcgcacttgcatatagacttaaggggaatcaaagctgttatttaattacagatgcgatgagagctaaaggaatgccagaaggacattatgatttaggtggtcaggatgtgattgtaaagggaagtgaagcacgcctgtcttctggggctttagctggaagtatactcaaaatgaacgaaggacttaaaaatttaatacaatttacaggtgacacgattgagcatttatggagagtaacaagtttaaatcaagcgataacattaggcatagacgacataaaaggtagtattaaaatcgggaaagatgcagatattgttatcatagatgatgcatgtaatgttgaaacgacgattaaaaatggaaaatatcatgctttcaaatga

SEQ ID NO: 3473 - DNA, 558 bp, Staphylococcus epidermidis
agggagcgaaatacattggaattacaagaagctatatctaatcgtagaagcgtcaaaaaatttaaacacgatatggtggttgatgatcaaacggtttacgatgcaatatataaagctactgacgctccaaatcatggtatgagagaaccatggagattggttcatatttcaaaagataaactcggtgattttagtagggatatcacaagatttgcttttccagatagtccggataagcgagaggatcactttcatgcagtaacaaatttaggtggcatgttgttgttgattttaaaagatgatccaagacaacgtcaaagtcgtgaaaattattttgcatttggagcttttgctcaaaatttaatgttacttttatacgaagcgggtattggtacttgttggaagtcgccacaatatatctttgatcctaaaatacgaaaagctttgggtgtaaaggataatgaaatattagcaggatttttgtatcttactgatttagaagaagtaccaacgaaggctaaacgtaaaaataaaaatcttattaccgaatttgaataa

SEQ ID NO: 3474 - DNA, 141 bp, Staphylococcus epidermidis
ctattaagaaaaaacaacatcaagcgcaatagaattttaatgattgttttaccattaataaaattggtattttatcaagcaacgagcaacagtgtttatgactctgtcactcgttgcttatttttatgttcacatttttaa

SEQ ID NO: 3475 - DNA, 975 bp, Staphylococcus epidermidis
aaggtaggaaaaattatgcaaatgagcgctaataaaaaaataagtatactggtcgttatggcaatttgtatggcaattttttatttattggtaggtttagattttgatatatttgaatatcaattccaaagccgtttcaaaaaatttattcttatattattagtaggagcatcgataggaacgtccgtagttattttccaatctattactacaaatagattattaactccttctattatgggacttgattctgtgtatttatttgtcaaagtcttacctatttttattttaggtgaacaagcaactgttgttacaaatatctaccttaattttttaatcactttgatcgcaatggtgtttttttcattgctattatttcaagttatatttaaactaggtcacttttcagtctatttcatattactagttggtgtaatattaggaactttcttccgtagtattacaagttttctccaacttataatgaatcctgaatcttttttagcagttcaaaatgttatgtttgctagctttgaagcatcaaattctaaattagtaactgtttcaggcatattattagttatattaataattgttacaataatacttcgaccatatttagatgttcttttgttaggtagagcacaagcaattaatctaggtgtttcttatgagaatatgacgcgtatgtttcttattttggttgctttactcgtctctatatctactgcattaataggtcctgtaacatttcttggcttattaactgtcaacttagcacacgaatttatgaagacctatgaacacaaatttattttaccggcaacaatattattcagctggattagtttatttatagcgcaatgggtagttgaaaatctattcgaagcaacaactgaattcagtttgatagtagatttagttggtggaagttacttcatatatttgcttgtcaaaaggagaaatgcaaattga

SEQ ID NO: 3476 - DNA, 600 bp, Staphylococcus epidermidis
acagaaggaaaaaattttgctatactaaacacgtatatcacgaacagggagtgtaagagcatgacgcgacagagaatcgccattgatatggatgaagtgcttgctgatacattgggtgctgttgttaaagcggtcaatgaacgagcggatttaaatatcaaaatggaatcattaaacggtaaaaaattaaaacatatgatacccgagcatgaggggttagtcatggatattttaaaagaacctggattctttagaaatttagatgtaatgccgcatgctcaagaagttgtaaaacaactcaatgagcattacgacatatacatagccacagcagcgatggatgttccaacctcttttcatgacaaatatgaatggttattagaatactttccttttttagatccgcaacattttgtattttgtggtagaaagaatattattcttgcagattatcttattgatgataatccaaagcaattggaaatttttgaagggaaatcaattatgtttactgcttctcataatgttaatgaacatagatttgaacgcgtaagtggttggagagatgtaaagaattattttaattcaattgaaaaatag

SEQ ID NO: 3477 - DNA, 129 bp, Staphylococcus epidermidis
aatagtttgaaatttgaagagtttaaagttgaaatcataatttgtaaaatggatttcactttagctcttcttttcattttagttgctaatgatgatatgattaatcattatgttcaagtaaaattgtaa

SEQ ID NO: 3478 - DNA, 150 bp, Staphylococcus epidermidis
ttagtattgaaaatgttattaaaatcaagctgtctattgaaacttaagtcttcaagttgtaaacttcaattgttcataaaaatattaaatagcttcggaggtgatgagatatgtcagattcaatcactatcattgatgaaaataaagtga

SEQ ID NO: 3479 - DNA, 516 bp, Staphylococcus epidermidis
gtgcttatgaagaaactaataacatcattacttgttttaggattagttttaactggagtaagcgttggaaacaacgttgaagcggcaactggtaattcaatgaaaacagtacaacaattaaacaaaggtgataaatcattagaaaacgttaagataggcgaatcaatgaagagtgtattaaaaaagtatagtcatcctatctattcttataacccaaatagtaatgaaaagtattacgaatttagaactgataaaggtgttttgctagtaacagctaatggtaaaaaagaaagaggaaatgttacacgcgtatcaatgacatataatgatgcaaacggcccttcatacaaagccgtaaaacaacaacttggtcataaagctataagtcgtgtacattataataatgttacaggtaactttggctatattcaaaaagatcaagcaagttatcaattcagttcaaattcaccaaaggataaaaatgtgaagttatatcgtatagatttaaataaataa

SEQ ID NO: 3480 - DNA, 1245 bp, Staphylococcus epidermidis
actcgtatgaagaaacaaattatcgaaagattaacgagatatgtaaaaattgatacacaatctaatcctgattccaagacgacaccatctacgaataaacagtgggatttattaaatctattagaagaagagcttcaatcattaggtcttaaaacagacatggatgaacatggttacttatttgctacactcgaaagcaatattaattataatgtacctactgtcggttttttagcacatgtagacacttcaccagatttcaatgcttctcatgtaaatccgcaaatcattgaagcctataatgggcaacctatcaaacttggtgaatctcagcgtatcttagatcctgatgtttttcctgaattaaataaagttgtgggtcatacactaatggtgacagatggtacatctctactaggcgccgatgataaagcaggtgttgtagaaataatggaagggataaagtatttaattgatcatcctgacattaaacacggtacaattcgagttggctttacacccgatgaagaaattggacgaggcccgcatcaatttgatgttagtcgatttaatgcagattttgcatatacaatggatggcagtcaattaggagaactacaattcgaaagtttcaatgcggcagaggtaactgtcacttgccatggtgttaacgttcatccaggttcagctaaaaatgccatggttaatgcaattagtttaggtcaacagtttaatagtttacttcccttacatgaagttcctgaaagaactgaaggatacgaagggttctatcatttaatgaattttacaggtaatgttgaaaaagcaactctacaatatattattcgcgaccatgacaaagaacagtttgagctacgtaaaaaacgcatgatggaaattcgtgatgatattaatgttcattataatcattttccaattaaagtagatgtgcatgaccaatattttaacatggcagaaaaaattgaacctttgaaacacatcattgatatacctaaacgtgtctttgaggctttagacatcgtacctaacactgaacctattcgaggtggtacagatggatcacaattatcttttatggggttacctacacctaatatttttactggttgtggcaatttccacggtccttttgaatacgcttctatcgatgtaatggaaaaggctgttcatgttgtcgttggtattgctcaagaagtagcaaacagccatcaatcttataaataa

SEQ ID NO: 3481 - DNA, 330 bp, Staphylococcus epidermidis
atagtgatgaaaaatattcatcaaaccgaagaatttaattctactattggtagtactgatccagtaattatcaagtttgaagccgactggtgtccagattgtaaagcgatggatatgtggatagatccaattgttgaaaaatataataattatcaatggtatgtggtcgatcgtgacgaattagaagatgtgacaactgaaaatgatgttatgggtatcccaagtattttaatattccaaaatggtaaaaaattagcacacttgcattcagcaaatgctaaatcacctgaacaagttgaatcattcttgactgaacatttagatcaataa

SEQ ID NO: 3482 - DNA, 1515 bp, Staphylococcus epidermidis
aaggtgatgaagatgatgagtaatttaataatattgcctatgttgttgccttttgtatgtgctttaattttagtcttcactaaaaataaaaatcgtatttcgaaaatcctatccattacaactatgattgttaatacaatgatttcaattgctttacttatttatgtcgttaatcataaaccgataacacttgattttgggggatggaaagcacctttcggcattcaatttctaggtgattcactgagtctgcttatggtgtcagtatcatcttttgttgttacgctaataatggcatacggctttggtagaggggagaagcgagtcaatcgatttcaccttcctacatttattcttttattaacagtaggtgttattggttcgtttttaacttctgatttatttaacctatacgtgatgtttgaaattatgcttcttgcttcgtttgtacttgttacattaggacaatctgttgaacaattacgtgcagcgatagtatatgttgttctgaatattttaggttcgtggttgcttttattaggaattggcatgttatataagacagtcggaacacttaatttctcacatttagcgatgcgattgaatcatatggaaaataaccaaacaataacgatgatatctttagtatttctagttgcttttagttcaaaggcagcactagtgattttcatgtggttacctaaagcatatgcagtgcttaatacggaacttgccgcgttatttgcagcattgatgacaaaagttggagcttatgcgcttattcgtttttttactttactattcgaccatcatccaagcgtcacgcatacattgctcgtgtttatggcttgtatcacaatgattatcggtgcatttggtgtcatcgcttacaaagatattaagaaaattgcggcttatcaagttattttgtctattggattcattattttaggtttaggttctcatactatatcaggtgtaaatggtgctatcttctatttagcgaatgatattatcgttaagacattattgttttttgtaattggtagtcttgtttatatgtcaggctatcgaaattatcagtatttaagtggactggcaaaaagagaaccattctttggtgttgcatttgtcgtggtaatttttgctataggtggcgtacctccttttagtggctttccgggtaaagtcttaatattccaaggggctattacaaatggtaattatattggtttagcacttatgattgtgacaagtttaattgctatgtatagtctttttagagtgatgtttataatgtattttggtgatgctgacggagaacaagtacaatttagaccactacctatttatcgtaaaggtttacttagtgttttagttgtagtggtattagcgatgggtattgcagcccctgttgttctgaaagtaacagaggatgcaacaaatcttaatatgaaagaagatgtctttcaaaagaatgtaaatacacatttgaaggaggttaatcataagtga

SEQ ID NO: 3483 - DNA, 1968 bp, Staphylococcus epidermidis
tggggagtgaaaaagatgagaattactgaactgttaactaaagaaacaatagcgatggatttagatgcttctgataaaagtggggtgattactgagcttgttaatcaattggataaagcaggtaagttaagtgaccctgtatcgtttaaagaggcaattcataatcgtgaatctcagagcacaacaggaattggtggaggtattgctataccacatgctaaagttgcagcagttaaaacacctgcaattgcattcggtaaatctaaagaaggtgtggattatcaaagtttagacatgcaacctgcacacttattctttatgattgcagcgcctgaaggtggagcacaaacgcatttagatgcgcttgcgaaactttctggaatattaatggatgagaaaatacgtgaaaaattaattcatgctgaatctcctgaagaagtgttaaacattatcgatgaagcggatgatgaggcaacaaaagaagaagaagcagaagcgaacgaaaatgcaactgtttcaactgacaactcaaatcaagataataatgagccatatgttttagctgttacagcatgcccaactgggattgcccacacatatatggcacgtgatgctttgaaaaagcaagctgagaagatgaacatcaaaattaaagttgaaacaaatggttctagtggtattaaaaaccatttaactgaacaagatatagaacgtgcaactggaataattgttgcagcagatgtccatgtagaaactgatcgttttgatgggaaaaatgtggttgaggttcctgttgctgatggtattaagcgtcccgaggaactaattaatacagctttagatacaaatcgtaaaccatttgtagcgcaaggtggatctaaaaaacatgacgataatgaagaaaagttaagcccaggaaaagcattctataaacacttaatgaatggtgtttctaatatgttaccacttgttatttcgggtggtatcttaatggcaattgtattcttattcggcgcaaactcatttaagcctgatagttcagaatataatgcatttgctgaacaattatggaatattggtaaaaatagtgcctttgctttaattattccaattttagctggtttcattgcacgtagtattgcagataaaccaggttttgcagctggtttagttggtggtatgttagctatttctggaggttctggctttattggtggaattattgctggtttcttagcaggttatttaactcaaggaattaaatatattacacgtaaattgccacaagcaattgaaggcttgaaacctactttaatctatccattactttcagtttcaattactggattgttaatggtgtatgtctttaatccgccagcagcttggttaaatcatttgctactaaatggtttaaatagtctgtcaggctctaatattatgttacttggtcttgtgattggagctatgatggcaattgacatgggcggtccatttaataaagcagcttatgtatttgctactgctgcattaacggaaggaaatgcagctcctattactgcagcgatgattggtggtatgattcctccattagctatcgctacagcaatgttaatctttagaagaaaattcactaaagagcaaagaggctcaattgtaccaaactatgtcatgggattatcatttattactgaaggtgccatcccattcgcagctgccgatccattacgtgtgattccttcaatgatggttggctcaggtgtggctggagcaattgctttaggtttaggatcaagtatcaaagcacctcatggtggaattttcgtcattattggtactgattttaaccatatacttcaaactcttattgctttagttgtgggtacgttagtttcagctttaatttatggtttcttgaaaccaaaagtaacagaaaatgaaattcaagcatctcaagctatggatgaatag

SEQ ID NO: 3484 - DNA, 789 bp, Staphylococcus epidermidis
atatttaagaacatttattgtttatataaaaaaggagttactatgagagacaaagacaatcaacattcgagattatattatattattttgacaatcgttattatcgcaatttgcgttgttgttgtaatactttttaatactttaaagacaaaccgttctcattctaccgatagatacgcagattttactgaattaaaaaaagatacgataaaaaataaagattggcgtattaaaacaaaacaccgtaaaaataaggatattttagtcactgcaattcacggtggaggtatcgaaccaggtacgactgaaattgcacgacgtatttccaatgttggaaaatataatttttatacctttgaaggtcttcgaaagtctaataacgatcaactacatgtaacatccactcattttaacgaacctatattagataagttacttaaaaacactaaagaaacattatctatacatggattctctggagatgaccctattgtttatatcggaggtaaagataaagagatgtctcactctatcacgaaagaattacgtaaaaaagactttactgtaaaagaaagtcctaacaaaatcgatgcaaagtcatcagataacatagctaataaaaatgaatctaactcaggtgtccaattagaactcacgactgcattgcgaaaacagtttttcaaacattataaattagatcgacatacacgtagtgattcagataaatatactaaagatttttacaaatttgcgaacgcagtgcaaaaaggtatcgaaaaggtaaattaa

SEQ ID NO: 3485 - DNA, 978 bp, Staphylococcus epidermidis
tttttaaagaaaaaattaaacaagggggcattgcttatggtcaatagaagaaagatatcaattattggcgcgggacatacaggtgggactctagcattcattcttgcacaaaaggaattaggagatattgtgttgattgaacgccagcaatcagagggtatggctaaaggaaaggcgttagatattttagaaagcggacccatttgggggtttgacacatctgtacatggttcagtaaatatagaagatattaaagattcagacatagtggtgatgactgcaggtatacctaggaaatcaggaatgacaagagaagaattagttcaaactaatgaacaaatagtacgagaaactgcattacaaattgcaacgtatgcacctcattcaataattattgtattgactaatccggttgatgttatgacatatactgcatttaaagcatcaggttttcctaaagaacgtattattggtcaatctggaattttagacgctgcaagatatcgaacttttattgctcaagaacttaacgtgtctgtcaaagatgtaaatgggtttgttttaggtggacatggtgatacgatgttacctttgattaataacacacacattaatgggattccagttaagcatcttatttctgaagaaaagattgatcaaattgttgaacgtacacgtaagggtggtgcagaaattgttgcattactaggtcaaggctcagcatattatgcaccagcaactgctatatatgaaactatagatgcaatttttaatgatcggaaacggttattaccaagtattgcttatctagagggagaatacggttgttcagatatttgtttcggagttcctactataataggatatcaaggaatagaaaagattatagaggtagatatgaataatgatgagtatcaacaactacaacactctgcgcaagctgtgagtgaagtcaaaaactcactaaaattcaaataa

SEQ ID NO: 3486 - DNA, 840 bp, Staphylococcus epidermidis
acgctaaagaaaaggggattatattctatgaaaaaattattcggaattattttagtattggctttaacgattgccttagctgcatgtggtggaggtaaagataaggaaaaaactatcacagtaggtgcatctccagcaccacacgctgaaattttagaaaaagcaaaaccattattgaagaaaaaaggttatgatttaaaaatcaaaccaattaacgattacacaacgcctaataaattattagacaaaggtgaaatcgatgcgaacttcttccaacatacaccatacttaaatactgaaagtaaagaaaaagggtataaaattgaatcggctgggaatgttgaattagaacctatggctgtatactcaaaaaaatataaaagcttaaaagatcttcctaaaggtgcaacagtatatgtatcaaataacccagctgaacaaggacgattcttaaaattctttgtagatgaaggtcttattaaacttaaaaaaggcgttaaaattgaaaatgctaaatttgatgacataactgaaaacaaaaaagatattaaatttaacaacaaacaatcagcagaatatttaccaaaaatctatcaaaatcaagacgctgacgcagtaatcattaattctaactatgcgattgaccaaaaattaagtcctaaaaaagattcgattgctttagaatctcctaaagataacccatatgcaaatttaattgcagttaaaaaaggtcataaagatgataaaaatatcaaagtattaatggaagtgctacaatctaaagaaattcaagattatattaaagataagtatgatggagctgtcgtacctgctaagtaa

SEQ ID NO: 3487 - DNA, 177 bp, Staphylococcus epidermidis
tttattaacctcgtctttcacgaatgtgtggatgtaaatgcattgtatttggtggatgctactattcaaaagttttatggcaaagattatgttttaaggtgtggtttgacagctattatattacgaatagaaattcttttagaatacatcaatcgacagtttattttgtatcaataa

SEQ ID NO: 3488 - DNA, 852 bp, Staphylococcus epidermidis
attcagtttgatagtagatttagttggtggaagttacttcatatatttgcttgtcaaaaggagaaatgcaaattgattcaaattcgaaatttagataaaacgatagacaataaacctattttaaaagatattagcgtagatattaaaaagggaaaattgacttcactcataggtcctaacggtgctggtaagagtacattattatctgctatcagtcgcttatttagttatgagaacggttcaattttgattgaagacaaagaaatttcagaatataaaactgacgatttagctaaaaaattaagtattttaaaacaatctaatcacactgatatgaacataactatcgagcaactagttaaatttggtcgttttccatattcaaaaggtcgaatgaagcaagaagactatgacaaagtggaatatgctcttgacttattacagcttaatgaaattaaacatcgtaatattaaaacactatctggaggtcagcgacaacgtgcatatattgctatgactatagcacaagatactgattatatattattagacgagcctttaaataatttagatatgaaacattcagtacagattatgcaaacgttacgagatttatgtcgtcagttaaataaaacaatcattatcgtattacatgatatcaactttgcttcttgttattcagacgacatcattgcgcttaaacaaggtgagctagttaaagctgatgataaagataatgttattcagtctgacattttaaaaagtttatatgaaatggaagtacgtatagaggagataaggggacaacgtatttgtctatattatgatgaaactacttttgactcagtttaa

SEQ ID NO: 3489 - DNA, 174 bp, Staphylococcus epidermidis
ttagagtttgagaggtgctatttaaaaatgaaaggaaaagagccttctaacaaatattttgataaaatgaagccttacttaatcactttgttatatttagctatttttatagcgctatatttaatttatggtagtggtgatacacaaaacaacttcatttataatgaattctaa

SEQ ID NO: 3490 - DNA, 126 bp, Staphylococcus epidermidis
atactgcttgatagaactaagttatttatatactataatatcatttatttcgtacaggtaaatatattaacattcataaaaaatattttatttgagacatacacatcattgtcgtttttatggtga

SEQ ID NO: 3491 - DNA, 186 bp, Staphylococcus epidermidis
acctgctctgatttttttgatgcttcattctgcatgtctccttatgttcctcctatatatttaaacaccattagcgttgttaaaaagagaaactttaatataattcaacctaattatattacttttatgttctttaaatgtttaaataatatgagctttaatttacaggatatgttagttttatga

SEQ ID NO: 3492 - DNA, 126 bp, Staphylococcus epidermidis
aaagaacctgaaacattaatcttgtctcagattcttttcacatattcacaattcataactgaggtgaaagtggtgctttcctattctagatattgttgccacagagaactcacacatttaatataa

SEQ ID NO: 3493 - DNA, 1272 bp, Staphylococcus epidermidis
tcaatgcatgaaagtataaaaatacatataggtaggtgccaaatgtttttattagttaatatcattggattatttattttcctaggtataggagttattttctctagaaataggaagaatatacaatggaaatctatttttattttggttattttgaatttgtttttagcttggttctttatatattttccatggggaagagcaggggttaaaggagcagctaacggtatagcatgggttatagaatccgcacatgagggtaccggatttgcatttaaaagcttcacgtctaataaaatgatggacatggcggtaagcgcgctcttccctattttattagttgtaccattatttgacattcttatgtactttaatatacttccaaaaatcattggcggtattggttgggtacttgctaaagttacacgccaacctaagtttgaatcattttttggtgttgaaatgatgttcttaggtaatactgaagctcttgcagtttctagtgaacaacttaaacgaatgaatgaaatgcgggtactaactattgcgatgatgtctatgagttcagtttcaggagcaattgtgggcgcttatgtgcaaatgatacctggagaacttgtattgacggcaattccacttaatattattaacgcaattatagtttcttgtattttgaatcctgtatcagttgaagaacaagaagatgtcgtgtatagcattaaagatcaccaaactgaaagacaaccatttttctcatttcttggagattcagttttagcagctggaaagcttgtattaattatcattgcatttgtcattagctttgtagctttggctgacttaattgatagattgattcatttaatcacacatcttattgcaaatggtattggtgtcaaaggtagctttggtcttgatcaaatcttaggcgttttcatgtatccatttgctttactattaggtttaccgtttaatgaagcgtgggaagtagcacaacaaatggcgaagaaaattgtaacaaacgaatttgttgtgatgggggaaatttctaatcaagtcaatgcgatgacgcctcatcatagagcagttatatcaacatttttagtttcttttgcaaacttttcaactattggaatgattataggtacattgaaaggtattgttgataagaaaacgtcggatttcgtttccaaatatgtaccgatgatgttgttagcaggaattttagtatccttacttactgctgcatttgttggattatttgcttggtaa

SEQ ID NO: 3494 - DNA, 1980 bp, Staphylococcus epidermidis
cgtaaaaatgattcattactaaaaacggaggaaacaaacatgagtttacccaagaagaaaataggaatttttgcgttcttcttattaacggtattcaccattactttgaagacatatttttcatattatgttgacttttctttaggtgtcaagggtttagtacaaaacttaatattgcttatgaatccctatagtttgattgcacttgtactaagtgttttcctattttttaaaggtaagaaggcattttggttcatctttattggaggatttttacttacgtttctactatacgcaaacgttgtgtacttcagatttttctcagatttcttaacttttagtacactaaaccaggcaggcaacgttgaatcaatgggtggtgcagtaagtgcttctttcaaatggtatgactttgtctacttcattgacactattatctatcttgctattttaatatttaaacgcaaatggttagataatagagcattcagtaaaaaattcgtacccgttgtgatggctacatcagtagcattatttttcttaaatttagcgtttgcagaaacagatcgtcccgaattattaacaagaacttttgaccataaatatcttgtgaaatacttaggaccatataacttcactgtttatgatggtgtaaaaacaatcgaaaataatcagcaaaaagcactagcttctgaagacgacttaactaaagtgctgaattacactaagcagaaacgtactgaacctaatcctgaatattatggtgcagcgaaaaagaaaaatataattaaaattcaccttgaaagtttccagactttcttaatcaataaaaaggtaaatggtaaagaggttacaccgtttttaaataaattatctagtggtaaccaagattttacgtatttcccaaactttttccatcaaacagggcaaggtaaaacatctgactcagagtttacaatggacaacagtttatatggcttgccgcaaggctcagcctattcactgaagggagataatacgtatcaatcattaccagctatactagaccaaaagcaaggttatacatctaatgtaatgcatggtgactacaaaacattttggaatcgagatcaagtttataaacatttcggtattgacaatttctatgatgctacttactatgacatgtctgacgacaatattgttaatcttggtttaaaagataaaccattctttaaagcatcagcagattatcaatctaaaatgaaaaagccgttttattcacacttaattactttaactaaccactatcctttcacattagatgaagaggatgcttctattgataaacctaataccggtgactcaacagtagacggttatatacaaacggcacactatctcgaccaagctttagaggaatatattactgaccttaagaaaaaaggtctatatgataactcagtcattatgatttacggtgaccattatggtatttctgaaaatcataataatgctatggaaaaattattaggtgagaagattacaccagctaaatttacagatttaaaccgcactggcttctggttaaaagttccaggtaaatcagggggcgtaaataaagagtatgctgggcaaatggatgttatgcctacattactacatcttgttggtattgatagcaagaattacctaatgtttggttctgacatgttctctaaacaacacaataacgtagtaccgtttagaaatggtgattttatcactgaagattataagtatgtgaatggtaaaatttactcaaataaagataatgaattgcttactgaaaaacctaaagacttcgataaaaataaaaaacaagtagagaaagatcttgaaatgagtgacagcgtgttaaatggtgacttgttcagattctacaaaaatcctgactttaaaaaagtaaatcctggtaaatatgaatataaatcaggtccaaaagggaacgaaaaaaaatag

SEQ ID NO: 3495 - DNA, 750 bp, Staphylococcus epidermidis
ttattgctcgaagtgaatcatttgaatttatttttgggaaaaaagcacattcttaaagatattacattctcattacctataaatggtgaaatcattggtattgtaggacctaatggtgccggtaaatcatctcttctcaaagcatttatcggagaatttaaagcgaccggtaaacatacattatatgatcaccctatacatacacaacttagatatattacatatatcccacaaaaagctcatattgatttagattttcctataaaagtggatcaagtgatactatcaggatgttatgaagacattggatggtttaaaaaagcaagtgtagttgaaaaaacgaaacttaaccaattacttaatgatttagaactcgaccatatacgccatcgacaaattgcagaattaagtggtggacaattgcaacgtgttcttgttgcaagagcacttatgagtaatagtgatatttattgtttagacgaaccttttgttggcatcgacatttatagcgaacaacttattatgaagaaaattaaacatttaagacatatgggtaaattgattttaattgttcatcatgacttatcaaaagcagatcaatattttgaccgcattttattattaaatcaatcgttgcagtttttagggccaacaaaagaagcattatcatctgaacgattaaatgcaactttcattaattacaaagatgattcgcttttaacactatcctcacaagggagtacgaattag

SEQ ID NO: 3496 - DNA, 342 bp, Staphylococcus epidermidis
atatttttagaggtgaatagaatggctattaagctgagttcaattgaccagtttgaacaagtattagaagaaaataaatatgtttttgtattaaaacacagtgaaacttgtccaatttctgcaaatgcgtatgatcaatttaataagtttttatatgaaagagacatagatggttattatctaatcgttcaacaagagcgtaaactatctgattatatcgcagagaaaacaaacgtaaaacacgaatcaccacaagctttttattttgtagatggtgaaatgaagtggaatgcagaccacgatgatattaacgtttctcaacttgctcaagctgaggaataa

SEQ ID NO: 3497 - DNA, 828 bp, Staphylococcus epidermidis
ggagacttagatatgtcagatttattccaaaacgcaccaccctatattcaggcgcttatagccggaataatcacgtggttacttactgctttgggtgcggcagcagtttttatatttaagaaagtgaatgataaagtcttaaattcgatgcaaggttttgcagctggaatcatgatagcagcaagtttttggtcattgttacaacccgcaattgaatcgagtgaaaatagtgctatgccatggcttcctgcagcaataggttttattctcggtggcgtttttatcagggttctagattatattattccccatattcaccaaaatgcccaagataaaaaccaacaacaagagggtgtgcctacctctcttggaaaaaatgcattacttgtgttagctatcacacttcacaacatacctgaaggactatctatcggagttgcattcggtggtgttgtatctggcaacagtcacgctacatttttaggtgcgattggtctagcgataggtatcggcatacagaatattcctgaaggtgcagcactatcgatgccaatccgtgctgcaggtgcaacacgttggaaagcatttaattatggacaagcttcagcaattgttgagcctattttcgctactatcggtgctgcagcaattttagtggtaaatcctatattgccttatgcattggcgtttgctgcaggtgcaatgattttcgttgttgttgaagaactgatacctgattctcaatcaagtaacaacactgatttggcaactttaagtctaatgattggttttacaattatgatgattcttgacgttgcacttggataa

SEQ ID NO: 3498 - DNA, 288 bp, Staphylococcus epidermidis
atgttgagcctctacgtgatgaagactttgtttttgataattaatatagtacttttaaagagatttctattaaaattagtaggaatctctttttttatgaaagttggtattataaaatattttgatgtattattactgctggataaaacatttataaaattcccaaaaaatatgaaaaaactattgaaaaaagaaaatagagtctataatattgatgttaatgataatcattatcattatcattatcattactttcgtatattgaccttatacatctttaatatttag

SEQ ID NO: 3499 - DNA, 1287 bp, Staphylococcus epidermidis
tacctcctagaggggaaactcatatatagaaaggtcgtgactataatggccgaacattcttttgatgtcaaggcagtcattaaagactttccaatacttgagcaaaaggtaaataataaacgtttagcataccttgattcaactgcgactagccaaacacctgtacaagttttaaatgtactagatgattactacaaacgctataattctaatgtccatcgtggtgtacacacattagggtctttagctacagatggctatgaaaatgcaagagaaacagtaagacgttttatcaatgcgaagtactttgaagaaattattttcactcgaggaacaactgcatcaataaatatagtagcacatagttatggtgacgctaatattagtgagggtgacgaaattgttgtaacagaaatggaacatcatgctaatattgttccatggcaacaattagctaaacgtaaaaatgcaacactaaaatttattccaatgacaaaagatggtgaattgcaattagatgatataaaagcaaccatcaatgataaaactaaaattgttgctatcgcacacgtttccaatgttttaggaacaattaatgatgttaaaactatcgctaaaattgcacatgaacatggtgcagttataagtgtggatggtgcgcaatcagctccacacatggctttagatatgcaagatatcgatgctgatttttatagttttagtggacataaaatgttaggtcctactggcattggagttttatatggaaaaagagaattattacaaaatatggaacccgttgaatttggtggagatatgatagacttcgtaagtaaatatgacgccacttgggctgacctaccaactaaatttgaggctggcacaccacttattgctcaagcaataggtttagcagaagctatacgttatattgaaaatttaggttttaatgcgattcatcagcatgaaaaagaattgacagaatatgcatatgaacaaatgttaactatagatggtcttgaaatttacggtccaccaaaagatagacgtgcaggggtcattacttttaatttagcagatatacatccacatgatgtagctacagctgttgatacagaaggtgttgcagttcgtgcaggccatcactgtgcgcaacctttgatgaaatggttaggtgtttcttcaacagcacgtgcaagtttttacgtttataatacgaaagaagatgtagatcaattagttcaagcattgaaacaaacgaaggagtttttctcttatgaattttaa

SEQ ID NO: 3500 - DNA, 159 bp, Staphylococcus epidermidis
aaggatatagaagcgcatttgttaagtataaacctacaaatgcgcttcttttttattgtatttagattgttcattactgtttcaaaatatctttctttaaatcatttgttaaatgtcagtattttaattttatactataacacctatgaattgaaatga

SEQ ID NO: 3501 - DNA, 984 bp, Staphylococcus epidermidis
ataagaatagaaaaaagggttaggaagggtgagtgttcaatgagctttgcatcagatatgaaaaatgaactaacacgcatagaagttgacgaatcgaatgctaaagcagagctcagtgcattaattcgcatgaatggcgcacttagtctatcaaatcaacagtttgtaattaatgtacagacagaaaatgcgacaacagctcgtcgaatttactctcttatcaaacgtatatttaatgttgaagttgaaattttagttagaaaaaagatgaaattgaaaaaaaacaatatttatatatgtcgaacaaagatgttagcgaaagaaatactaaatgatttaggaattttaaaaaagggagtttttactcacgatattgatccggatatgattaaagatgatgaaatgaaaagaagttatttaagaggggctttcttagcaggtggttctgtaaataatcctgaaacatcttcatatcatcttgaaattttttcacaatatgaagatcattccgaaggtcttactaaattgatgaatagttatgaactcaatgcgaaacatttggaacgtaaaaaagggagtattgcgtatcttaaagaagctgaaaaaatttccgactttcttagtttgataggtggctatcaagcattgttaaagtttgaagatgtaagaattgtccgtgatatgcgtaattcggttaatcgtcttgttaattgtgaaacagcaaattttaataaaactgttagcgcagcaatgaaacaggttgaaagtatacaattaattgatgaagaaattgggcttgaaaatttacctgatcgtttaagagaagtagcgaagctcagagtagaacatcaagaaatatcgttaaaagaattgggtgagatggtttctacagggcctatatctaaatcaggtatgaatcaccgtttaagaaagttgaatgaattagcggataaaataagaaatggtgaacaaattgaattataa

SEQ ID NO: 3502 - DNA, 765 bp, Staphylococcus epidermidis
gatatgtcagattcaatcactatcattgatgaaaataaagtgattgatgtagtcttaattgctgggcgaatcttacttgaagcaggcgctgaaacatatcgaattgaggatacaatgaatcgtattgcccatagttatggtttacatgatacatacagttttgtgacatcaactgcaattattttctcattaaatgatcgtactagtacgaagttgattcgtattcgcgaacgtacaaccgatcttgagaaaattgctttaaccaatagcctatctcgtaaaatttcgagtaagcaacttacaattgacgaagcaaaaagtgagttactgcaacttaaacgtgcgtctcttcagtattctttcttaacaaatctcattgctgcctttgtagcttgtggttttttcttattcatgtttggtggcgtagcttccgacgcttggattgcatgcctagcgggtggcatagcttttttaacgtttagtttcgtgcaaaaatatatacaaattaaattcttttcagagtttgtagcatctgctgttgttattagtattgcagcaatattcactaaactaggtatagctaaaaatcaagacattattactattgcaagtgtcatgcctctcgttcccggtattttgattactaacgctattcgtgacttacttgccggagagttacttgctggtatgtcacgtggtgttgaagctgctttaactgcatttgctattggtgcaggagtagctattgtattactattattataa

SEQ ID NO: 3503 - DNA, 168 bp, Staphylococcus epidermidis
tcagttaaagaaattctattatcagctaacgtcttatttgtcacaagaccagtaaaccaacttgctggtaaaaataaaaatataataaatatgacgccactgattataatgggtaagaatggtttcagtttcatcgtaactcttctaaagcttctacaattttattag

SEQ ID NO: 3504 - DNA, 1308 bp, Staphylococcus epidermidis
gactataaagaaagagacaatttggcttgtcatatgtttatagcctttatctacattgttggttggttaaaatattatgaaagcttaggtgaattagagatggctcaagatcgtaagaaagtgctcgtattaggtgcaggttatgctggtttacaaactgtaactaaattacaaaaagaactttctgctgatgcagcggaaattactttaattaataagaatgaatatcattatgaatcaacttggttgcatgaagcttctgccggtacgattaattatgaagatttattgtatcctgttgagaaaactgtcaacaaaaataaagtgaattttgttgttgctgaggtaacaaaaattgatcgtaatgctaaacgtgtagaaactgataagggtgtttatgactttgatatcttagttgttgcactaggttttgttagcgaaacatttggtattgatggtatgaaagaacatgctttccaaattgagaacgttttaacttctcgtaagttgtctcgtcacattgaagataagttcgcaaattatgctgcttctaaagaaaaagatgataaagatttatctattttagttgggggagctggatttacaggaattgaatttctaggtgaattaactgatagaattcctgaattatgcagtaaatatggtgttgatcaaagtaaagtgaagttaacatgtgttgaagcagcacctaaaatgttaccgatgttctcagacgacttagttagttatgcagtaaaatatttagaagaccgtggagtagaattcaaaattgcaacacctattgtcgcttgtaatgaaaaaggtttcgttgttgaagtcaatggagaaaaacaacaattagaagccggaacttctgtatggactgctggagtgcgtggaagtcatttaatggaagaatcatttgaaggtgttaaacgtggacgtattatcaataaacaagatttaacaattgaaggtcataatgacatctttgttataggagattgttcagcgtttattccagctggtgaagagcgtccattaccaacaacagctcaaattgctatgcaacaaggtgagcatactgctagcaacattaaacgtttattaaatggtgaatcaacacaagatttccaatatgttaaccgtggaactgtatgttcattaggtgctaatgatggtgttggaattgtatatggtagagatatcgctggtaaaaaagcagcattcttgaagaaagttattgatactcgtgcgatttacaaacttggtggcataggattagcctttaaaaaaggaaaattttaa

SEQ ID NO: 3505 - DNA, 123 bp, Staphylococcus epidermidis
ttaaaaaaagataaataccttacaaaatggattattaccgtttttcatttattaaaagtgttattcaaaccgagagattttcatttatctatgtttaataaaatgattgttactttaaactga

SEQ ID NO: 3506 - DNA, 192 bp, Staphylococcus epidermidis
atggctgaagataaatttgaacaagctaaaggtaatattaaagaaacagtaggtaatgctactgataataaagaattagaaaaagatggtaaaggtgacaaagcttctggtaaagcgaaagaagctgtagaaaacgttaaagaaaaagcaaatgacgttattgataaatttaaaggtaataaaggtgactaa

SEQ ID NO: 3507 - DNA, 141 bp, Staphylococcus epidermidis
acgaggggagacatattgaatatttacattgccatcgtattaggattaatttttgtattcttatctgatatggattatagaaggagaaacaatagtacaaatatggataagaaaatgataaagattagcttttttacatag

SEQ ID NO: 3508 - DNA, 1791 bp, Staphylococcus epidermidis
atggttctggagaaacagaaattgactttactttacacgcaacgaaatggtgttactcgtagacgtaaaatggtttttgaaggtgtgatacctaacattgaccgtcgttaccatgaatctccctctgaatatacacgcgaaatgatgagtaaatatatgacagagttaccgtgtgaaacttgtcatggcaaacgcttaagcaaagaagcgttatctgtatacgtaggcgactataatataggtgaagtcgttgaatattcaattaaaaacgcgctttattatttcgaaaatttaaaattaagcgaccaagataaatcgattgcagatcaaattttaaaagagattatttcaagattatcatttttaaataatgttggtttggaatatttgactttagatcgctcatcagggactttatctggaggggaagcacaacgtattcgtttagcaacacaaattggttcacgattaaccggagtactatatgttttagatgaaccttctattggattacatcaaagagataatgatagattaattaatactttaaaagaaatgcgtgatttaggtaatacacttattgtcgttgaacatgacgatgatactatgagagcagctgattatttagttgatgtgggtccgggagctggtaaccacggtggagaggttgtctcaagtggtacccctaataaagtaatgaaagataaaaaatccttaactggtcaatatttaagtggaaaaaaacgaattgaagtccctgaatacagacgagaaatcaccgatagaaagattcaaattaaaggtgctaaaagtaataatttgaaaaatgtaaatgtagacttcccactatctgtcttaactgttgttacaggtgtgtcaggttctggtaaaagttcactcgtcaatgaaattttatataaagcattagctcaaaaaattaataaatctaaagtgaaacctgggaattttgatgaaattaaaggaattgatcaattagataaaatcattgatattgatcaatcgccaataggtagaacaccacgttctaacccagccacatacactggtgtctttgatgacataagagatgtctttgcacaaacgaatgaagctaaaatacgaggttatcaaaaaggtagatttagttttaatgtcaaaggtggacgatgtgaagcttgtaaaggtgatggaattataaaaattgaaatgcattttttaccagatgtctatgtaccttgtgaagtatgtgatggtaaacgctataatcgtgagactttagaggtaacatacaaaggtaaaaatattgcggatgtattagaaatgactgttgaagaagctacgcatttctttgaaaatattcctaagattaaacgtaaattacaaacacttgtagatgttgggttggggtacattactttaggtcaacaagctactacattatctggtggcgaagcgcaacgtgtaaaactcgcatcagaattgcacaaacgttcaacggggcgttctatttatattcttgatgaaccaactacaggattacatgtcgacgatataagtcgtttattaaaggtattgaatcgtatagtggaaaatggtgatacggtcgttattatcgaacacaatcttgatgttattaaaacggctgatcatattattgatttaggtccagaaggcggtgaaggtggaggaacaatcatcgcaactggtacacctgaagagattgctcaaaataaagggtcttacactggtcaatacttaaaaccagtattagagagagacagcgttgaatag

SEQ ID NO: 3509 - DNA, 243 bp, Staphylococcus epidermidis
ttaattatggaatttagagaacaagtattagatttattagcagaagtagctgaaaacaacattgtgaaggaaaacccagatgtagaaatctttgaagaaggtattattgattcatttcaaactgtaggtttacttttagaaattcaaaataaattggatattgaagtgtcaattatggactttgatagagatgagtgggcaactcctaataaaattgtagaagctttagaagagttacgatga

SEQ ID NO: 3510 - DNA, 402 bp, Staphylococcus epidermidis
attaatcaggaggggattctcgtggcagtaccgagcgaatttaaatattctaaagagcatgagtgggttaaaattgaaaataatgtagcaacaattggtattacagaatacgcacaaaacgaattaggtgatattgtatttgttgagctacctgaaactgacgatgaattaaatgaaggtgacacattcggtagtgtggaatcagtaaaaacagtatcagagttgtatgcgccaatttctgggaaaattgttgaagttaatgaagaattggaagatagcccagaatttgtaaatgaatcgccatacgaaaaagcatggatggttaaaattgaaattagtgacgatagtcaattagaagaattattatcagcagatcaatactcagaaatgattggtgaataa

SEQ ID NO: 3511 - DNA, 336 bp, Staphylococcus epidermidis
ttcttcaaggaggacacatcattggcaaaggtttatggatcactcatagataatgaaacacgatgtacacattattattcatctttagatgttattgccattaaatttaaatgttgcaacaaatattatccgtgttataaatgtcataatgaacacgtatctcatacaattgaaagatgggctgaaaatgagtttgatgaaaaagctattatgtgtggtgtttgtaaacatgagatgcgtattcgtgactatatgatggtagaaatgtgtcctcgttgtaaagcgcattttaacagtcgttgtaaatttcattatcatttatattttgaagtataa

SEQ ID NO: 3512 - DNA, 951 bp, Staphylococcus epidermidis
acaaaaaaggagcgctttaacgtgaaaaaaattctcgctttagcaatagcatttttaattatccttgccgcatgtgggaatcacagtaaccatgaacatcactcacatgaaggaaaattaaaagttgtaactacaaactctattctctatgacatggttaaacgtgtcggtggaaataaggtcgatgttcatagcatcgttccagtaggacaagatccacatgaatatgaggttaaacctaaagatattaaagcattaacagatgctgacgttgtattttataatggtttaaacctagaaactggaaatggttggtttgaaaaagcacttgaccaagcaggaaaatcaacaaaagataaaaatgtgatagcagcatcaaataatgttaaaccaatatacttaaatggtgaggaaggtaacaaaaacaaacaagatccacatgcatggttaagtttagagaatggaattaaatacgtaaaaacaatacaaaaatcactagaacatcatgataaaaaagataagtctacatatgaaaaacaagggaatgcatatatatcaaaattagaagaacttaataaagatagtaaaaataaatttgatgacatacccaaaaatcaacgtgccatgatgacaagtgaaggtgcatttaaatattttgctcaacaattcgatgttaaaccaggttatatttgggagataaacacagaaaaacaaggtacacctggtcaaatgaaacaagccattaaatttgttaaagataatcatttaaaacatttattagtcgaaacaagcgtagataaaaaagctatgcaaagtttatcagaagaaactaagaaagatatttatggtgaagtatttaccgactctataggtaaggaaggtactaaaggtgactcatactataaaatgatgaaatctaatattgatacaatacatggtagtatgaaataa

SEQ ID NO: 3513 - DNA, 711 bp, Staphylococcus epidermidis
aatttaagggagtattttattatgaaatccactgcgcaattaacaaaggagaataatgtcaaagctttgcgactgaacaataccgatcgtgaaatatttgaaaattacatgacatatgtgcgtgctgacttacgagttaaccctcacgattcagaattaatgttaaaccgtactttgaaacacttaattcgtgcaggtgatactggaatgcttgcgatggagtttttcaaccatgatcctaaagcacatgctaaaaaagagataagggaactcccaaatgaaacatttaaaaacatttttaaatatataagtcataacttcattcttttaataggtattttttgttttctcaaaggattgattggcttttttatagggggcgatagtaatttactatatttatatacgtttcccctaactgtcattattggtttagtaattatatttttatttatttggatgaactttaaaacggtacaattacagtgctttaacaactcttattggacctggtggctcacctatggtgtcatcgcattattattaatcactcttttttatgttttttttataccgcaatcatttttagcgtttggaccatatattaaagttagtaattggactttcatcattattgcgataataatcatccctatttcattttatgtgaatcatcacttttataataaagaagcaaatacacgcatataa

SEQ ID NO: 3514 - DNA, 1011 bp, Staphylococcus epidermidis
aagtggagggagataatgaaacaaatgaatgtagtacttattggtggtggcactggactttctgtccttgctagaggccttagagaatttccaatagacattactgccattgttactgtagcggacaatggtgggagcacggggaaaattagagatgtcatggatattccagcgcctggtgatattcgtaatgtcattgctgctttaagtgactcagaatcgatattaactcaattgttccagtaccgttttggtgaaaatcaagtagatgggcattcattaggtaatttagttattgctggaatgactaacattactaatgattttggacacgctattaaagagttaagcaaagttttaaatattaaaggccaagtcatcccttcaacaaacgcaagtgtgcaactcaacgcggtgatggaagacggtgaaattgtacatggagaaactaatatacctaaaacacataaaaaaatagatcgtgtgtttttagaaccaagtgatgttgaaccaatgaatgaagcgatagaagctttagaacaagcagatttaattgtcttaggaccaggttcattatatacaagtgttatatcaaatttatgtgtcaaaggtatttcagaagcattattacgtacatctgctccaaaactttatgtatctaatgttatgacacaaccaggcgagactgataattatgatgtcaaagagcatattgatgcacttactcgacaagttggtgaaccatttattgattttgtcatatgtagctcagaatcctatagtaaagatgttttacaacgatatgaagaaaagaattcgaaaccagtagcagtacataaagaacaattaaaagatagtggaattagagttttaacggcatctaatttagttgaaatatctaatgaacactatgtcagacataacacaaaagtattatcaaaaatgatttatgaacttgccttagaattaacaagtacaattcgctttactcctagtgataaaaagaaataa

SEQ ID NO: 3515 - DNA, 1014 bp, Staphylococcus epidermidis
aatggtctactattttgtagagggaatgaaggtgaaaaagtgattaaatttaaaaatgtcacaaagcgatatgctaataatattgctgtagataatgtaagttttaatattaaagaaggagaattttttgtgttaattggtccttcaggttgtggtaagacaacaacacttaaaatgatcaatcgtttaattcctttaagcgaaggttacatatattttaaagataaaccaattagtgattatccagtttacgaaatgcgttgggatattggatatgtactacaacaaattgcattatttcctcatatgactatcaaagaaaacattgcacaagtaccccaaatgaaaaagtggaaagataacgatattgatttacgtgtggatgaattattgacaatggtaggtttaaatcctgagcaatttaaaaatagaaaacctgatgaactatcgggtggacaacgacaaagggttggtgtagtgcgagcattagctgcagatcctcccgttattatcatggatgagccttttagtgctcttgacccaattagcagagagaagttgcaggacgatttgattcatttgcaaactcaaattaagaaaacaatagtttttgtaacgcatgatattcaagaagcgatgaaactaggtgacagaatttgtttactcaatgaagggcgtgttgaacaaattgatacacctgatagttttagaacgcgacctaaaagtgactttgtaaagcaattcatgggtagtcatttggatacaacgcataatattgtgaatcaagtgaagattaaagatttaggaattaatcggtctgtagatgacaatgcaagcgttattcattatcctgaagtagatgctgagttgtacttaaataatatttatgaagatttgtctcattatgatgcagttgtggtcaacgataaagaacaacatcgtcgatatttgttaaatagagaagatgtgtttacttatttatctcttaataaggaggaagcgacacatgaatga

SEQ ID NO: 3516 - DNA, 1125 bp, Staphylococcus epidermidis
ggtatgagtttgtttataataggtactaagttttttaaaatttcagtcaatttaaggtgtgatttatgtatgaagaaacaattagaccaattaacagcatatacgccagggctttctccagaatctttaaaaaaacagtatggcattaaaggtgaattacataaacttgcttcaaatgaaaatgtatatggtccaagtccaaaagttaaaacggctattcaatctcatttagatgaattatattattatccggaatctggatcgccaaaattaagggaagcaataagtcaacaacttaatgttgatgcatctcgtattttatttggtgcgggtttagatgaggttattctaatgatatcaagagccgtattatcaccaggagataagattatcactagtgaatctactttcggacaatattatcataatgcaattgtggaatcagctgatgttatccaagtgcctctcaaagatggtggatttgatttagatggtatgttacaacaaattgataataaaacgtctttaatttggttatgcaatcctaacaatccaactgggacttacttttcgcacgatgaattatttaatttcttaaaacgtgtcccaagtgatattcctgtattaattgacgaagcatatgtagaattcgttactgctgatgattttccagatacgctaaaattacaggaggattttgacaatgcctttttattacgtactttttctaaggcatatggattagctggattaagagtaggatatgttatagcctctgaagacgccattgaaaagtggaatatcattcgtccaccatttaatgttactagaatttcagaatatgcagcaatcgctgccttagaagatcaagagtatttgaaagaagtgacacaaaaaaatagttttgaacgagataaattttatcaaattcctcaaagtcagcattttttaccaagtcaagcgaattttgtctttgttaaaacttcaagaagtcaagcactttatgatgcattgttaaacgtaggatgtattacacgtttattccctaacggtgttagaattactattggtttaccagaacaaaataataagatgattgaagttttaaaacattttgagtattaa

SEQ ID NO: 3517 - DNA, 192 bp, Staphylococcus epidermidis
ttgaagcaacttattataagccaactttcaactcagtcatcgtctgccattatattgaaaaattttgagcagaggattactcctttatactcatcatactatataactagtagtcccatatcgtgtggttttatattaccctcctataatataaacaacatcttttacacacgatatggtggtattagttag

SEQ ID NO: 3518 - DNA, 960 bp, Staphylococcus epidermidis
ttacacaaactatttatcgaaagtaggtatatatttatgaaacaaccgtataaccatggtgttcttttctatcatgaacatagcggtttgaaagatatacataatggcataggagaagttgcaaaatctcttagttcaatgtgtaaacacctctctcttcaactcagtgaaaataaaggcgatattattaaatattgtaaatctattaaaaatgaaaattatagctctgatgtagacgttttatttattttaggtggagatggtacacttaatgaactagtaaatggcgttatgcagtatcagttaaatttaccaatcggtgtaataccaggtggtacctttaacgattttacaaaaacacttcaactgcaccctaattttaaaacagctagtgagcaattattaacatcacatgctgaatcatatgatgtgttaaaagtgaacgacttatatgtacttaatttcgttggacttggcttaatagtacaaaatgcagagaatgttcaagatggttctaaagatatattcggtaaattcagctatattggatcaaccgttaaaacgttattaaatcctgttaaatttgatttctcattgactgttgatggtgaaacaaaagaaggcaatacttcgatgatgttaatagcaaacggtcccaatataggtggtggacaaattccgctaaccgatttatcgccacaagatggaagagcaaacacatttgtatttaatgatcaaacactaaatatattgaatgatatattaaaaaaacgtgatagtatgaattggaacgaaatcacacaaggtattgatcacatatcaggtaagcacatcacactctcaacaaaccctagtatgaaagtggatattgatggcgaaattaatttagaaacaccaattgagattcaagtattacccaaagcgatacaacttcttactgcaactgaacaaaataattaa

SEQ ID NO: 3519 - DNA, 126 bp, Staphylococcus epidermidis
agtcaaaaactcactaaaattcaaataaataattatgaagttctacatcttaaattgttagatttttgtgaaaattgtgtaaagggtattttttcgttgatttataaaagcgctttcttgatataa

SEQ ID NO: 3520 - DNA, 246 bp, Staphylococcus epidermidis
gttaattcttgtaaaattaaattctgtcgtttttctgatatcactgctatacctcccctaattcacttatattgtaatggctacgcttacatatttcaatcaaaatcttccattttcaatcaaaaacaatcattttatgacaaaaataaaaacacctttcagattaggtgtttgaaatggattgtatcatcacactttaagacgtacattttaattttcagaaatcattttctaagtattaaataa

SEQ ID NO: 3521 - DNA, 132 bp, Staphylococcus epidermidis
ttaatctcttgtgcatatataatgattcattataaactcagtatttcttatgttcatcagtctccaggacgattcaatttaagttccaaaactgatggacagggcacaagactacttattttttatttatag

SEQ ID NO: 3522 - DNA, 1125 bp, Staphylococcus epidermidis
tataatgattggaaatttaaagatggtgaaaaaatgagattgataattaaaaagatttatatcatagctattgtgcttttaaatatggtttttaaaccgtttaatataaattcgaagcacattgtgataatgatgacctttaagcaagatatactgcctattatagaggccttatgtagtgaaggataccatgtgacggttataggtaaaaaaatatatcagaaagatattaataacattaatcatgcatattttatacctgccggaaataaatatattatgagacatatgaaagtattaagtaaagcaaaggttattattttagatacgtattatttaatgatgggtggctatcagaagaaaaaagggcaaactgttattcaaacatggcatgctgctggtgcgcttaaaaattttggcttaactgatcatcaagttgatttaaaaaataaggctatggtaagacaatacaaaaaagtttatgatgctaccgattattatttggtaggtggggagaaaatggctcaatgttttatacaatcgtttgatgcatctccatcgcaaatgttaaagtttggacttccaagactgacccaatactttagaagcaatcttaagttagaacaacaacgattaaaaaagaaatatcatattacaaataaactcgcagtatatgttccgacttatagagaaggtcaagtagcacaacgtactattgataaagaaaactttgaacggcacttgccgaattatacgttattgagtcatttgcatccttcgactgttgattgtcaaacttctcattcaatcgatgttacttcattgttaattatggcggatattattataagtgattatagctcattacctattgaagcaagcgcacttaataaaccgacacttatttataattatgatgaacagcaatatgaaaaagtaagaggattgaatgaattttattatgctattccagaacgatacaaaatgagtaatgaagagtcaattatacaagcgatacaggataacgatgagcaatttcaatctttatttaatgattggcatcaatataactcaaaagatagtcttaaccagttagttcattttattaataagttggtgaaataa

SEQ ID NO: 3523 - DNA, 153 bp, Staphylococcus epidermidis
attagaagttgctataatgatattctcaattctatattagactgtctgaaaaatatggctaatccaatcacttatgacctaagatcaaaagatgtttcacattatatattgtctacaaataaaaaaaggctggggcaaaaagttccaggataa

SEQ ID NO: 3524 - DNA, 681 bp, Staphylococcus epidermidis
gaatatagactaattttaatattaaggaggtgtcttattatgggaatgcatcaatattttaaaagactatcagatttagaaaaattaataagattaccaggtaaatttaaatattttgaacacaatgtcgcagctcattcttttaaagtaactaaaattgcgcaatatatggctactgtcgaagaatatcatggaaataaaatcgattggaagagtctttatgaaaagtcactcaaccacgactttgctgaagtgtttacaggtgatatcaaaacaccggtaaaatacgcaagtaaggaattaaaacatttattctcccaagttgaagaagaaatggtcgatacgtttatcaaagaggagataccaacacaatatcagcacgtgtatcgtgaacgtttacaagaaggtaaagatgattctctagaaggtcaaattctatctgttgctgataaaattgatttattgtatgaaacatttggagaaatacaaaaacgtaatcctgagccactattttttgaaatatatgaaatgagtttagaaactattatacaatttgatcacttagaatctgtaaaagattttattgaaaatgttatacctgaaatgctcacagaaaactttattcctcgaactgaattacgtgaaacaacaatgtcaattctaaacagaagaaatgggtga

SEQ ID NO: 3525 - DNA, 258 bp, Staphylococcus epidermidis
aaggagacatgtcacatgcctactgagaatccaacaatgtttgatcaagtagcagaagttatagaacgtttgcgtccattcttattacgagatggtggcgattgtacgcttgtagatgttgaagatggtattgttaagctacaattacatggcgcttgcggaacatgtcctagttctacaattaccttaaaagctggcatcgagcgtgcacttcatgaagaagttccaggtgtaatagaagtagaacaagtattctaa

SEQ ID NO: 3526 - DNA, 1050 bp, Staphylococcus epidermidis
agatttaaatgtagctattgcagaattagaaaaataaaatatcatctatctgtttttgaaattaatagaggtgtgcatatgaataaaatactcgtaacacgtcaaattccacaacactacgtagagcaacttaaaaaaataggacaagttgtcatgtgggaacacgatttaacgcctatgtctagagaatcatttcttgctaacgttgaagatgcaacagcatgtgtgatcacattgagtgagcatattgatgaagaagtatttctcagggcacaacaacttaaagtgattgctaatatggcagtaggttttgacaatattgatatttcattagcaaagaaacatggtgtagttgttaccaatacacctcatgtactgacagagacaactgccgaactagggtttacattgatgcttactgtagctcgtagaatcattgaagcgacatcatatattcaaaagggtaagtggaaaagttggggcccctacttattatcaggaaaagatgtatacggtgcaactgttggtatttttggaatgggtgatataggaaaagcgtttgcacgtcgcttacaagggtttgatgcacggataatatatcacaatcgcaaacgtgacttaaatgctgaaagagatttaaatgctacatatgtaacgtttaaatctttacttgaacaaagtgattttattatttgcacagcacctttaactaaggaaactgagaatcaatttgatgctcgagcttttaataaaatgaaaaatgatgctgtcttcattaatattggaagaggtgcaattgtagatgaggaagcacttttagaagcgttaaaaaatcatgagatacaagcctgtggtttagatgttatgcgtcaagaacctattcaacctaatcatccaatactgaaattacctaacgctgtggtgttacctcacataggaagtgcatcccaagtcactagaaatcgaatggtacaactttgtatagataatattaaagcagtattaaataatgatgcaccaataacccttgtaacctctttacacttttaa

SEQ ID NO: 3527 - DNA, 174 bp, Staphylococcus epidermidis
cacccaaaatgttgcaaactatgtaattttaacattcaacttctcatgtacgtaactatgttcttcgtagttgatattataacattttttatcagaacacacgcaaaagattatttattagtacaaaaaattgcacgtcatctatttttattttctgtcacctttctgtgttaa

SEQ ID NO: 3528 - DNA, 1104 bp, Staphylococcus epidermidis
ttctcactgtgcaactctaaggaggtaaatattcacatggggctgaataaagaagctataaaaattggttttgcctatgtcggcattgttgtcggcgcaggattttcaacaggacaagaagtgatgcaatttttcacaccatttggtttatggtcatatattggagtgattatctcaggatttatacttggattcataggaagacaagtagctaagataggtactgcatttgaagcgaaaaatcacgagtccacattgcaatatgtgtttggaaaaaaatttagtaaagtttttgattatattcttgtctttttcttatttggtatagctgtcactatgatagccggatcaggttctacttttgagcaaagttttggaattcctacttggttaggcgcattaatcatgacagttttgatttacttaacattattattagattttaataaaattgtaagagctttaggactagttacaccatttttaatcataatggttattcttattgctgtgttttacctatttacaggtagtatttcattaggggaagtaaacagtgctatgcctgaaacgagtgcttggaaaggtatcttttggggattagtatacggcggattagcctttgctgtaggatttagtacgatagtagctatcggcggtgatgcgtctaagcgaagagtttcaggtgcaggagcaatgtttggtggtgtgctatacgctatcctacttgcgttaattaacttctcgcttcaaacagaatattcaaaaattaaagatgtggcaatacctacgcttaacctagcgaaaggtatacatccatggttaggtcttgtactcacagtcattatgttagctgtgatgtacaacacgattttaggtctttgttattcttttgcagcgcgtttcacagaaccttatagtaaaaaataccatatattcattattatcatgatggtgatggcatttattttaagtttcgtaggattcgctgatttaatcaatgtcttatacaaatttatgggtattgtcggattatttattgtagtagcagtattgattaaatattataaacgtaaaaaagatgatgaagagcatatcgcgtaa

SEQ ID NO: 3529 - DNA, 834 bp, Staphylococcus epidermidis
gagaaagcgtggttaagtttaatgttcgcagttggaacggttttaaaagaacatattaaaaacttctatttaattcaaagactagcacaattccaaattaaaattaccaatcataataactatctaggtattgcatgggaagtgttgaatcctgctttacaaatcatggtgtattggcttgtttttggtttaggaattagaagcaatgcacctatacacggcattccgtttgtattttggttgttagttggtataagtatgtggttctttattaatcaaggtgtcctagaaggaactaaatcaatctcacagaaattcaatcaagtggcaaagatgaatttcccactctcaatcattcctacttatattgtaacaagtaggttctatggtcatttaggattattagcaattattataatagcttgtatgttcaatggaattatcccttcaattcacattgtacaattacttatatatgtaccttttgcatatttgctaacatcgtcggtggcacttttaacatccactttggggattttaattagagatacgcagatgattatgcaagcattaatgagaatattgttttatatgtctccaattttatgggtgccaaaaaatcacggcgtaagtggtttgattcatcaaattatgttatttaatccagtatattttatcgcagaatcataccgagcagcgatattgttccatcaatggtatttcatagatcattggaagttaatgctatataacgttattatcattctcttattctttatagtaggttctattttacatagacgctatagagatcactttgcggacttcttgtaa

SEQ ID NO: 3530 - DNA, 132 bp, Staphylococcus epidermidis
tattgcaagtgtaaagaggttagattttgtcccaggtgggacttaaaaagtcaaagcttagttatgattgcctctcaagtacctttgttacaaagatataaggaggaaggtagtagtgaaagacttaattaa

SEQ ID NO: 3531 - DNA, 606 bp, Staphylococcus epidermidis
gtgaagaggtgtttacaattggttaaaacattatatttaatgagacatggtcaaacagtatttaacttaaaaggtaaaatacaaggggctagtgattctcctttgactgcattaggtgtacaacaagcgaatgcagcacaacaatattttaaaacgaaaaatattcattttgactatctttattcatcaccacaacaaagagcatgtgacacgttagagaacgctgtaccaaaccaacaatattggtgtgtaaaagatcttaaagagtgggggtttggattatttgaaggggaaagtatcgagttattaagagctattaaacaacctagatatttgtatggtgacgctgttgtaccatttggtggagaatcaagatctgaagttgaacacagggtttatcgagcactctatgaaatgatggatacaacagatggagagacaattctagcagtgagtcatggtagcactattggtttgtttgtaagaaatatattagggtatgacaagggaagtaaatttgaaataggaaattgtaacattgtaaaatttgaatacgatggagaagaatttatctttaaagatttaattaatcccattaaaaaatag

SEQ ID NO: 3532 - DNA, 414 bp, Staphylococcus epidermidis
ggagaatttcgtatcatgaaaagagtcattacttatggtacatatgacttgcttcattatggtcatattgaattacttagaagagctcgtgagatgggggattatcttatcgttgcgctttctactgatgaattcaaccaaatcaaaaacaaaaaatcatattatgattatgaacaacgtaagatgatgttagagtctattagatacgtagacttagttatccctgaagaaggatggggacagaaagaaaaagatgttgatcgttttgatgttgatgtatttgtgatgggtcatgattgggaaggggagtttgacttccttaaagataagtgtgaagtcatttatcttaaccgcacagaaggtatctcaactaccaaaatcaagcaagaattatacggaaaagatacaaaataa

SEQ ID NO: 3533 - DNA, 813 bp, Staphylococcus epidermidis
gtttgtcttcgtaaaaagataatttggttgaagtatgacaggagtgattatttgtcgatattagaggtaagacagttgtcaaaagtctatggtgataagcaagctttccaagaagttttgaaagaaattaatttagatgttgatgaaggtgagtttatatcaattatgggaccttctggttcaggaaagacaactttattaaatgtacttagttcgattgattatatgactaaaggatctattacaatcaacgggaaacaacttgagaagttatctaataagcaattatctgatattagaaaaaaagatattggatttatttttcaagattataatattttaaataccttaaccgttaaagaaaatatcatgcttccactatcagttcaaaagttagataaacaaataatgcatgaacgttatcaacgtatagtagaagctttgaacattagtgatattagtgataaatatccatcagagttgtcaggtggacaacgtcaacgtacctcagcagcaagggcatttattaatttaccttcaattatatttgctgatgagcctacaggtgctttagattctaaaagtacactagatttacttaagcgtcttaaatatatgaatgaggaatttaacacaaccatacttatggtgacacatgatccagtagcggctagtttttcaaaccgtgttgtgatgttaaaggatggacaaatctttactgagttgtatcaaggtgatgatgataaacaaacgttttataaagaaattataagaacgcaaagtgtacttggtggcatcaattatgagctttaa

SEQ ID NO: 3534 - DNA, 681 bp, Staphylococcus epidermidis
  modified_base (40)..(40): a, c, g, t, unknown or other
aaaagaattcgtgcacttcaacaggatattaataactatntgataccggagtttaaaaaatataaaaattccactcaacatttaacagcagatactaatgaggttaagcacttgaaagaggattatctaaaaactgttgaaaataaagagaaatctatatatgatttaaaagaatttgtagatttatgtaatcgctcaattaaagataatgaagatattttggattatactaaattattcgagaaaaatagaactgaagtggagtctgacattaataaagcacaaaataaagaagatgcaagtcaacttaaatcaaaattagaagaaaataatcaacaattaaaagatactgctaaaaaatatttaaattcttcaaataatgattctgattcagcgaaagaagcaatcaaaaatcatatttcaccacttattgacaaacaaattacggatattaataaaacaaatatttctgataatcatgttgataatgctagaaaaaatgcaattgagatgtattatagtttgcaaaattattatgatacgagagtagatacgattaaaactagcgaaaaattagctcaaattgatgttgatcgattgccaaaagaaggaaaagatatatcagagatggataaatcgttcaaaagagaatttaaaaaaataagagaaagtgtgaattaa

SEQ ID NO: 3535 - DNA, 222 bp, Staphylococcus epidermidis
gaattacatcgtaagaagaagggatataaaatgaaagatactcagttaacatatatattattaatcattgcaagtattttattaattgctaatggtatatttgcatttgaacgtacgttatcaatgatattaatgtcgatattatttatattagttggaatcattttattatcaacaacattgaataccatgtatcaatcatcaaaacactcaaaacgttaa

SEQ ID NO: 3536 - DNA, 537 bp, Staphylococcus epidermidis
gtgattattttgagaagattaagtaaagagaagcatcatcaagtgaatcctttatggcatatatatagaaaaattaaattcgtaaaagtgctaaagcaaacgttgattatagaaattgcaagatttgttcctagtatgaaacttaaaaataaaatatataaaaagcttttaaaaatggatgtcgggaatcatacttcatttgcatataaagtgttgcctgatttgttttatccagaatacatttcggttggcaagaatacagtcattggttataatacaacaatattaactcacgaagtacttgttgatgagtggagagtaggaaaagtcattataggcgattacactttaataggtgcaaatacgacaatattaccaggaataaccataggaaatcatgttaaaattggtgcgggtacggttgtgtctaaagatgttcccgattacagttttgcatttggtaatcctatgcaaatacaattagattcaggaggtgacaatgaatggcacaaaaagaaaataacatcattccaatga

SEQ ID NO: 3537 - DNA, 612 bp, Staphylococcus epidermidis
attatataccgggtacttattcacgaatttggccacgtcttatttaacaaactcgctggtggaaaggccaaagatcttgtcattgtgacaagccctagagaaagaaaagtcacttcacaacaaggctatgcgattacacaatctaaaggatacttaggtcagtttattacaactataggtgggtatcttatgccaccattgatgtttttaactggattggtatctattcactatcaatatccaagtatatttattactatatatttatttatttttatatattatttctttattacttcccgtaaactatcacctttgattgtcattatactcatctcaagtttactctatttagtatttaaacaagaccatcaatggttcatttacgacattgtcacattaagttaccattttattttaggcgtacttttaggtgaaatattacaatcctcatggacgatttttcgtcttacctttcaacgacctaaaccttcttgggatggcagtgctttaacgaaagttactcgagtacccacctttatctttagtttagtgtggatattattcaatctctatactgtgtatttattaatcaaatacacaatactataa

SEQ ID NO: 3538 - DNA, 1239 bp, Staphylococcus epidermidis
gaaaattgccgaggttgtaaacggatgataccttatggcacatttacatttttcttaattgcatttatcgttcttatacctgtgataatacttggattcttaggtaagcgaagttatatttacaatggtataagtacagcaatcatgattgtcattatattcgcatcagataaacataatctgttagggcaaaaatatctaagtgcacaacttttttgttttattatttatgtcatatggcaggttgccctcattatgtactactatcaatcacgacaaaagaagaatacttttacaaaatttgtaacaattatggtgttgtctattctccctctagcaattgttaaaatattacagagttcatggttaggtggacatcaaattcacttccatgaaagtaaattaattgaatttgtaggatttttaggtatctcatacgtcactttcaaaagtgttcaattaattatggaaattcgtgatggttctattaaagaaatcaaggtagggaaattgatacaattcatttcattcttcccaaccatttcatctggacctattgatagatataaacgttttgtgaaagatgataagaaagtacctagcggtgcagagtacagagaacttgttgtcaaagcaattcatatgattatgttagggttcttatataaatatattattgcgtatttgattcagacttacgctgttaatcctttacaacttaacctgcatggatttactcatatgtggctatatatgtacgcttatagcttatatttattctttgattttgctggatacagtttattcgcaattgcagtgagttatttatatggtattaagacaccgcctaactttaaacaaccgtttaaagccaaaaatattaaagatttctggaatagatggcatatgactttatctttctggtttagagattgtatctatatgagatctttattctacatgtcacgtaagaagttattaaaaagtcaatttgcaatgtcaaatgtagcgtactttttaaactttttcataatgggagtatggcatggtcttgaagtatattacattgtatatggattataccacgcagcgttattcataggttatggttattatgagcgttggcgtaaaaagcatccaccacgttggcaaaatggtttcactacagctataagtattatcattaccttccattttgtaactttcggattcttaattttctcaggcaaatttatttaa

SEQ ID NO: 3539 - DNA, 468 bp, Staphylococcus epidermidis
gtatttatacgttacttaattacaaagataggagggggcaagatgaaagagaatgatgtagtacttaaatcagttacaaaaattgtagtgtttattttgttaacatttggattttatgtattttttgctggccataataatccaggtggtggctttattggtggcttgatttttagctcggcatttatcttaatgtttcttgcctttgatgtaaatgaagtgttgaaaagcttgcctattgattttaaaaaattaatgattataggttcactcatatctgttgcaactgcatcagtgcctatgttttttgggaagccatttttatatcaaactgaagcaaatgtaacatttccattactaggacatgttcatgttactactgtgactttatttgagcttggcatcttattaacagtagtaggtgtgattgttacagttatgctatctataagtgggggtagatcatga

SEQ ID NO: 3540 - DNA, 168 bp, Staphylococcus epidermidis
atgcgaatacgtcattgtttagactatgtagttgttaactttttattaagatttttaaatgtttgtaatcttattgtaataaaaatacatagttcaatttataaatatatagtattatgccttaaatatcaagtaaaagcacgctatacaggtaaattgtcaacataa

SEQ ID NO: 3541 - DNA, 1035 bp, Staphylococcus epidermidis
atcgtgcaacgaatggaagccagtcgttttacactttttaagtattgttttgttaatatagtgattaagaaagtattgaaagagagagttatgaataaatatagaagtgtcattatatggttatttattttaatattaagcatgagcttaagtttaagctgggatgtaggaaaacttgatgatgtttttaatcaaaccatactattccaggttcgtttacctagattacttgaagccatgctcactggtgcagtacttacattagctggccaagtgtatcaaattgtgttaaataatccacttgcagatagttttacattgggattagctagtggtgcatcattaggatctggaattgctttatttttgggacttagttttttatggttccctatattttccattattttcagtttaatcacactgttacttgttttaagtgtttcagcgatgttagccaaaggatatcctgttcaaatgcttatattaacgggattactatttggtgcactattaaatgcattattgtatttgcttgttttgattaatcctaagaagatgaatccaattgctagttatctgttcggtggttttgcatcagctgaatatcaggatgttatgattattagtttgatagcatctgtcgcaatcatagtattatttttaatgcaaaaaggaattaaattactgcaagttggtgaattgaaaagtcagtctctaggattaaatgtacaacaagtaacgtatattgttcttatagtagcctccatcatgacagcagttgtggtcgcatacgttggagttattggttttataggcatgattattccacaactgattagaaaattttattggcgttatcaaataggtttacaaatgttattgaatataatcataggtgctgtagtcatgataattgcagattttataggaagtacaatgatacaacctatacaaattcctgtaggcatcgtgatggcattgctcggtgtaccagtcctattttatattttaattaaacagactaacatatga

SEQ ID NO: 3542 - DNA, 498 bp, Staphylococcus epidermidis
aatttaaaacgaatgattaagtacatctactggtgggtatcaataaaatacatacaatttgaggaggtaataatgatggcagttcaatatgaaactaaagcgactaacgtaggtggacgtaaaggtcatgtccatactgacgataatgcaataaatgtagatgtattaccaccacaacaagctgacggtaaagcgactaatccagaacaattatttgctgcaggttacgcttcatgctttaatggtgcatttgatttaattttaaaacaaaataaagtgcgcgatgctgaacctgaagtaacgttaacggtacgcttggaagacgatccagatgccgaaagcccaaaacttagcgttgatattcatgcaaaagttaaaaatgttttatcacaagaagatgctgaaaaatatttacaagatgcgcacgacttttgtccgtattcaaaagctacacgtggcaatatcgatgtaaacttaaatgttgaagtagtagaataa

SEQ ID NO: 3543 - DNA, 123 bp, Staphylococcus epidermidis
aacttagtgcgattcgcggctgttaatgctgtctcactacctgaaaagaaaaatgaaacaaatattaatagtataattgcaataatcatgatgcatttctccttaagatttagttcgtattaa

SEQ ID NO: 3544 - DNA, 1674 bp, Staphylococcus epidermidis
ggagataagcgaatgaatataatcgatcaggttaaacagacgctaatagaagaaatagaagctagtattagaaaagctaacctcgcagaagatattccagaaattaaaattgaaatacctaaagatactaaaaatggagattattcttctaatattgctatggttttaacaaaaattgctaagcgtaatccacgtgaaattgcgcaagctattgtcgatcatttagatacaagcaaagcacacgttaaacaggttgatattgctgggccaggtttcatcaacttttatctggataatcaatatttaacagacattattccagaagctatcacaaaaggtgatcgatttggatatgcaacacaatctaagaatactaacattttattagaatatgtatcagctaatccaacaggagacttacatattggtcatgctaggaatgcagctgtaggcgattctttagctaatattctcattgcggctggttacaatgttacacgtgaatattatattaatgacgcaggtaatcaaatcactaatttagcacgatcaattgaagcacgatacttcgaagctttaggtgatacgagttatgagatgccggcagacggttataatggtaaagacattattgaaatcggtaaagatctcgctgttaaacatccagaaataaaagactactctgatgaagaacgcttaaaaacgtttagacaacttggtgtcgattatgaaatggaaaaattaaaaaaggatttatctgattttaacgtgcactttgataattggtttagcgaaacatctttatatgaaaatggcgcgattaaaaatacattatctaaaatgaaagagctaggctatacgtatgaagcagatggcgcgacttggttacgtacaagtgactttaaagacgataaagatcgtgtattaataaaaaaagacggtaattacacttatttcacaccagatacggcctatcactacaataagattaatagaggaaatgatattttaattgatttaatgggtgctgatcaccacggttatattaaccgtctcaaagctagcttagaaacatttggtgtagacagcgatcgtcttgaaattcaaattatgcaaatggttcgccttatgcaaaacggagaagaagtgaagatgagtaagcgtacaggcaatgcgattactttacgtgaaattatggatgaagtcggtatcgatgctgcacgttatttcttaacaatgcgtagtcctgattctcattttgactttgatttagagttagctaaagagcaatctcaagacaatccaatttattacgcacaatatgcacatgcacgaatttgttctattctaaagcaagctaaagaacaaggtattgaagtgtctactgatgcagacttttctaaaataaataatgataaagcaatagacttattaaaaaaagtagcagaattcgaatcgacgatagagagtgcagccgaacatcgtgcacctcatcgtctaactaattatattcaggatctagctgcagcattccataaattttataatgctgaaaaagtgcttacagatgatacggaaaaaactaaagcacatgtagctatgattgaagcggtgcgtattaccttgcacaatgcattagcattagtaggtgttacagcaccagaatctatgtaa

SEQ ID NO: 3545 - DNA, 234 bp, Staphylococcus epidermidis
atgaaatttagagaatggacaataacgattaacggaaaagggcctataaatgttgtagccaatgaagatactttactcatattacagaaatatcaacatgtcgaagtagcattaaaaatagataatgagacggttcaagttaaatctctcggttataacgaagatataattattaaccataatactaaagaaattacgattaatgtaaccaacttgttagaagatgatgaataa

SEQ ID NO: 3546 - DNA, 276 bp, Staphylococcus epidermidis
cttaacattagatttacatggaataaaggaggattaatgatgtctactcatagtcaatgtaactatgtcaatcctaattcaatttctttagattgggaatgtttaattataagcaaaacagatatgctactcgatggtgtacctaaagaattaattaatacttggttagatcaaaatgttatcgagccgttttgtgttcgtaataatgaaataaactttaaaactaaagatgtttggaatgctcttaagacccataactggtattattcaaattaa

SEQ ID NO: 3547 - DNA, 159 bp, Staphylococcus epidermidis
gaaacacctagattaattgcttgtgctctacctaacaaaagaacatctaaatatggtcgaagtattattgtaacaattattaatataactaataatatgcctgaaacagttactaatttagaatttgatgcttcaaagctagcaaacataacattttga

SEQ ID NO: 3548 - DNA, 1710 bp, Staphylococcus epidermidis
ggtgaagatagatcaatgaaatcacatattcattttagtatagatagagatttaatatgcgctatcatggtaggtgttttaagcggaattgtaacattagcaatgttctttttaagtggttatatgattactcaaagtgcgctaggtgcgccactttatgcattaatgattttagttgtatctgttaaattgtttggttttttaagagcaattacacgctatatagaaagattactttcacacaagacgacatttacaatgttacgtaatgtacgagttcaatttttaaaaatgctatatccagtcgttccagatatctatagaagatttaattcaagtgatcttattacaaaaatgataagccgtgtagaagctttacaaaacatatatctgagagtatattacccaccgattgtaatcggattaactgcaattgtttcagtaataactatgttgtttttatctccactacatgcattagtgattactttaagtatgttattaactttatggattgttccttggttaagtgctatgaaagcacgtaaattaaagcaacaagtgacccaaacgcaaaaaacatttcttaaaagatattatgattataaagaaggtcatgaagaattaaaacgtttcaatcgcagcgatgacttcgaaaatacagtttcccagtctttacgacaatttgatgatatgcaacttaaggaacgccgatttctttctatttatgactacttgttaaacttaatagcgatgttctcaatatttatgtgtttagtgttaggtgcgcaacagattcatgatggtcagctcaatgctatttatattacaagtattatattgatgatattaactttatttgaacaagcagtacctatgagcaatgtggcatattataaagcagatacagacctggcacttgaagagatacaagaggttattgtacctaagtataaaattccttcagaacatacaaacttaaagcgttcgcaaaatcttttattagaaattaaaaatgtcacatttaaatatgaacatcaacatcattctactttaaaacagattaatctaaccattgaatatggtgataaggtggcaatcattggtccttcaggatcaggtaaaagtactttgcttcatgtattacttgggctatatcaaatagaagagggagaagtgagattaaatggtaaggatatgaacagtatcaatgacaatgataaatatcaaacatttaatgcaatgcttcaatctcaatatatttttgatggttcaattcgtgataatttattttctgagcaatcagatgataacctcaaaaaggttctcgaagatgttggattagaatatttaaatttagatagtatagttacgttagacggtcataatttatcaggtggggaagctcaacgtctaagtttagcgagattgctattaagaccttcggccggtttttggatattagatgaacctactacagcactagatattaataatacccaaaaaattataaatttgattgaatccttatcccaaacactcatcatagctacacatgatttagaaatacttccaagatttaataaaattatagtcatgaatgacggagaaataatagaaaatgattcatatcaagaattaatgcagcatgacggttatttaaaaaaagtaatagaaatgaatggaaacgaaatgaaattttttaattaa

SEQ ID NO: 3549 - DNA, 255 bp, Staphylococcus epidermidis
cgaatcatcagtaatatcgacacaaatatcataaacacgccaaagtataagttaaacgaatcaagtgtaaggtatctacttaaaaaagaaccaaccaaagatccaggtagtagtccaaatagaaatatcgaaccattttttatatctacttgtttggtttttaaatatcctaatgaggaagataatccagtaacaatcagaataactgaagaagtacctattgcaatttgcgtcgtaataccatgtagaagatga

SEQ ID NO: 3550 - DNA, 282 bp, Staphylococcus epidermidis
aggagcgtcagagttatgatagatatgtacttatatgatgatgaagaacaaagccaagtacagttcgtcggctttgttggtgagcatagtcgttacgacttaatgcttgtacaaacggatagacattatggtaaaactttagttttaaatatgcagacaaatcaatttggcattataggttcagatgatatagaagaagaaggttacatttctcatattttaggagtatcaaaggaagaagcggatgaaattattgaatatttaaatgaagttattcaatag

SEQ ID NO: 3551 - DNA, 213 bp, Staphylococcus epidermidis
tcaacatcaaggcaacaaataatattattaaccgaaataaaattaagtgagctaggtacagaattcgttatttcatcccgtgtaacgagatttataaaggaaatacctcgacgtaatgtatttttcgtttacttctttgatagccagtatataaaatgcttaggaacaatgttttgtatcctaagcattttattgttttatttagcatcatag

SEQ ID NO: 3552 - DNA, 438 bp, Staphylococcus epidermidis
ttttaccaaagaaaatggacgctcaatcaacttgtagactattttagtaggtggttagatgagacaaaaggaacttttgtacatactcaaaaacaagatcatcactacatcatttacaataggaacattaaaagacctttagctattttcaaaatggttaatacaacagaagatataattacattacatcttgttgatggtaaattgatgaaacctaaatcaaagaagcaagcaaaattagaatttagacttcttaaaggaacacgtttaattatggttcatttatacgattatatccctagattattttggccaatttactatttcatacaagcaccgattcaaggacttcttatgagaggttttgaaattgattgtagaattaagcattatcaaggtcgcattcaatcaggtgagaagattaaatatactaaataa

SEQ ID NO: 3553 - DNA, 141 bp, Staphylococcus epidermidis
aatcataaaagtatctatactatattgtttataacgttaggaaataaaatagttccaaatgaatgcaaaaatgcaattcttttggaactttgtttctcattgattatttatttaattgaatattatagaaataccttctga

SEQ ID NO: 3554 - DNA, 621 bp, Staphylococcus epidermidis
tataataaaagcaaggagttggtgactgtgaaagtaaaatatatagacaaacgtcactggcgtcgcctggtagagagagaatatacagaggttaaagttaataataatagatttaaaggtattataggcttggtcacgatgaaaaaggttcgtgagcctttagaggtgacggtagttggacaaaacataatagttgcagatgacaattataaatggttacagatactaccggataagaagcggtatagtatgactgtcatgtttgataataaagggaatccattagaatactactttgacattaatataaagaacattactcaaaaaggaaatgcacgtaccatcgatttatgtttagacgttctcgttctacctaatggtgagtatgaacttgtagatgaagatgatttaatgtacgcactacaaaataaacaaatttcaaagaagcaatatcatgaggcatatattatcgcccatcaattaatgattgaaatagaagataatttttcagaaatacaagataaggttatgcgttgttatcataaaatcaatcataaagcacagaaaatgaaacataaacgtccctataaagctaaaaagaaatcacaccgacgacattaa

SEQ ID NO: 3555 - DNA, 480 bp, Staphylococcus epidermidis
ttttgtaaaaggagtacaattatgacagactcaaatgctaaagaaataagaactggacgtttaattgcgataagttcattagtgttttgtattttacttatcatacaccactttattgtattagatgaatcaacagctaaatcaattttatctttagctggtcaaaaaacatcagatacagcagtgaaaaacattttaaatagtgaccgatacactggaattatgtatattttagcttacttagcaggtactgttgctttctggaatcgccatccatatttatggtggtttatgtttgccgtatatatttctaatgcactatttacactcgtaaatctttacttatttattcaaggtattttagatgtaaaaaatgtacttgcagttttaccaattttaattgtagtgattggatctataattctagcaatttatatgctagttgtttctattacacgtaaaagtactttcaatagatag

SEQ ID NO: 3556 - DNA, 132 bp, Staphylococcus epidermidis
ttaaacaaaagtacatcttgtggtaagagaaagatgcaaccttttcaaattccttgtataaccttagcaataaagactaagtttgataatatttatatttatcgagtttttcaatctattactgcctactaa

SEQ ID NO: 3557 - DNA, 2052 bp, Staphylococcus epidermidis
agaggtgaaagtgtggagatatttgaaactctactcatatttgtcgcactagttattgtgagctcctttgtacatactttcatacctaaagtacctcttgcatttatccaaattttccttgggatgattttatacctcactcccattccagttgaattcaattttgattctgaattatttatggttacattgattgcaccactactattcgttgagggtgttaatgtttcaagagtacatttaaggaagtatatcaaacctgttatgatgatggctctaggtcttgtcataactaccgttataggcgtaggattgtttattcattggatttggcctgaattacctataggtgctgctttcgcaattgcggctatactttgtcctacagacgctgttgcggtacaagcaatcacgaaaggtaaggttttaccaaaaggttcaatgaccattcttgaaggtgaatctttacttaatgatgctgcaggtatcatttcatttaaaattgccgtaggtgtattgattactggaactttttccatttttgatgcgattcaacaatttttgattgcctctattggaggtgctattgttggtctaattataggcatggctttagtgagatttcgtttaacattaatgagacgtggcattgagaacattaacatgtttacatttatacaattgctgacgccgtttgtcacttatttgattgctgaattattccatgcatcagggattattgcagcagtagttgcgggactcgtgcatggatttgaacgtgaccgtatagctcaaacgagaacacaattacagatgagctataatcacacatggagtattttaggctacgttttaaatggttttgtgttttcaatcttaggttttttagtacctgaggtaatagtgaaaattattaaaactgaaccgcataatttattattcttaatcgtcatcacattgctagtcgctcttgcggtgtatctctttagatttgtgtgggtatatgtactttatccttatttctatttatctgtcagtccattccaaaaaatgatttctaaaaatgatgaagataaagttactgagagtaaacctaagcgtagcttatatgcactaatcatgactctatgtggtgtacatggaaccatttcactcgcaatcgccttaaccttgccatatttattagcaaatcatgaaacatttgcttatcgaaatgatttattatttattgcttccggaatggtaatattaagtttaattattgcacaagtcattctgcctttagtaacgcctgatagccctgaagtgaagataggtaatatgtcatttaaagaggcgagaatctacattttagaacatgttatcgattacctaaatcaaaaatcgacgtttgaaacgagttaccgttatggaaacgtcattaaagattaccacgataaactcacatttttaaaaacggttgaaaaggaagatgaaaactccaaagaactagaacgacttcaaaagattgcatttaacgtagaaacaaaaacgctagagaaattggttgatgatggcgaaattactgagagtgttcttgaaaactatatgcgttacgctgaacgaacagaagtgtataaacaagcttcgttattaagacgaattattgttggtttaagaggaatgctattgaaacgtcgtgtaaaaacaaaaattaattcggcatcatctcttagtgttactgataacttattagaattgggtaaaatcaataagcttgttcattataacgtcgtaagtcgtttagccaaagaagctactactgataataaactagaagtaggtatgatttgcgatggatatctgatgagaatagataacttaacaccaaacaatttctttaattccagacatgaagatacacttaccaaaattaaattaaatgctttaagagaacaacgtcgtattctaagagaactaattgaaaatgatgagataacagaaggtactgcattaaaattaagagaatccattaattatgatgaaatggtaattgtagatagtatgacataa

SEQ ID NO: 3558 - DNA, 489 bp, Staphylococcus epidermidis
aacaaacgaaggagtttttctcttatgaattttaataatttggatcaattatatagatctgtaattatggatcattacaaaaaccctagaaacaaaggtgtcttagacaatggctcaatgactgttgatatgaataaccctacatgtggtgatcgcatacgtttgacatttgatattgaagacggaatcattaatgatgctaagtttgaaggagaaggatgttcaatttcaatgtctagtgcatctatgatgactgaagcagttaaaggtcattcacttggtgaagcaatgcaaatgagccaagagtttactaaaatgatgctcggtgaagactacgagattacagaagaaatgggagatattgaggcgcttcaaggtgtctcacaattcccagctagaattaaatgtgcaacgcttgcatggaaagcattagaaaaagggacagtcgaaaaagaaggtaagtcagaaggtacaacggaagaagattaa

SEQ ID NO: 3559 - DNA, 1266 bp, Staphylococcus epidermidis
aattgtagaagctttagaagagttacgatgaaactgaaaccattcttacccattataatcagtggcgtcatatttattatatttttatttttaccagcaagttggtttactggtcttgtgacaaataagacgttagctgataatagaatttctttaactgatcaagttttaaaaggcacgctcattcaaaataaattattcgagtcaaataagtattacccgatttatggttcaagtgaactggaaaaggatgatccttttaatccaggtatagcgctaaataaacaaaatgctagtaaagaaacgttccttattggtgcgggaggttcgacagatttaattaatgcagttgaacttgcagcgcaatacgacaatttaaaaggaaagaaatttacatttattatttctccacagtggtttacgaatcatggattaacaaatcaaaactttgatgctcgtatgtcacaaagtcaaatcaatcagatgtttaatcaaaaagatatgccagctaatttgaagaaacggtatgcacaaagattgttacagtttccgcatgcacacaataagtcataccttagagaacaagcaaaacatcctaatgatgtctctggaaactacatttcttcatttaaagaaaatcaattaactaagattgaagctattaaatcattattctcattcactaagccacctctagcagaagtaaaacctgcaacaagagaagatgcttcatgggatgagatgaaacataaagctgccgatataggcaaagcaaatactcaatctaataaatatgatataagagatccatattggaaattgataaaacaaaacaagcgtaaaatcaaaagggattatgagttcaacattaactcacccgagttccaagatttaaaattattagtgcaaacgctacatgctgctggagctgatgtacaatatgttagtataccttcaaatggaagatggtatgatcatataggtatcaaaaaagatagacgtgaagctgtatataaaaagattcactcaactgtagttgataatggtgggaaaatttatgatttgacaaacaaggactatgaaaagtacgtaattagtgatgctgttcatattggatggaaaggttgggtttacgtcgaccagcaaattgcaagacatatggatggtcatgcgcctaaaaatcatgaagtcgattattctaaaaataaaccaccgcacaaacatcacaacgatcgtcaagatgatcaacatcaaggcaacaaataa

SEQ ID NO: 3560 - DNA, 147 bp, Staphylococcus epidermidis
ccgcacagaaggtatctcaactaccaaaatcaagcaagaattatacggaaaagatacaaaataactaagagtatttatgacactattgaacatttaatcttgaaaatagagataagaaagaattgttctttaaatcaatgtgactag

SEQ ID NO: 3561 - DNA, 312 bp, Staphylococcus epidermidis
gaggagagaagaacgatgcatgaacaagattttaatattctagaaggtaaaaagatgacattagtagaattaggtcgtgagttagagaatctaactggtcgtactattaaagatacaacaagtgatattaaacgagtcattgcacatttgcctaactttgaatcagatacagatacatttgtagcaacataccaccttaatcatcaaaatgattttattgatgcaacatttgttgcacctaaaaatcaaagtgatcgtttgaaagaaataccggtacacattaagttgattagttatatttctaaaaactaa

SEQ ID NO: 3562 - DNA, 750 bp, Staphylococcus epidermidis
aatattaagaggtcattgaaaatgaatttaaactgcattaaggctatcgtctttgatttagaaggtactctattagatagagtaaaatcgcgtgaaaagtttatagaagagcaatatgaacggtttcatgattattttattcatgtgcaattagcagattataagaataaatttattgaattagacgatgatgaagacaacgataaacctgatctatataaggaaatcattaaacaatttcatatcgaccgtcttaaatggaaagatttatttaatgactttgaaatgcatttctatcgttacgttttcccttactatgatactttgtatacattagaaaagttatcgaaacatcattacatgattggtgtgattgcaaatgggaaatccaaaattaaacaatttagattgcattcattgggtattatgcacgttattaattatttaactacttctgaaactgtaggctatcgtaagccacatcctaaaatctttgaagatatgattgatcaattgggggttaaaccatctgaaataatgtatgtcggagatgatgcattaaacgatgttgctcctgcacgtgcaatggggatggtaagtgtgtggtataaacaagaagatgcagaattggagccattaacagaagaagtagattatacgattactaccatagaggaattgcttaaaattttaccagataattttgaaacagaaggagaagaacaacatggcaatggatttaattactaa

SEQ ID NO: 3563 - DNA, 537 bp, Staphylococcus epidermidis
tttggaaagagctgtactataatgtttgtgaattatttcacaatatctaaggagtggttgtatatgttatctgtaactaaaaaaaatacatatgaatcaaacaaagatgaagtcacacaaatgattgattcattagcagaaaaaggacaagaagctctaaaagaactatctaaaaaatcacaacatgagattaatgacattgtacatcagatgagcatggctgctgttgatcagcatatgcatttagctaaactagcttacgacgaaacaggtagaggtatttatgaagacaaagctatcaaaaatttatatgcctcagagtacatatggaattcaatcaaagacaataaaacagtaggtatcataggtgaagataaacaaaaaggattaacgtatgtagctgaacctataggcgtgatttgtggagtgacaccaacgaccaaccctacatctacaactattttcaaagcaatgattgctattaaaacaggtaatccaattattttcgcatttcatccaagtgcacaacaatcataa

SEQ ID NO: 3564 - DNA, 315 bp, Staphylococcus epidermidis
atcaaggagagtatgataaaaatgaatgaagataaccgtaacaaacaaattaaatttgaaagaaacctaatcacttttccatatttaggttttgcctttattgttttattatttaatattttttatactgatgtaaaaattacaatggtcttatttggtctattctttgcttacaatttaggaatgctttttatagccttcataagacattttaaacgtacacttatattaaccttaatactaacaatattaagtggtatagcattttttgtactactttatgtttttggattaaatcacgatatttttggatag

SEQ ID NO: 3565 - DNA, 465 bp, Staphylococcus epidermidis
aatgtctggaggagaactttaatgtctgaacaacataatttaaaagagcagctatgctttagtttgtacaatgctcaaagacaagttaatcgctactattctaacaaagtctttaaaaagtacaatctaacatacccacaatttcttgttttaacaatattatgggatgaatcacctgttaacgtcaaaaaggtcgttacagaattagcacttgatactggaactgtatcgccattactcaagagaatggaacaagttgatttaatcaaacgtgaacgttctgaagtagatcaacgtgaagtatttattcacttaacagacaaaagtgaaatgattaggcccgaattaagcaacgcatctgagaaagttgcaaccgcttcttctttatctaaagaagaggtcaaagaacttaatcgcttattaggtaaagtcatcgatgcatttatcgaaacaaaagaaaagtaa

SEQ ID NO: 3566 - DNA, 306 bp, Staphylococcus epidermidis
catagtcggaggcagattttgatggaaaaccttacaaaagaacaaaaatatacaatagctaaattttataaattatatatggaaagatctaatgcggggcaaccagaagaagaagctaatcattttaaagattctgtaacggcacaagatgattatttttgtgatagaaaatatgaagatttcattcataactgtaaagtcttaataaatgaaggttacttagatggcgaggttgaagataacaaaatatataatattcaggttacaacaaaagcttttacagaaattgagcgtagctttggttaa

SEQ ID NO: 3567 - DNA, 939 bp, Staphylococcus epidermidis
ttttataggagggaaatcatgatatatacagttaccttcaatccttcaatcgattacatcatttttactgatggatttgaaatatcaggattaaaccgggcaaaagcaacgtataaatttgcaggaggtaagggaatcaatgtatcaagagtacttaaaactttagatgttgattctacagccttaggattttcaggaggtttccctggagattttattgctcaaacacttgaggacagtaatatccaatcagattttgttcaagtagatgaggatacgcgtattaatgtaaaactaaaatcaggtcaagaaacagaaatcaatgcacccggacctaaagtgacacacgcgcaatttgaacaacttttatctcaaatacgtcgtactacaaacgacgatattgttattgtagctggaagtgtaccgaacagtattccaagtgatgcttatgcacaaatagcacaaatcactgaaaaaactggtgcgcaactagttgttgatgcagaaaaagatcttgttgaaacagtattaccatatcgaccattatttattaaaccaaacaaagatgaattagaagtaatgtttaacactacagtcaagagtgatgaagatgttataaaatatggtaaagaaattttgaaaaaaggggcacaatcagtcatcatttcacttggtggcgatggtgcaatatatgttgatcaacatcaaagcattaaagctgtgaatccacaaggacatgtagttaatacagtaggatctggtgatagtacagtggcaggtatggtagcagggttgtccatgggtcttaatatagatgaagcttttcaacaggccgtagcttcaggaacagcgactgctttttcagaagatttagcgacaagagatgctatagaaaatattaaatctcaagtgacaatttctgtacttgatggggagtga

SEQ ID NO: 3568 - DNA, 2406 bp, Staphylococcus epidermidis
agatgtaggagagaaaggaggggcataatgaatttaaagcaatccatcgaagaaatgataaaacaacctgactatgaacccatgtcagtatctgactttcaagatgcgttaggtttaaacagtgccgactcatttagagatttaattaaaatactcgttgaattagaacagtctggtttaattgaacgtacaagaacagacagatatcaacgtaaacaatccaacaaaacaaattcaaaactaatcaaaggaacgttaagtcaaaataaaaaaggctttgctttcttaagacctgaagatgacgagatggatgatatttttattccaccaactaaaatcaatagagcattagatggagatactgtcatcgtggaaattcaaaaatctcgtggagaacataaaggtaaaattgaaggtgaagtaaaatctattgaaaagcattcagttacacaagttgttggaacgtatagcgaagcaaagcattttggtttcgtattaccggatgacaaacgtattatgcaagatatctttatacctaaaggacaaaatttaggtgctgtagatggtcataaagtattagtacaaattacgaagtatgccgatagtactgacaatccagaaggccacgtctcagcaatattaggtcataaaaatgatccaggtgtagatatactttccatcatttaccagcatggaatagaaatcgagtttccagatgatgtattacaagaagctgaagaagtaccggatgtaatagaaccatctgaaatcgaagggcgtcgtgatttaagagatgaattaacaatcactatagatggcgcagatgctaaagatttagatgatgccattgctgtaaaaaaattaaaaaatggcaacaccgagcttacagttagtattgcagatgtaagttactatgtaaaagaaggatcagctttagataaagaagcttatgatcgtgcgacaagtgtgtatcttgtcgatcgagtaatcccgatgattccacaccgtctaagtaatggaatatgctcattaaatccagaagaagatcgtttaacattaagttgtcgaatggaaataaatgaacgaggcgaagttgtaaaacatgaaatctttgatagtgtaatacattcaaactacagaatgacatatgatgcagttaacaaaattatcactgatcaagattctgaaatacgttcacaatataaagatttaacacctatgttagatttagcgcaagatttatcaaatagattaattcatatgcgcaaacgtcgtggagaaattgattttgatattaatgaagcgaaagtacttgtgaatgacgaaggtattccaacagaagtgctaatgagagaacgtggcgaaggagaacgtttaattgaatcattcatgttagcagccaatgaaacagtagctgaacacttcaataaattggaagtaccatttatttatcgtgttcatgaacaaccaaaatctgaccgattaagacagttcttcgactttattaccaatttcggtattatgataaaaggtacaggtgaagatattcatccaacaacattacaaagcattcaagaagaagttgaaggtagaccagaacaaatggttatttcaacgatgatgttacgttctatgcaacaagcacattatgatgatgttaatttaggacattttggtttgtctgctgagtactatactcactttacgtctccaatacgccgttatcctgatttaacagtgcatagattaattcgtaaatatttaatagagaattctatggataaaaaagaaatacgtcattgggaagagacgttgccagaattagctgagcacacatcacaacgtgaacgccgtgccattgaagccgaacgtgatactgatgaattgaaaaaagctgagtatatgattcaacatattggtgatgaatttgaaggtatcattagctcggttgctaattttggtatgtttatagaattacctaatactattgagggtatggttcatatcgctaatatgacagacgattattatcattttgatgaacgacaaatggcactaatcggtgaacgtcaagcaaaggtctttcgcattggtgatacggtcaaagttaaagtgacacatgttgatgtggaagaacgcatgatagatttccaaattgttggcatgccattacctaaaaagacatcatcacaacgacctgctcgtgagaaaaccattcaagctaaaacacgtggcaagtcgttagaccacactaaaagtgatcgtaatggtaaaggtaaaaagaaaaaacgtaagcaacgtaaaggtaaaaatgcacgtaaaaaagataaacaaggtaatacgcatcacaaacctttttataaagataaaagtgtgaagaagaaatcgcgtcgaaagaaaaaatag

SEQ ID NO: 3569 - DNA, 525 bp, Staphylococcus epidermidis
caaaacaggagtgttgatatgacacatctcattcgtgaaattagtattaaagacgttgaaaactttatcagcctattaagccaaatatatgatgaatcagaatttacattctacaatccaggtgaatatttaccaacgatatcttccgcaagtcaacacttagaaaaatacatcacctcacctaccaaagcaatatatgtcgctgaaagtgatgagcaacttgttggatacgtatttgttaatactgaaacttatgaacgtacacagcacgaagctgtggtgtaccttggtgttagagaatattaccaacatcaaggtattggacaagcacttatcaatagaattgaagcatgggctttaaatcatcatattcgacgtattgaagctacggttgttactgaaaacattaacgcaatagaattgtttaaaggcatgggctttcaaatcgaaggtgaacttaaagataagctttttataaaccaaaaatattataacgaatatgtaatggctaaaatattaaattaa

SEQ ID NO: 3570 - DNA, 159 bp, Staphylococcus epidermidis
ggtgtctttttcattgtgcactatctgtgcactttttgtgcacctaaaatccaaaagcccacaaccacttgggttgcaggctatataatggagacggcgggattcgaacccgcgtccagaggtcctgatacaaatctttctacgtgtgtagtttattga

SEQ ID NO: 3571 - DNA, 129 bp, Staphylococcus epidermidis
tctgctagtggatacttaacgtgtgtctcgctatcagtaattactgcaaaaggtgtcacttcagaaccagttcctgatgtcgttggtatacatataaattttgcgtttttaggtttggtaattttataa

SEQ ID NO: 3572 - DNA, 663 bp, Staphylococcus epidermidis
attgtaggtggcaaaaataagatggataaatccataattactattaaacaagcacattcaattgaaaatgtgataagtaaatcacgctttatagcatatattaagcctgtttcgactgaaaatgaagcaaaagcttttatagatgaaattaaaacaaaacataaagatgcaactcataattgttcagcctatactgtcggaccagagatgaatattcaaaaggcaaacgacgatggcgaaccaagtggaacagctggcatcccaatgcttgaaatactgaaaaaacaagagatacacaatgtttgtgtcgtcgtgacacgctacttcggtggtatcaagttaggtgcaggcggtcttattagagcatatagcggcgccgtgcgtgatgtgatatatgatataggtagagtcgaactaagagaagctattccagtaaccgttacgttagattatgatcagacaggtaaatttgaatatgaacttgcctctactacattcttattaagagaacaattttataccgataaagtaagttatcaaattgacgtagtaaaaaatgaatatgatgcttttatagactttttaaatcgaattacttctggaaattatgatttgaaacaagaagaccttaaactattaccttttgatattgaaaccaattaa

SEQ ID NO: 3573 - DNA, 1065 bp, Staphylococcus epidermidis
atcaaattagggggtctctttgacttagaaaataaagagacgaacatacaagagtatgaagaaatgatgactgatcctgatttttggaatgatcaaactaaagcacaagatatcattgataagaacaatgcactaaaatctatagtaaatgggtattatcaactgacaaatgctgtcgatgatatgagtgcgacgagagagttattacaagaagaatatgatgaggatatgaagatagaattagaagaggaagttcagcaatttgaagaacaaattgatcaatatgagttacaattactcctcgacggaccacatgatgcaaataatgctatattagagcttcatcccggtgctggcggtacagaatcacaagattgggtaagtatgcttcttaggatgtatcaacgttactgtgaacaaaatggctttaaagttgaaacggttgattatcttccaggagatgaagcaggcgttaaaagtgtcacattacttattaaaggacataatgcttatggttatttaaaggcagaaaaaggtgttcatcgtttagttagaatttcacctttcgattcatctggtagacgccatacttcttttgcatcatgtgatgttattcctgattttaataatgatgaaattgaaatcgagattaacccagatgatatcacagtggatacttttagagcttcaggcgctggtggacaacatattaacaaaactgagtctgcaattagaattacacatcaccctacaggtattgtagtcaacaaccaaaatgaacgatctcaaataaaaaatagagaagctgcaatgaaaatgttgaagtccaaactttatcaattaaagttagaagagcaagagcaagaaatggctgaaattcgaggcgaacaaaaagacattggatggggaagtcagattcgttcttacgtctttcatccatattcaatgattaaagatcatcgtacgaatgaagaaactggtaaagtagacgctgttatggatggagaaataggcccattcatagaagcttatttaagaaaagaaatggatagtcgagacgtataa

SEQ ID NO: 3574 - DNA, 129 bp, Staphylococcus epidermidis
cagcacgtaggagatgctgttaggcgatgcagtggctattacgcagctactgcgaaattattgtttgatttgtcagttatatttaaccgaaatgtgttgatgacggagccaaccctccgacacgcttaa

SEQ ID NO: 3575 - DNA, 696 bp, Staphylococcus epidermidis
caattaaaaggggatggattgatgcgtaaatgtatccagtgcaatcaacctattcatgagaccattcatatttataacttatttaaaccacctcagatattttgtgaacgatgtgaaacattatggcttaactccaaaattcataaagatggtaggtgtcctaagtgccttaacaacaaaatttctactgatggcgaatgtcatgactgtcaattcttaagtaaaacattttatttaatggaacaattgttttgtgattatagttatgatggtatgatgaaagaaatcatacaccagtataagattaagcgagacttctatttggcagaagtattggcgagaaaattagttttacctcaaacgcaatatgattatatagttcccattccttctccaattgaacgcgacattgaacgtacatttaatcctgtgaccactgtcttagataaaatgggcatctcatatcaagatgtattaggtacacatatacgtcctaagcagtcaaagttaggaaagattgaacgttcaaaagcccctaatccattttatataaaagatgaagagataaatatcgaagggaaagtaatactactcatagatgatatttatacaacagggttaactattcatcacgcagggtgtaaattgtacgataaaaaagtcagaaaattcaaagtgtttgcgtttgcacgataa

SEQ ID NO: 3576 - DNA, 681 bp, Staphylococcus epidermidis
tatagaaaaggagttattataatgtcacaatcgacacaccaatcaactgatcataaaagacaatctcaagataagaaccaaacacatgcctatgcaaaagtttggttatattttatgtattattggatgatttttgggattggttgttattttggacaatatcttcctatgtcatggagaaaaccattgtctctaggattgttaattctgatattagcaacgttgtttattaaacgtgcgcgaaaatatggattagtgatctctcatatatacgctattattgtaggtttgctttcgtatgctctttttacgacttacttacaaaatttaggagcagaagtattctataaaaatattattcttgctattggtgcatttatagcttttggtattataggttactttttaataaaagacgcttcgagtatgggaaaatatttgtttgtgacattaattgcgctaattatagctgggattatagggatatttattaataatccaatttttcatactgtcattacaatagtgagcttattattgtttctcctttatactttatacgattttaatagaatgaaaagaggtcaattctcaccaagagaaatgggatttaatttgtttatcaacttattaaatatcatcgaagatatacttagtttagcaaatcgctttaaaaactaa

SEQ ID NO: 3577 - DNA, 795 bp, Staphylococcus epidermidis
ctaaagggaggtgccaagatgaataaaattcaaatttgtaatcagattgaacttaactatattgatgaaggcgaaggcatccccatcattttaattcatggattagatggaaacttggcaggatttaaagatttaaaaaatgaactcaagaagcagtatagagtaattacttatgatgtcagaggtcatggaaaatcttcacgaacagaatcatatgaattaaaagatcatgttgaagatttaaatgatttaatgggagcattaaatatcgattctgcacatattttaggacatgatatggggggcatcattgcgagtgaatttactgaaaaatatcaatataaagtgattacattgacaattgtttcggccaaaagtgaagacattgcaaatggtttcaacaaattaatggttgattaccaagaagaattagcaggctttaataaatctgaggcaatgattattttattctctaaattatttaaagagaaagataaagcaatgaaatggtatcaaagccaaaaattatacaatagaccaactccggaagaaagtgcaattgcagtacgtgcattgcttaatattaaagatttaactcgtgttcatcataatgtgtccatacctactttaattgtgaatggtaagtatgacccactcatacaaaataaaagtcattatgatatggatcaatattatgatcaagttacaaaaattgtatttgataattcaggacatgcaccacatatcgaggaaccagaaaaattcctgaaactctacttagattttgttagttaa

SEQ ID NO: 3578 - DNA, 777 bp, Staphylococcus epidermidis
attaggggaggtatagcagtgatatcagaaaaacgacagaatttaattttacaagaattaactcaaaaggactttttaacacttcaagatttagttgatagaacaggatgtagtgcatcaactatacgaagagatttatctaagttgcagaatatgggtaaattacaacgagtacatggtggtgctacaattcatcaaaatcgagttaaggaacctaagttatctgaaaaaagaactcagaatttacgtgaaaaacaagaaatcgctaaacgtgctgcatgtgatatccaagatcatgaatgtatatttctagatgcgggttcctcaacttttgagttaattcaatatattgaggcaaaagatattactgttgtaacaaacggaatgacacatgttgaagaactattaaagcacggtattaaaactttaatggttggtggccaagttaaacctacgacaatggctacagttggtgctaacgcgttagaaacattaagacgttattgttttgatcgtgcttttataggaatgaacggtattgatgtgaaatatggattaacaacccctgatgaacaagaagctttgattaaagaaacagctatgaaactatcaaatcacaaatatgtgcttgtcgatcaatcaaagtttaatcaaatttattttgcaagagttccaattttagatggacttagcatcataacttcgcaaaaagcaatgcaaagcaagatgactgaagcttacatgaatgaatttaattttataggagggaaatcatga

SEQ ID NO: 3579 - DNA, 564 bp, Staphylococcus epidermidis; identical to SEQ ID NO: 2487

SEQ ID NO: 3580 - DNA, 1074 bp, Staphylococcus epidermidis
gaaagcatttttaatttgattactaagcaacataaggaggctattaacgtgattaagctaaaccaaattgttaaacgctatcataccaaggataaagatgttcttgctgttgatcacgttgatttaaacattgaatccggctctatttttggtgtgattggtttctcaggagctggcaaaagtacgcttataagaatgtttaacaacttagaatctccaacgtcaggtgaaatcattatagatggtgacaatataagtcaattatctaaatcacagttacgaaaaaaacgacaaaaagtgagtatgatttttcaacattttaacctgctatggtcaagaaatgtattgaaaaatgtaacatttccattagaaattgctggcgttccaagtggtctagctaaacaaaaagcattggaactcattgaacttgtcggcctaaaaggtcgagaaagtgcgtatccgtctgaattatcaggcggacaaaaacaaagagtgggtattgcgagagcattagctaatgatccagatgtattgttatgcgatgaggcaacaagtgcattagatccacaaactacagatgaaattctagatttattattgaaggtaagggaacaacaaaatttaactattgtacttataacacatgaaatgcatgttatacgaagaatttgtgatgaagttgctgtaatggaaaacggtaaagttatcgaacagggagcggtaagtaaagtatttgagaatccacaacacgaagtaacaaaacgttttgtgaaagatgatttaaacgatgattttgaagattctttagagtatttggagccattagatcatgatgcatatatcgtgaggttaaactttactggtgaaaatacgactgagcctatcatatcttatatgacgaagacgcataacatagatgtgaatattcttgaagcagatattaagaatactaaaaacggttcgcttggatttttagttattcacataccacatataagtgaagaacatttcaagcaatttaaacataatcttcacgaacaacacgttaatgtggaggtgctaaaacatgggtaa

SEQ ID NO: 3581 - DNA, 1182 bp, Staphylococcus epidermidis
aaaaaaaggggggttcctatgaaaaaacaattattcattctttattttaatatatttcttatatttttagggattggattagttattcctgtacttcctgtatatttgaaggatttaggattaaaaggtagtgacttaggaatgctagttgctgcttttgcattatcacaaatgattatttcaccatttggtgggacactagctgataaattgggtaaaaaattaattatatgtatcggtttagtattctttgctgtctctgaatttatgttcgcagccggtcaaagttttaccattttaatcatttcacgtgttttaggtggctttagtgcaggcatggtcatgcctggtgtaacaggtatgattgcagatatttctccaggagctgataaagctaaaaactttggttacatgtcggcaattattaattcaggttttatattaggacctggatttggaggctttttagctgaaatttcacatagattacctttctatgttgctggaacattaggtgttgttgcattcattatgtcagttttattaattcataatcctcaaaaagcaactacagatggattccaccaatatcaacctgaattattcactaaaattaattggaaagtatttattactccagtcatattaacacttgtattagcatttggtttatctgcttttgaaacattattttctttatatacagctgacaaagtaaattatactcctaaagatatttcgatagctattatcggtggaggcgtgtttggcgcattattccaagtattcttctttgataaatttatgaaatatatgagtgaacttaattttattgcatggtcattactatattcagccattgttctcgttatgttagtgcttgcaaacggttattggacgattatgattattagctttgttgtttttataggttttgatatgattagaccagctttaaccaattacttctcgaatatagcaggcaaacggcaaggttttgcaggtggattgaattcaacttttaccagtatgggtaactttataggtcctcttgtagctggtgcattattcgatgttaatttagagtttcctttatatatggctattgcggtttcattaagtggaattatcattatttttattgaaaaaggacttaagtcacgccgtaaagaagcaaattaa

SEQ ID NO: 3582 - DNA, 123 bp, Staphylococcus epidermidis
atagtaattttagacactgatcaatcttttaagttggttattttaaatatcaggttccaattttttcttttacaacttaacaattctacttacctcatataccttctaaaacaggtttcataa

SEQ ID NO: 3583 - DNA, 930 bp, Staphylococcus epidermidis
atcactttcttaactcactgtgttatatttattttcaacaaaatcttctattcactttacactaggttaataaatttaacaactgatgtgttgtatattataatctatataaatgtttataaggaaggtacaaaaatgagcgtttcggtaaatattgaaaatttaacaaaagaataccgtatctatagaaataataaagatagaattaaagatgcattaatacctaaaaacaaaaataaaacattttacgctctggataacgtaagtttaacagcgcatgagggagatgtgataggtttagtcggcatcaacggttcaggtaagtctactttaagtaatatgattggtggctctatttcaccaagttccggtgaaataacgagacatggtgatgtgagtgtcatcgctattaatgcaggactaaatggacaattgacaggtgtagaaaatattgaatttaaaatgctctgcatgggctttaaaaggaaagaaattaaaaaattaatgccggaaattatagaatttagtgaactcggcgaatttatttatcaacctgttaaaaaatattcaagtggtatgcgtgcaaaacttggattttcaattaatattactgttaatcctgacatattagttattgacgaagcattatcagtaggcgatcaaacatttactcaaaaatgtttagataaaatttatgaatttaaagcggctaaaaaaacaatattttttgttagtcataatattagacaagtgcgtgaattttgtacaaaaatcgcttggattgagggcggtaaactaaaagaattcggcgaacttgaagaagtattacctgattatgaggcgtttcttaaaacttttaagaaaaaatctaaagcagaacaaaaggaatttagaaataaattagatgagtcacgttttgtcgtaaaataa

SEQ ID NO: 3584 - DNA, 138 bp, Staphylococcus epidermidis
ttatctcttattaaggctaagcatctttttaaagctgatatagtggttatactcattgtgaatagtaaatatttaaaaagtttaacaagttattacactttaaaattcacttatgatattatcatctttgttatataa

SEQ ID NO: 3585 - DNA, 1368 bp, Staphylococcus epidermidis
aattcacttatgatattatcatctttgttatataactcatataaagaatggtggaaatttatgagcaaagtaaataaacctttatatttctatcttatgttatttctgttgacaactttaattggtgcttttctactctatttgccctatacagggaagaaacccattaactttattgacgcattgtttgtagcttctagcgcattcacagtaacaggtctatcaccagttgatgttggaacacaatttaatatttttggagaaatcattatcttattacttatacaaattggtggattaggtattgtcactgtagcaatgctaactctcatctttttaaataagaaaatatcaattaacaatagaattttatttatgattacttggaatattgacgaacccggtggtgtaattaaacttattaaacatctagccatatacagcatcgccactgaattatttggtacactttgtctatgtttatcgtttattccaaaatttggcataggtaaaggtctatttttaagtttattcacttcagtttccgcatttaacaacgcaggattcgccctttttaaaaacaacttaatcgatttttcaaatgatccggtaatcattatcactattccaatacttatcattttgggaggtttgggacatttagtcgtggttgatttgtggaacgccaaaagttttagaaaattatccttacactctaaactcgtgttaactaccactggattattaattttgataggcacggttttcttctttttactagaaaatcaaaactctatgttacacatgggattaattgaaaaaataggaaatgcatttttccaatcagtgacaacaaggactgcaggatttaacacaattgacgttggaaacattaaaacaccgacagctttattacttatggctctcatgtttattggaggtgcaccattgagtgctgcaggtggtataaaggttacaacttttgttattgcaacaatcgctatttttaatacgatacgcaaagaaaaaaacaactctatatttaatagagaaatatcagaaagatacatacagttgtctttcgtaactattctcatttctattgcatttatcggtatggttacgtttatacttaccataatcaattccaatatacctttaatcaaaatactcttcgaagtcgtatcagcattcggtacagtcggtctcactatggatttaacttccgaatactataattggactgagtttattattatcatcgtaatgttatgtggtaaaattggattactgaatattagtagagcgcttgttccacctaaagaccctaaaaattatagatataccaaaggacacattcacttataa

SEQ ID NO: 3586 - DNA, 135 bp, Staphylococcus epidermidis
ggggatattattttatcagccaaaagagttccggttttttttaatccaaacacccgttggggaataaaatttaacaaaaaggaagttgtagtaaaaaaagggacttttgaagtattccagccagggaaaaattaa

SEQ ID NO: 3587 - DNA, 726 bp, Staphylococcus epidermidis
gatgacattatgggacgtaaatggaacaacattaaagagaaaaaagcccaaaaagataaaaatactagtagaatatatgccaaatttggtaaagaaatatatgtagctgcaaagtctggtgagcctaatccagagtcaaatcaaactttaagattagtattagaacgtgcaaaaacatattcagtacctaatcatattatagatagagctattgataaggctaaaggcgctggtgacgaaaactacgatcacttaagatatgaaggttttggtccgaatggttcaatgcttatagttgacgcattaacaaacaatgtaaatcgtacagcatcagatgtacgtgctgcgttcggtaagaatggaggaaatatgggagtatctggttcagtagcttatatgtttgaccatactgcaacctttggtgtagaaggtaaatctgtagatgaagtcttagaaacactaatggagcaagatattgatgtaagagatgtaattgatgacaatggcttgactattgtttacgcagaaccagatcaatttgcacaagttcaggatgcattacgtgaagctggcgttgaggaatttaaagtagcagagtttgaaatgttacctcaaactgatattgagttgtctgaagaggatcaagctatttttgaaaaattaatcgatgcacttgaagacttggaagatgttcaaaatgttttccataatgtagatttaaaataa

SEQ ID NO: 3588 - DNA, 1524 bp, Staphylococcus epidermidis
cttataattattgttatacagaatgaggaacggaggatctatatgcaattttttattaatcaagatacgccaacatcaattgaaacgattgtggtgggtgtgccagatcacctcaaccaattaggtgagataaaatatcataagacgttaattaaagaacgattagaaacattaaaacaatatcatgtcatcaatagctcaatcggcaaaatatcatcaacgcttatctacattgatgaaaagcctaaaagattattaactgtaggactaggaaacttaaaaatcttatcatatcaacgtttattaaaagtttggggtcagttgtttcaatatttaaaagacgttcatgtcacggattgtgaattattgttagatactttcaaatctaaacatggtaacattgttgaaatttgtcaaactttaggtttacaaagtgcacaatctatctttgaatttgaccattataaatcggataaaaagcctccatatcaaggtagagtctatatacaaacgacagagcataatatagaaacgaagattaacgaaggccaacaattgggtgaatctataaattatgctcgtgaactaagtcaaatacctccgaatattttaacaccccaatattttgccgaagaaataaaaaaacatttcgaagggagttccgttagtgtagatatcaaagatcaccgacaaattatagatgaaggatttggattaatacatgcagtaggtaaaggttctaatcatggtccgagattaattacggtatcatactatggtgcagaagctgatgaaccacctatttcattagtgggtaagggtattacatatgattccggtggatatagtattaagtctaagataggtatgcaaactatgaaatatgatatgtgcggtgcggccaatgttattggtatgattgatgtgatctctaagcaaaacctacctgtaaatattgtaggaataatcgcttcagctgaaaatatgattggtgaatcttccatgaaaccagatgatgtatttactgcgcttaatggggaaacagtagaaatgttgaatagtgatgctgaaggtagaatggttttaggtgacgcagtattctatgcaacacaatttaaaccacaactaattcttgattttgctacattaacgggtgcagcgattgtagctttaggtgatgacaaggcggctgctttccaatctcatgctgaaaatgaacttaaaaacttattaacagttgcacgtcatgtagacgaaaaagtattcgaattacctattacagagactgaaagacatttaattaaacaatcagatgtagcagatttagtcaatcatacgaacggtcaaggaaaagcattgtttgcagcagcatttatttcgcattttagtggtgacatcccacacattcactttgatatcgcgggccctgcaacaactaaaagtgctacatataaagggccaaagggtccgacaggttacatgatacctacagttgtagagtggttacaacaaaaatataaataa

SEQ ID NO: 3589 - DNA, 873 bp, Staphylococcus epidermidis
aaggagattattatgaaaaaattcaaatggataaatatatttaaaggttttggtatgggtacaagtgatctcgtcccaggtgtaagtggagggactatcgctttattacttggaatttatgatgactttattagctcaattagtggtttgttttcaagacgattttggcctagcttaaaatttttactacctattttagtagggatgctaatagctataggactattaagtcaattatttaattatttgcttagtcaacatcatattcctactatgttattttttacaggtttgattctcggtatcatcccttatttattaaccatctcaaatttcaaaaaaaatttcagtataatacattattttattctattattaggtattgctattatagtcgttttcgcattgcttaatcatggagacaagcattcaggtgaaacacttactttatctttcagtcttatcattaaatattttatcgcaggtgttttcgcttcaagtgctatgttattaccaggcatttctggatcatttatgttacttgtcttcggagtatatgggacgctaatgtatgctatttctgaactacttcattttaatttaaatgcattacctatcatattaatagtaggtttcggtattgtaactggttttatgatttcaagtcgattaattcaatattgtctacatcaacaccctacaatgacatttgctttgataataggctttgtaatcggatcgttgtatgcagttttccctggattcccgaaagacttaatccaatggatcatatcatttttcctattgatcactggcttcttagtaagttatgttcttggtaaaattacagcaaaaaatgaagcatcattttga

SEQ ID NO: 3590 - DNA, 507 bp, Staphylococcus epidermidis
atgattgttataaagggtgagaatatgtctaaaactaaaaaaacaaatgcaatgcggattttagatagagctaaaattaattatcaaatgaatacttacgaagttactgacaagcatcaacatggagaagagattgcacaactcgtaggtgctaaaatagaagaagtctttaaaacacttgtactagagaattccaatcatgaacactatgtttttgtcattccagttaatgaaaccttagatatgaagaaggcggctcatgttgttaatgaaaagaaattgaatttaatgcctctcgatcaattaaaacaagtaacagggtatgttagaggaggatgttcacctatcggtatgaaacattcctttaaaacgacgattgatgcttccgctaaaaatttagaaaaagtttatattagcggaggtcaaagaggaatgcaaattatcattcatgtgaatgatttaattgacatgacaaaggctcaggtagaatctattacacagaattaa

SEQ ID NO: 3591 - DNA, 126 bp, Staphylococcus epidermidis
agatgtgttataatttctttcgtatataatgaacggaggacaatttttatgcatacattaatcatcgttttattaattatagattgtattgcattagtgactgttgtattactccaagaaggttaa

SEQ ID NO: 3592 - DNA, 126 bp, Staphylococcus epidermidis
attttagttatatatataatattccaagtgggagcaactattgttatctgtacctttatgatttatattgtaacgctatcagttactagaattaaaaataaacaaaaaaggagcgctttaacgtga

SEQ ID NO: 3593 - DNA, 627 bp, Staphylococcus epidermidis
  modified_base (57)..(57): a, c, g, t, unknown or other
tgcgtggttatgcaatctcgttactttgcaagaatatactttattatcttatttgtnatatctatgactgaatcacatatttttaactttatgacgttaaatttatttttagcatacgtgccatttgaactttgtctacttttaaaattgttcaaaccagtcaaagcttttgaatggcccttatttattgttttcggactcatatttctattattagttccaaacacattttatatgattaccgatctcatacacttaaaccaatttcaatttaactttttagctggattaaacatcacagaatggatttatttcacctatttaatacttggcgtactcttagcaatatacctcacaattcttatatttttagaaattgcacattttacgtcttatgtatggttaaatcgactattgatagttatattaatgttcttaaatggattaggtatttacatcggtcgattcttaagattacatactgtctatttattaaatgcacctttaaaaattgtgaaagaggtttttttaatcatagatgttaaagcgttactatttgtcgttttaatggtgctcatacaagcaacagtcatattgtttattaaaggggtgagattataccaatga

SEQ ID NO: 3594 - DNA, 240 bp, Staphylococcus epidermidis
ggaggaatttttatgattacaaaagaagatattgttgcagatgttgtaacagattatcctaaaagtgcagatatatttagaaatgctggaatagatttttgttgtggcggacaagagagtatcgcttcagctgtcaatcataaaccaaatattgacttaaattccttattaaataagttgaatcatattgataatacagaaggtaacagtaccattaatcctggaacttttaaatggtga

SEQ ID NO: 3595 - DNA, 141 bp, Staphylococcus epidermidis
atcatgtctatgtactaccgcaattacacacattattatggagtaataaaaaaggtgtctaatattgaaaaaacgtttaaaaaaatttctgagtgttatgaaatgattaagttaatgttaattgatataatgaagagatga

SEQ ID NO: 3596 - DNA, 909 bp, Staphylococcus epidermidis
ggtgaaactatgaaacgctatttaattactggtggaactggcatggtcggttcccacttggtcaacgaaattaaacaaaccgatgcacatattacaattttaaccagacaggataaaacttctaatcatcccaaaatcacgtatatcaactggtcaaaagagggttggcaacatcaagtaccagatatagatattgttattaatctagctggtgcaacgttgaataaacgttggacatcttcccacaaacaagcgatgatgcttagtcgtattcaatcaacgcaaacactatttgaactttttgaaacacgtgaacacaaaccagaagttttatttaacgcaagtgcaatgggctactaccctccagatttatttacaagttatacggaattatatcgaacacttccatttgatttcttatcagaaattgtatatcaatgggaacggtttgcgaataaatttaagcaattcggtacacgtgtcgttttaggtcgattcggtcttattctatcagacgatggtggtgctcttgaaatgatggaacttccgtatcgtttatatgttgggggaaaactcggctctggaagacaatggtactcttggattcatatcgatgacttaattagaggtattttatttactatcaatcatgataacgctgaaggtccatttaatttaactgcacctattcctgaaagacaaaacttatttggttatactttagcacgtgcgatgcataaaccacatgaaacgtgggcacctaaattgatactacgtgcagtgctaggtcagatgtctactgtcatattagatacacaaaaagtacttccaaataaattacatgcactaggttttgagtttaagtataataatttaagaaatgctttagatgatttaattaaagcttaa

SEQ ID NO: 3597 - DNA, 864 bp, Staphylococcus epidermidis
ggggacgctatgaaaatagatgattatcgtttgctcattactttagatgagacaaaaactttacgcaaagcagcagaaattctatatatttctcaacctgcagttactcaacgtttaaaggcaattgaggctgcatttggagttgagatttttattcgtacaaaaaaacagctcattactacgactgaaggttcaatgattattgaacatgcgcgtgatatgctcaaacgtgaacgtttattttttgataaaatacaagcacatattggtgaagtgaacggtacaatttcaatcggttgctcttcgcttattggacaaacattgcttcctgaagtattaagtctttataattcgcaatttcccaatgtggagatacaggttcaagtaggatctactgaacaaataaaagcgcatcatcgagactaccatgtgatgattacacgtggaaataaagtaatgaatttatcgaatacacatttatttaatgatgaacattattttatatatcctaaggatcgtaaggaagatgtaactaaactgccttttattgaatttcaagcggatccaatttatattaaccaaattaaacaatggtataacgatcatttgggacatgattatcacgcgacaatcacagttgatcaagttgccacatgtaaagaaatgttgcttagtggtgtaggggtaactatactaccaaaaattatgatgaaaaatatcgataagaacatgtttgaatttgaaaaagtcactattgataaaaagccacttattcggtcaacatacatgagttatgacgcaagtatgctacaacttcctcaagtagacgcattcgtaaatttaatgttgaactttattagataa

SEQ ID NO: 3598 - DNA, 201 bp, Staphylococcus epidermidis
cctctgtatattctctctctaccaggcgacgccagtgacgtttgtctatatattttactttcacagtcaccaactccttgcttttattatattaaactaggatgtcaatgtcatcttaagtctcagataaatactgtttacataaatgttcttattaaatcattaagactattttactataaattgatttattttacttaa

SEQ ID NO: 3599 - DNA, 894 bp, Staphylococcus epidermidis
tcatataatattgaggcgatgatattgaattcaaaagttaaaggtattattgctatattgatttcagctgtgggttttagttttatgtcagtcttttttagattggccggtgatttaccagtctttcaaaaatctctagctagaaattttgtagccatgtttataccattattttttatttataaatataggcaacctatgtttggaaaattaagtagtcaacccctactcatctcacgttcaacacttgggttaattggtgtcttacttaatatctacgcaattgatcacatggtattaagtgatgctgatacattaatgaaattaaatcctttttggacaattgttcttagtttaatttttttacatgaaaaggtacgaaaatatcaaatcacggcgatgattattgctataatagggatgctattaattgttaaaccagaattttcatcatcagttattccttcaatagcaggattactatccggtatttttgcagcttctgcctacacatgtgttagagcactcagcactcgtgaaaaaccttatacgatagtgttttatttttcattattctcagttgtagttcttatacctttttcaatatttacttatacacctatgacaacaattcaaattcttttcttactcggcgctggattatcagcagctgtaggacaaattggtataacattggcttatagttttgctccagcaaaagatatctccatcttcacatatgcgtctataatatttactgcattatttggatttattctgtttggagaatcacctgatatgtttgcaacagtaggatatattgtcattatcggagcaagttactatatgtttgataaagcaagacgtgaaacaactataaatcaaaataattaa

SEQ ID NO: 3600 - DNA, 354 bp, Staphylococcus epidermidis
gggggtaatatgcgtagtgtaattaagttggaaaatacatttatattcataatcacaatcgccgtttatgttaaattagaattttctatatggctgtttttacttttactattagttccagatatatttatgttaggatatgtgattaatagaaaaacagggagttatgtctacaatattggacacacgtatatcacacctataattatcgcgctattatatttatacattgatgaaaggttactattacagatttctttaatatggttagctcatattagtatagatagaactttaggtttcggactcaaatattcatcagatactgataaaacgataatacaaaagatgtaa

SEQ ID NO: 3601 - DNA, 1161 bp, Staphylococcus epidermidis
gggttaaatatgcacattgaatttaagtatcgctattatgaaaatgaaaaggactatgaagactatcaattagaaatggataactttcaagattctaaaattgcatatcgtcttgatgaagtaggggatgtcattcactttgcagaacaagaacaacgtaacggaagctatgttgcactttatgttacttatgaagcagcacctttttttaataaggaaatggtggtcaataatgtgaaacaatcccatatttttgctgcagcttattcatttaaatcggtcaattcgataaaaaatataaaaaaagtaatgcccaataaaaatcatataaaaactgaaggattttatttttgtgaaagtgataaagcgatgattaacaagatcaaatcgattcataaagccattattgaaggggcaacgtatcaggtgaattacacaacccgcttaaaagcagaagttttctgtcctataagtcacttatattatcaacttactatgtcacaaaatggtaattataccgttttaatggacacacctgatataaaagtagcatcaatatcgcctgaacttttctttcaaaaaggtgactataaaggtaaatcaaatatgattgttagtaagccgatgaaagggactatgcctagagggaaaaatgttaaagaagatgagctatattataataatttaaaaacctcctctaaagatatggcggagaatgtgatgattgtagacttattacgtaacgatattacaagaattgctcaaagtggaactatagatgtacctgaattgttttcgattgagaaatatgacacagttttccaaatgaccagtacagtgtgtggccgattacaagatgacattcaattgatagatatgatgcgagcgctctttccttgtggttctattacaggtgcaccaaaaataaatacaatgcaatatatagctcagttggaggacatgccaagatccatttactgtggaacaattggcttattacttccaaaccaaaggatgatatttaatatccctatacggacaattgagtataatcatgaagaagcggtttatggggtgggtgctggtataacaattgattcagtacccgaaaatgaagttcaggaatttcacgataaaactaaaattttggagcggttataa

SEQ ID NO: 3602 - DNA, 399 bp, Staphylococcus epidermidis
ggtgaaaatatgattaaagtcgaccaacaatattttgaattgatagaagaatatagagaatgttttgatgaggaaatattttcagctaggtattcggatatattagacaaatatgattatgtcgtaggtgactatggttacgatcaattacgcttaaaaggattttataaagatagtaataaaaaggcagaaataagtaaacgattttcaagtatacaagattatatactagaatattgtaattttggttgtccttattttgtagtcagacgattgtcaccaaatgaatttattgaagaaatagatgataaagaagatatcattgataaattacatgatgttaagattcaacctactattcaagacacagaaaaacatacccaagctatagatcaatag

SEQ ID NO: 3603 - DNA, 597 bp, Staphylococcus epidermidis
ggtatgaatatgattttaatgatagataatcaagattcctttacatgtaacttaatagattatattaaagtacaaactactgaagaagtgaaaatcatttctgtaaatgatttgatgacacagcatctcgatgcattgaatccgagagcgattgtcatttcacctggacctgggaaacctagtgattatccaatactatcatccgtattagaaatatttcaccgtcacgttcccattttgggcgtctgtttaggttttcaattaatcattgaatactttggaggaaacattattcataatgataaacctattcatggacatattaccaagataaggcatagcaatgagggtatttttaaaggtctaccatcgtattttaacgtgatgcgataccattcacttatggctgacccctctacaatacctagcgcattaaaagtcacagctctgaacaacgagaatgttattatggctgttgcacatcataagtatcctatttatggtttacagtatcatcctgaatctatactaagtgaatatggtcacgaacaattaaatttattcttaaccgaggtaggggttaaatatgcacattga

SEQ ID NO: 3604 - DNA, 405 bp, Staphylococcus epidermidis
gataatgatatatgcgttgtctacttatatttggaggtgcagattttgaatgagcagaaattaattaaattactagaattttacaaacaatataaagcattatctggatatatagataaaaaatataagttgacgttaaacgatcttgctgtactatatttagctaaaatatattgcttagatgagcgaattcttatgcaaacttttctaaaactggctacaggagagttagatattagtagaactaagattttgatgtctattagaagattgatagacaaagaaaagttaaataaagtaagatcgaatagagatgaaagaaaaatttttctatatatggatgaaaataatatgagtgaatttgatgctttatttgaagatgttgaaaaattcttaagttattaa

SEQ ID NO: 3605 - DNA, 744 bp, Staphylococcus epidermidis
cgaggtgatattatgaaaatatatagtcaaggcgaccaagccattgttgtttcaatagagaaaaatgtatctcaaagactgacagaagatttactttcattgagagcatatttaattgataaatcatatccatttattactgaaattgtagctacagagtctgacctaatgatttgttatgacgcaagagatatgattaaacatcaccatattcagtcaccatttttatatatgaaagctttaattgattctataaaattagaaattagacatcatcgacaacaacttcaagcaaaatatattcaaaaacaacaatctgttaatattccagttatatatgggggagaatttgggcctgatttacaacatttgttaaagcatcttaaactcaaattagaggattttgtaaaattacatactcaagaaaaatattttgtatcaatgatggggtattcaccaggatttccgtatcttactggaatgaataaaaaattgcatgtgaaccacacaagtgaaaagaaaaaattcatcccttgtggatcagttattatggaaggaaaaaaatgtggaatagttactactgatacatataatgattggttagttatcggatatacaccagttcaacttttctttcctgagcaacaaaactttacattattaaagctaggagacaatgtcacgtttgagtctaaagatatcaatgaaatagaactaggagattataaaacatgtcaatcataa

SEQ ID NO: 3606 - DNA, 1743 bp, Staphylococcus epidermidis
agacgaggtataactatgaaagaacaaaaccctttgtttttcttatttaaaagactctcatggccatatgggttaatcattgcagcggttatcattacttcgttgggaagtttaagtggtttattagtaccattattcaccgggcgtttagttgataaattttccgtcagtagtattaattggggaatgatagctatatttggctcgattttcttagttaatgcattgcttagcggtataggcctatatttgttaagtaaaattggtgaaaagattatttatgcgattcgttcattattgtgggaacatattattcaattaaaaatgccgttctttgataaaaatgaaagtggccaattaatgagtcgtctaacagatgatacaaaagtgattaatgaatttatttcacaaaagctacctaatttattgccttctgttttaactttaataggttcattagtcatgctatttatcatggattggaaattaactttattaacatttattactattcctgtatttattttaatcatcgttcctttgggacgtgtgatgcaaaaaatatctaccaatacgcaatctgaaattgcgaacttcagtggattattaggtagagtgcttaccgaaatgcgtttagttaaagtatctaatactgagcgtttagagttagataatgcgcatacaaatcttaaaaaaatatatagattaggattaaaacaggctaaaatatcagcagtcgtacagcccatttctggtgttgttatgctattaactattgcgattattttaggttttggtgcattagaaataggtactggagcaattactcctggaacacttatagctatgatattttatgtaatccagttatctatgccactgattaacttatcgacactagttacggattataaaaaagctgtgggtgcgagcagtcgtatatatgaaattatgcaagagcctattgaacctactgaagctttatcagaatctaaagacgttacgatcatcgacggcgaattagtatttgagcacgtggattttaaatatgacgttaaaaagattttggaagatgtgtcatttagtattccacaaggtgaagtgagcgcgtttgtaggaccttctggttcaggtaaaagtacgatttttaatttaattgagcgcatgtatgatattgaacgtggagatattaaatacggtaatcaaagtatttttgatattccactttcaaagtggcgcacaaaaattggttatgttatgcaatctaattcgatgatgagtggaacgataagagataatattttatatggtattaatagaaaagttgatgatgaagagttaatagagtatgctaaactagctaattgtcatgattttattatgcagtttgacgaaggttacgacacgatggttggtgagcgtggactcaaattatcaggtggtcaacgacaaaggatagatatcgctagaagttttgttaaaaatcctgatattttgttattagacgaggcgacagcgaacctagatagcgaaagtgaattgaaaattcaagaagcacttgaaacacttatggaaggcagaactactgtagtcattgctcatcgactttcaactataaaaaaagctggtcaaattgtatttattgataaaggtgaagttaccggtaagggaacgcatcatgaattgatggcaagtcatgataaatacagacattttgttacatctcaaaaattatcagattaa

SEQ ID NO: 3607 - DNA, 834 bp, Staphylococcus epidermidis
agcaagattttagagaatgaaagtaggggaattattatgagtcgtttaagtggtgaacaagtgaaaattggctacggtgattctacgattattaataatttggatgtcgcaattcctgatggaaaggttacttctattattggacctaacgggtgtgggaaatcaactttattgaaagcgttatctagactattgtcaattaaagaaggtaaaattaatttggatggtaagagtattcatgccacatccacgaaagaaatagctaaaaaaatagcaattttaccacaatcaccagaggtcccagatggacttactgtaggagaacttgtttcttatgggcgttttccacatcaaaaaggatttggtcgtttaactgcagaagataaaaaagaaattgattgggcattgtcagttacaggtacaagtgaatttcgtcatcgtactataaatgatttaagtggtggacaaagacaacgcgtgtggattgcaatggcactagcccaacgtactgatattattttcttagatgaacctacaacttatttagatatttgtcatcaattagaaatattaaatttagtcaaaaagctcaacgaagaagaaggttgcactattgtgatggttttacatgacattaatcaagcaattcgcttctcagatcatctcattacgatgaaagctggagatattgttgctactggtcaaactgatgaagtgttaactaaggacattttagaaaaggtatttaatattgatggtgttttagatatagatccgagaacagggaaaccaattttagttacttacgatttattctgtcagacgtattcgtga

SEQ ID NO: 3608 - DNA, 456 bp, Staphylococcus epidermidis
aacattatcttgaacataaaggagaagaataaggaaatgcaacaaatatatccaagtgtcactcacccatatcaattcgaacttaacaaagattttaacttttcagctgcacattacattccctttgaagaagcgggaaaatgtattcgtacacacggtcatacgtattacgtcaacttaacaatcgctggtaatacactagataaatgtggatttttagttaattttagagatttaaaaaagctagttcatgaacaatttgaccattatttgcttaatgacttacctgcttttaaggataaaagtccctcaacagaaattgtcgcacaaacgatttaccacattattcaaaaagagttaaatcaaagagagaatcaaccgaaatgtgttcaagtttatcttagagaaacaccttcaagttacgtagtttatagaccaaaggaagatcaagtgtaa

SEQ ID NO: 3609 - DNA, 447 bp, Staphylococcus epidermidis
ttaactatctttaaatttaaaaagatgggttttaagatttatggatatgatataaatagggaggtttcattaatggctatttcaaaaatcaatgactgctttgaattattagctatggtcacttatgctgacagattaaaaggaataattaaaaaagaattctcaatcagctttgaagaatttgcagtattaacttatattagtgagaataaagaagaggaatattatcttaaagatattatcaatcacttaaattataaacaacctcaagttgttaaagctgttaaaaatttatctcaagaaaattactttaataaaaaacgtaatgaacacgatgaaagaactgttttaatcttagtagattctaagcagcgtaaaaaaatcgatgatttacttaaacgagtaaacaaccgtatcacagaagcaaataatgaaaatgaagtataa

SEQ ID NO: 3610 - DNA, 144 bp, Staphylococcus epidermidis
ataaccatcttaaacactccatttaatcgaaaatgcttattttgcctatattttaatataaaattaacgcgttatgaagtttttaactctactcatatcgcgttatttaaacatatattcttttttatatttattagtttttag

SEQ ID NO: 3611 - DNA, 216 bp, Staphylococcus epidermidis
ttaaaaatcttaaaagtaaattaccaagcaaataatccaacaaatgcagcagtaagtaaggatactaaaattcctgctaacaacatcatcggtacatatttggaaacgaaatccgacgttttcttatcaacaatacctttcaatgtacctataatcattccaatagttgaaaagtttgcaaaagaaactaaaaatgttgatataactgctctatga

SEQ ID NO: 3612 - DNA, 876 bp, Staphylococcus epidermidis
tgtggtatcatgttgttggtgataaatatgatagaaataggtcttactggctggggtgaccatgatacattatatgaggatttagagcgtaaaacagataagttaaaaacgtatgctagtcacttcccaatagtagagttggatgcttcgtattatgcgatacagccagagcgaaatataattaaatggataaatgaaacgccgaatagatttcaattcgttgttaaaattcatcaagcattaacattgcatgctgactatagagattatgcagagtcgagagatatattatttaaacagtttaaagaaatgatcaatccgttaaaagagcataataaattggcgatggtgctcgtacaatttccaccttggtttgattgtaacgtccaaaatataaattacatcttatatgtgagaaaacaattaactgatattccgatgagcattgaatttagacatcaatcatggtttgacaatcagtataaagaacaaactttatccttcttaacacaacatcaaatcattcatgcagtggtagatgaacctcaagttaaagaggggagcgttcctttagtaaataggattactagtgaaattgcttttgtacgttatcatggacgtaatcattatggttggactaaaaaagatatgactgatcaagaatggcgagatgtaagatatttatatgattatagcaatgatgagttagctgacttggctcgtaaagtcgaaatacttaatcaaaaggctaagaaagtatatgtaatttttaataataactctggcggtcatgcagctaataatgctaaaaagtatcaaaatattttagacattgattatgaaggtttagcaccgcaacaattaaaactattttaa

SEQ ID NO: 3613 - DNA, 129 bp, Staphylococcus epidermidis
tggcaagtcatgataaatacagacattttgttacatctcaaaaattatcagattaatattaaccacgccctaattaatgagtggaagggcgtggttttttatataagttttgtaaaaatgtcattttaa

SEQ ID NO: 3614 - DNA, 240 bp, Staphylococcus epidermidis
ggaggatacatcagtatgtcaaaaactttggaactcgtatttaaatcaaatcttaataaacccgtcaaattactattacccgattttaacgctattactacagaacaattaattaaagaaagtatgaaccaacttttagaattagacattttaagatttagtttgggaaagcctgtcaaaatttatgctgcacaacttattgataaaagtacaactgttatatttgaagataaaaattaa

SEQ ID NO: 3615 - DNA, 609 bp, Staphylococcus epidermidis
gagttcaacatgattatatatatattaattaacatcgccatcgtcttgctaattcttggcttcgatttataccgacatcgtttcagacagcttaagtttagctccatattattatctgttttaatcaatagcatgattgatatttttgcgattaatcaattcaattttattacgatgtttaccgtcacgctatttatgatatggacacttttacaaatatatttaaatttcaagctatatccttttgtaatttctgaccaaaagtttattgctataatactagccattgttataagcttattgcaatttattacagataaatcgagcacacaatcggtgtacatgtccatcccatatttatcacccacgatatttataataggggcgattttactttttgtaggtactttcaaaatagacgaagttgaacgtctttcactatttcgtaaaattaaaagaccaatgacaacaggtacaattattattatcctatctctcatatcaacgatgattttaacgcccttttggtatgtctttttaatcatttatagcttactcattggttttatattatggcaaggtgttttcttcataaaagataaaaaataa

SEQ ID NO: 3616 - DNA, 1080 bp, Staphylococcus epidermidis
ttttatgacatattaaaaaaattgagttataaaaagttagagaagttacaaacgaatactcatttaagttatttaaatgggattaagggtataataactttaaaattaaacagacgtatccacgcctggaggagagacatggaaaataaacctgattattttcaccacattgaacatagaaagtttcaaagtagctcaaaaattacattatggttatctttagttattactatgatattcactgtagttgagttcgtaggaggtattgtgtcgaattcactcgcgttactctctgactcatttcacatgctaagtgatgttctagcattaggtttatcaatggtagcgatttatttctcgagcaagccacctacaaagaactatacatatggttttttacgcttggaaattatcgtagcttttctcaatggcttagcacttattgttatttcactaggaattatgtatgagggtatcatgagaattatacaccctagacctgttgaaagtggcattatgattctaattgcgtttattggtttaattgccaatatcgtattgaccatcattttaatgatttctctaaaaaaagagaataatattaatattcaaagtgcattatggcattttattggtgatttattaaattctttaggtattattgtggcgtttgtgttgattcattttactggatggaacattgttgacccaattattagtattctcatttcattgattattttaagaggaggatacaaaattattaaaaatgcttcaaaagttctgatggagcgtgtgccggatcgatatgatacagatgaaattatgggagcaatgaaagatgttgaaggcgtgatagatattcatgaattccatttatggagtgttacaactaatcaaagttctttaagtgcacatgttgtactaagtgatgactacattaaatcgccttatgctacaataaataaagtttcggatttgttaaaaacacaatacggtttagaacatgtaacacttcaaattgaaaatataaacctcaatcatttagatgaggagtatttcaaacaacttcaagaatag

SEQ ID NO: 3617 - DNA, 1278 bp, Staphylococcus epidermidis
ttaagggacataatgaagaacacgcagaagatatgttatttctttagtgtcaaatcattgttacttagatttatagattattctcatacatcctttagtatgtttaaaataatttttggaaaagagaaaaataaggtggttaagacaatgaaagttttagtagccatggatgaatttaatggaattatttctagttaccaagctaatagatatgttgaagaagcggtagcaagtcaaattgaagatgcagatatcgttcaagttccactatttaacggtcgtcacgaattattagattcagtctttctttggcaatcaggaaataaatatcgtgtgagtgcgcatgatgctgacatgaaagaaaccgaagcaatatatggacaaacggatagtggtatgactattatcgaaggtcacttatttttaaatggcaaaaaacctattcaacatcgatcaagttacggtttgggagaggttataaaagcagcattggacaatcatacagaacatcttgttatttctttaggtggaataggaagttttgatggcggtgcaggcatgttgcaagcattgggtgcaacattttatgatgatgaagcacaaattgtcgatatgaggaaaggtgcatatttaataaaatatattagacgtattgatttatcaggtgttcatccacaattaacaaaggtaaacattcaattaatgtcagatttctcaagtcgattgtatgggaaaaaaagtgaaatcatgcaaacatacgaatcattagatttgtctcaaaatgaagcagccgagatagataatttaatttggtattttagtgaattatttaagaatgaattgaaaatagcaatgggaccaatcgagcgcggtggtgctggaggtggtatagcagctgtattaaatagtctctatcaagctgagattttaacaagccatgaattagtgaatcaaatcacacatttagaaaacttaattcaacaggcagatcttattattttcggagaaggtttgaaagaagaagatcaaattctagagactacaacaatacgtatagcagaacttacccaacaatacagcaagccagctattgcaatttgtgctacaaatgataaatttgatttgtttgaatcattgaatgttacagcaatgtttaatacatttattgatatgcctgattcatatacagattttaagatgggtattcaaatcagacattacacagtacaagcactaaaattattgaaaacgcaaataaacttaccgctttcatcctaa

SEQ ID NO: 3618 - DNA, 225 bp, Staphylococcus epidermidis
atctactgcatcatcacttcgtatatctttgaattattcttaaattactttaattttaaaatcaaatttatactgtttaattataaaaacgcaccccaaaagctaaaatttagtctagcttttggggtgcacaatattgtcttgagcattttaatatgctttcagtcgatgactggattaaaaatgtatttatgtcaagcttactatatcaataattcagagtag

SEQ ID NO: 3619 - DNA, 942 bp, Staphylococcus epidermidis
ggtgaatgcatgttaacaacagatagattagttaatacgttaaatttagaattacttactggtgaagaaggtttagatagaccaattaaaaacacagatatttcacgtccaggtttagaaatggctggatatttttcacattatgcttcagaccgtattcaattattagggacaacggagttatcattttataatttacttccagatgaagagaagaaaggaagaatgagaaaattatgccgacctgaaactccagcgattattgttacacgtgggttagaaccacccgaagaacttatacaagcatctcaagaaacgcatacaccaattattgttgcgaaagatgccacaacgagtttaatgagtaggttaacgacatttctcgaacatgaactcgcgaaaactacttctttgcacggtgtacttgttgatgtttacggtgtaggtgtactaattacaggagattctggcattgggaaaagtgaaactgcattagaattagtcaaacgaggccatagattagtggctgatgataatgtagaaatcaaagaaattactaaggatgaacttgtagggaaaccgcctaaacttatcgaacatttgctagagattcgtggtctcggaatcattaatgttatgactttgtttggagcaggatcaatattaactgaaaaacaaattcgattaaatattaatttagaaaattggaataagaataaattatacgatcgtgtaggtcttaatgaagaaacattgaaaattcttgatacggaaatcactaaaaaaacgataccagttagaccagggcgtaatgtagcagtaattattgaagtagctgctatgaattatcgtcttaatatcatgggtattaatacagcagttgaatttaatgagagacttaatgaagaaatcgttcgaaatagtcataaaagtgaggagtaa

SEQ ID NO: 3620 - DNA, 297 bp, Staphylococcus epidermidis
ccgcctggcataccgcgttcaatcatgacagtttttaaattggcacgagatgcatatactgctgctgtcataccggcaggacctgcaccgattattgctacatcaacatctacttcagtcattttaaatgcctcctacttattaatcattatgcgcattatatatcatacttttcatttcataaatttatatgctcaatataaattcaattgctttattcagtttgtatctagaaacattaaaatcgtccatcaattgcctcttggtaagtggttggctagaacgacgatacgatag

SEQ ID NO: 3621 - DNA, 330 bp, Staphylococcus epidermidis
gggattttaatgactaaaattagtgttgtcgtatatggagcagaagtcgtttgtgcgagttgtgtaaatgcacctacatctatagatacttatcaatggcttcaagcattacttttaagaaagtttcctcaacatcattttgaatttacatatattgacatacgaaatgatactgaaaatttaactgatcatgatatgcaatttatagaaagaattaatgaagatgaattgttttacccattagttacgatgaatgatgaatatgtagcagatggttacatacaatataaacaaataacccgttttattaaatcatattttactatgtaa

SEQ ID NO: 3622 - DNA, 333 bp, Staphylococcus epidermidis
atgaatttaattcctacagttattgaaacaactaaccgcggtgaacgtgcgtatgatatatattcacgtttgttgaaagaccgtattatcatgctaggttctcaaattgatgataacgtagctaactctattgtgtcacaattattattcttgcaagcgcaagattctgaaaaggatatttatttatatattaattcaccaggtggcagtgtaactgctggatttgctatttatgatactatccaacatatcaaaccagacgttcaaacaatctgtattggtatggcagcgtctatgggttcattcttgttagcagcaggtgccaaaaggtaa

SEQ ID NO: 3623 - DNA, 306 bp, Staphylococcus epidermidis; identical to SEQ ID NO: 2503

SEQ ID NO: 3624 - DNA, 171 bp, Staphylococcus epidermidis
ggcaaattaatcacatttgctattaagtattatcagcctgagtccgacgatgtacttgtcggacttttttattttataattgagacaatcatgtttttaaatcatatgttaaagggaataatgatttatcaagtcaatttgataataatgaagagatttttaaatatatga

SEQ ID NO: 3625 - DNA, 453 bp, Staphylococcus epidermidis
tcatttctaatctacttttggctgaatcaatggttgacgaaagaaggtgattcaatgaaagtagtatattattcattttctggtaatgttagacgatttattagtcgtgctggtattaaagatacatttgaaattactcaagataattgtaacgaatcagttaatgaaccctacattttagttactggcactattggatttggagaggtgccgcagccggttcaatcttttttaaatgtaaatcatactcagttacaagctgttgctgcgagtggaaatcgaaattggggacaaaatttcgctaaagctggccatacaatttctgaggaatataaagttccattaatgatgaagtttgaagtacaagggacaaataaagacattattgaatttaaggataaggtgggcaatttcaatgaaaaccatggaagaaaagaaatacaatcatattga

SEQ ID NO: 3626 - DNA, 354 bp, Staphylococcus epidermidis
ttgctactaatagcaagaaactttagttttattaagcagttatacactacttatttgaaaaataaccaattcgttcaattgaaaatggaattaaatggatatcgcgatgctttatacggtggtggtaaatctgctaaatccctgatgactaaaaaagatattaagatgagtaataaaattgccaatgcaatgaaaaggttagaaaaagttatagataactcacatgaaaaaattgacgccagagcaatacgagagtatgtcaataaatatccaattatcgagggtcaagttatacatatcaatagttgtcttgataatgatatttctggcacatatatttactacagtgcctga

SEQ ID NO: 3627 - DNA, 168 bp, Staphylococcus epidermidis
aagcaaataatttttaattcactcaaaaattctactaggagtctcgatattataaaaaaagtaggactacgaattcatcttgaatccattgtcctacctcataacgtcaatatagcgtatattaaatttgaaatatttctaacaaacaattattataatttcttttaa

SEQ ID NO: 3628 - DNA, 528 bp, Staphylococcus epidermidis
atcaaaataattaaaggagctagaaaattgacacaaggacgtcaaaaagatgaattaaaagatattactttattaggcaatcaaaataacacttatgaatttgattatagaccggaagttttagaaacttttgataataagcatcaaggtcgtgattattttgttaagtttaattgtcctgaattcacatcactatgccctattacgggtcaaccagattttgcgacaatttatatctcgtatatccctaatatcaagatggtggaatctaaatcattaaagttatatttatttagttttagaaaccacggagattttcacgaagattgtatgaatattattatgaatgatttaattaatttaatggacccacattatattgaagtttggggtaaatttactccgagaggtggcatttccatagatccttacacgaattatggtcgtcctgatacaaaatatgaaaaaatggctgaacatcgattaatgaatcatgacatgtatccagaaaaaatagataatcgttaa

SEQ ID NO: 3629 - DNA, 288 bp, Staphylococcus epidermidis
agtaaatcaattatttttgcaactagctttatgaattattcaaggagcttctttaaatatatgaaattaatatctaaaagcatatacttatcatttatattttttatttttagtctcatgttatttaccaatcaaagtttcgctaatgataataaacgttttcagctaaaaccaggtgacattattgttacaaaaggtcctgttttaaatggttttttggtcactgtagtttggcaattgatcatgacactgtacttcaaattgaaggtccaggggataaaccaatga

SEQ ID NO: 3630 - DNA, 1008 bp, Staphylococcus epidermidis
aacatgtcaatcataattgaaaatagtggcctatttagtagctttcaagattttggaagaaagggatatgaacatgaaggtgtcatcccgagtggcgcactagatgaattagcacatgaaatagccaaccgtctggttgcaaatgacaaaaatgaagcaacacttgaaatgactcaaaaaatggcaacaattcgtttcactgagccggcacttatagctttaacaggtggtaattttaaagctgaaactgaacatatgaaaatttatcctaataaattatatctcatcaatgaaggtgagacattgaaatttaatgaaaccagtcgtacatcacgtgtttatctagcagttggtggaggttttaaactagaaaaatggcttcattcagcatctacagattttaatgtggaaattggtggttttgagggaagaaagcttaagaaaggtgatgaaatagaattaaaacaccactattctcaacgacatcttaagctatttgataacttatctgacaaacgtacaactgattggggaattgatggttacgcattgtctttcaattatgtttcggatgtttttcatgttataaaaaataagggaacggaagattttaaaaaagaggcgacgcgtcgttttacaacggctgaatatagtgtgtctagtaaaacaaatagagtaggtatggtgcttgatggcccccaaatcaaagcatactatgatgatatgccggctcatcaatcagtaaaaagaggaaccattcaagttaagagagatggcacaccgattgtattattaaacgatcattatacattaggaagttatcctcaaataggtacaatcgcaagctatcatctaacaaaattagcccaaaaaccacaaggctcaaaattgaaatttcaatttatagatatcgaaactgcagaaaaaaacttaataaagtatagcaattggttaaatcaattgttccatggtattgaacaccgtatgcaattagaaatgttaaagtga

SEQ ID NO: 3631 - DNA, 186 bp, Staphylococcus epidermidis
gatactgttttcactttagtaaaagtacaaattgttttatggactttcgctaatgcattttggtttgtagctaaaaataataaaagtactaaacaaattgataaaataactgcaacagaacttaaaaataagtttttcaatttcatctccttacccacatttctcttaagatttattctatcttaa

SEQ ID NO: 3632 - DNA, 246 bp, Staphylococcus epidermidis
ggtaaaacaatgtcgaatcataattattctgacgaaaaaatcgaagttatagatccgagtgatgatagatataaaggagatgattattttaataaaaattcatctcaaaacaatcaaaatttaaaaacttttaatcaaacttattcttatggttgcacacattcaggatgcggctgtatattaggctgtttaactatttcacttatttcattcttactttcattactaattttttggattatataa

SEQ ID NO: 3633 - DNA, 651 bp, Staphylococcus epidermidis
ttgatgacaatcgctcaaaatggaggatttttaatgtttagtaagaaaaaggataagttcatggttcaattagaagaaatggtattcaatctagaccgtgcagctattgaattcggcaaaatggacttcaatacacacttagatttgaaagcttattctgataatattaaaacgtatgagtcacatggtgacgaacttatgcatcaagttatttctgatctcaaccaaacattcattacaccaattgaacgtgaagatatcttatctttatgcaatgcaatagatgatgttctagatgctatggaagagacatcagcaatgtttgaaatgtattcaattgaatatacagatgagtacatggctgaatttgtagaaaacatacaaaaagcagttgccgaaatgaagctagctgtaggattacttgtagacaaaaagttatctcacatgcgcattcattctattaatattaaagaatttgagacaaattgcgacggtatcttaagacagtcgatgaaacacatcttcaacagtgaaacagatccaatcacattaattaaaataaaagatatttatcaaagcatggaagaaatagcagataagtgtcaagctgttgctaataattttgaaactataatcatgaaaaatagctaa

SEQ ID NO: 3634 - DNA, 714 bp, Staphylococcus epidermidis
atggctaaaatacccgttttagaaatatttggaccaacgattcaaggtgaaggtcgtgtaataggaagaaaaacaatgtttgtgcgtacagctggttgtgattatcgatgtagctggtgtgattctgcatttacttgggacggtagtgctaaagaagatatcaaattaatgactgctgaagaaatttatgatgcgttacttgaaataggtggtcatcgatttaatcacgtaactatatccggaggtaaccctgcgttaatcaaaggtatacaggaattagtagatttatttgaagacaaacatatttatacagctttagaaacacaaggtagtcgtttccaatcatggatgacacaaattgacgatttaacgattagtccaaaaccccctagttcgggaatgaaaactaatctagaaatattagattctgttataaatcaatgtacatttcattcacttaatttgaaagtggtgatttttgacgatgcagactatgattttgcaaaattaattcatcatcgctaccctaacatcccattctatctacaagtaggtaatccttatcttgatgataacgttgaccaacatacagataaattacttgaaaggtatgagcaattagtggatcgtgtaatgcaaagtagtgatatgaatcatgtctatgtactaccgcaattacacacattattatggagtaataaaaaaggtgtctaa

SEQ ID NO: 3635 - DNA, 918 bp, Staphylococcus epidermidis
cttaagaaaatgacaagcaacgaaaaagaaatgggtaaaagtgaattgttagttgttacaggtatgtctggagcgggtaaatcattggtgattcaaagtctcgaagatatgggatttttctgtgtagataatttaccacctgtactattacctaaatttgtagaattgatggctcaaggaaatccttcattgcaaaaagtagcaattgcaatagatttaagaggtaaggaattatttaaatctctagttaaagaaattgatattattaaaagtcgtaatgacgtgattttagatgttatgtttttagaagctaaaactgaaaaaattatttcacgttataaagaatcaagaagagcgcacccactaaatgaacaaggacaaagatcattaatagatgcaataaatgaggaacgtgaacatctatcagaaatccgaagtatcgctaattacgtgattgatacaacaaaattaaaacctaaagaattaaagcaacgcatttcaaagttttatttagatgaaaactttgaaacatttacaatcaacgtgacaagtttcggtttcaagcatggtatacaaatggatgctgatttagtttttgatgtcagatttctacctaatccctactatgtagaggaattgcgtccatttactggtttagatgagccagtgtacaattacgttatgaagtggaaagaaacccaaatattttttgataaattaacagatttattaaaatttatgattcctggctacaaaaaagaaggtaaatcgcaattggttattgctataggttgtacgggtggacaacatcgatcagtcgcattagctaaacgtttagctgaatatcttaacgagatttttgaatataatgtttatgtgcatcatagagatgcgcatattgaaagtggagggagataa

SEQ ID NO: 3636 - DNA, 1077 bp, Staphylococcus epidermidis
gttggtgaaataatgaaattagcaataattattccagtgtataacgctgaagaaacgattaaacgtgctatactctcagttgatactagtgtgccttatgagattatttgtatcaatgatggttcaactgatcaaacacaacatgtacttacagaattacaacaaaaacatccacacattaaagtcattcatcagagtaatcaaggagcagctcgaagtagaaatgttggcttagaagctatgtctgaagatgttgatgcatttttatttttagacgcagatgatgagtttttacctagtaggattgatttaatggtgaatgcttttaataaaaacaaagaaaccgatgttgttatcggtcaaatggcaagagatgttaacggcgaatggcaagtcatttcgacccatcaatctatggtaaaagatgcgattgtcacacttgatcgtaaaccggatattttacaatcgataggacctggagcaaaattatttagctcgaagtatgctggattacgttttgatgaagatgtcgttttctgtgaagagcatacctttattgtcaaagcgttctctaaagcgcgagatattcaacttatacctaacattgtatatggctataatgagagagaaggatcagtaacagcgcaacgtgctgatacattcttaccttatatgagtgatgcgttaaaagttcgtcaacgcgtgatggaattactattattattagacgaaaaaatctactatagttatcgaatggataacctcatagtaagttacttaatacaggcacatttaaagaaaaataacaaaataacgcaatctttgcttgaaagtgttatagcgtatatgaaagctatgcagcatacacattactcgggagaggctatgtttcgaattgttagagctgttgaacagagtgcaacacattggacaaagcctttatacttacaatggaaaaaggcacttagtgaggttggaattggcagaccaggattaattcgttttaaacttcaagttatacctaaaaagatatccttttctggtaaagaatcactaaaaagaatttttaaaaaataa

SEQ ID NO: 3637 - DNA, 207 bp, Staphylococcus epidermidis
cttaaagaaatacgaggttcactcatgatttatttacaaaattttattactacaactatccaattaaatatctatcttattttagttattggactgctttacgtaatcatccactattatagaaataaaggtgtgaacgctttcttagatatttatttaaattatataccgggtacttattcacgaatttggccacgtcttatttaa

SEQ ID NO: 3638 - DNA, 507 bp, Staphylococcus epidermidis
atcatattgataatacagaaggtaacagtaccattaatcctggaacttttaaatggtgaatctcttagacaatatatacaatcagcttatcacgaaacgttaaaagaagaatttaagaatcttacaccttacatgactaaattggcaaaagtacatggtcgtagtcacccatacttattaaaattacaagacttatatcgcgagtttggtgatagtatgttggatcatatacgtaaagaagatgaggaagattttcctaaactcattcaatatagtcaaggacaagatgtacaaaacattaaaatcatattagaagatttaattaatgaccacgaagatactgggcaattattaaatgttatgaatcaactaacctctgattatcaaaccccagaagaagcatgtggaacatggaagcttgtttaccaaagattacaaaatatcgaacgtcaaacacaccaacatgtacatcttgaaaaccatgtgttatttaaaaaggtaagttaa

SEQ ID NO: 3639 - DNA, 273 bp, Staphylococcus epidermidis
ggcagaatgataaatgctgttgtaatcgcagtcatattaatgatcatactatgtttatgtcgattaaatgtggtcattagcttatttattagtgcacttgtcggtggattaatatcaggtatgaatttagaaaaagtaattaatgtttttggaaaaaatatagtagatggcgcagaagtcgcattaagttatgcgttacttggtggttttgctgccttgatttcctatagtcgtataactgattatctaatagtgtcctacaccacggggaat

SEQ ID NO: 3640 - DNA, 276 bp, Staphylococcus epidermidis
  modified_base (273)..(273): a, c, g, t, unknown or other
tgtttagtgataaggagtgcaaatatgaaaaaactactatttatcataacagttatcattttaaccatagttgtatccgcttgtggaaatgaatcaaaaagagatattaaacaatttgaacgtcaatatgaagaaattcatcaaaaacaacacagtgtagaaaaagttatggataaaataccattaaaagagttagataatttaagtaaaactgataccactgataaaaataaaaaagaattcgtgcacttcaacaggatattaataactatntga

SEQ ID NO: 3641 - DNA, 1068 bp, Staphylococcus epidermidis
aaggagccgataactattttttcaataagaagtcaaatcattatcggtgtcatttcaagcgttattttaacaacaattatactggttattgcatataagctcatgtggtttaatggtcacatgacactcactttagccatcactactatgataacaagctgtttaacactttcgatttgtagtatttttattaatcctttaattcagaagattaagcaattcaatattaagactaagcaatttataaatcacgaaaaattcattgatgatgaaacatttcagtctcctagagaaattaaagagttgaatgattcttttaataaaatggcatatgaaatcaataatcaaatgaatatgataaaaaacgagcaacaagaaaaaactgaaatcatacaaaaccttgcacatgatttaaaaacacctttagctggtattcgatcatattctgaaggtttacgggatggcgtcattagtgatcctcaagaagttcatgaagcatatgaaatattaattaaacaagcaaatcgtttatcaattttatttgatgacattacacatgtgattaatttaaatactggacgttcttatcctttggaattaatacagctcgatcaattacttgttaatatattacaaccatacgagcaacacataaaacaagaaaatcgtacacttgaagttaatttctgcacagatattgatgcattctaccagtatcgacctccaatcgaacgtattttgaccaatttactagataatgcattaaaattttctaattctggtagccgtattgatattattatttctgagtgtaaagaaaacgacgtcattagtatttcaataaaagatgagggcataggtatcgttccagaacttcaatcacgtatctttgaaagaacgtttagagttgaagattctcgaaatactaagactggtggttcggggttaggattatacattgcaaatgagttagcacaacaaattgacgcctctattacagtccaaagtgatttagacattggaaccacgatgacacttaccttaaaaaaatttcaatttaaaaagtaa

SEQ ID NO: 3642 - DNA, 654 bp, Staphylococcus epidermidis
ggtgaaacgatgttaactgaagaaaaagaggattatttgaaagcaattttgactaatgatggcgacgtgtcctttgtatcaaataaaaaactatcgcaatttttaaatatcaaaccaccatcagtaagtgaaatggtagggcgtttagaaaaggaaggctatgttgaaacaaaacattataaaggtgcccgtttaactgaagaagggttaaagcaaacgttagacatcataaaacgacatcgattactagaattatttttaatagaaattttacaatataattgggaagaggttcatcaagaagctgaaatacttgaacatcggatatcagatttatttgtagagcgtttagataagattttaaattttccgaaaacatgccctcatggaggcgtcattcctagaggtgatcaatataaagaaatttttactacgtcaattcttaattttgaacctggagaacgtgttactgtacgacgagttcgtgataagacagagttgttagtttacttatcaagtaaggatatttatattggaaatacagttgaaattgtatccaaagatgataccaataaggttattattcttaagaggaatgatattgtaacaattttaagctatgaaaatgcgatgaatatttttgcagaaaaataa

SEQ ID NO: 3643 - DNA, 1566 bp, Staphylococcus epidermidis
atagagaagatgtgtttacttatttatctcttaataaggaggaagcgacacatgaatgagttctttgcgacattaagtgatagaaaagggcagctattttctactataattgaacacattcaactttcttttatagcgcttttcattgcaactcttatagcagtaccaattgcaattttgctcactaaaacaaaaaaactttcagaaatcgtcatgaatattgcagctgttctacaaacaattccatcactggcactacttggtttgatgataccaattttcggaattgggagacttccggcaattatcgccttagttgtatatgcgttacttcctattctacgtaatacatacacaggtattaaggaggtcgatccctctcttattgaagcggctaaaggcattggaatgaaaccacttagaagattgaccaaagtcgaactccctattgcaatgcctgttatcatggcaggaatacgcacagctatggtattaatcattggtactgctacactcgcagctttaataggcgctggtggtctaggagatttaatattattaggcattgatcgtaacaatagtgcactcattttaataggtgctattccagctgcacttctagctattatttttgattttattttaagatacatggaacgtttatcatataaaaaattgctcatttctttagggacaattgtaattgtgattatcatagctattgccatacctatggcagcgcaaaaaggtgataaaatcacattcgcaggcaagctaggttcagaaccgtcaattattacgaatatgtataaaatacttattgaagaagacacagatgatactgtagaagtcaaagatggcatgggtaaaacctcattcttatttaatgcgcttaagtcagatgaaattgatggttatttagaatttacaggtactgtattaggtgaattaacgaaagaagatttaaagtctaaaaaagaaaacgatgtatatcaacaagcaaagtctagtttagaaaaaaaatatgatatgacaatgcttaaaccgatgaaatataataatacgtatgcattagctgtaaaacgtgactttgcaaaaaaatatcaaattaagacaataggtgatttacgcaaggtagaagataaacttaaaccaggttttacattggaatttaatgatagaccagatggatacaaagctgttaaaaaaacgtatcatcttaatctttctaatgttaaaactatggaacctaaattacgttatactgcagttaaaaagggagatattaatctcatagacgcatactctactgatgcagaattaaaacaatataacatggtagtattaaaagatgatcaacatgtatttcctccataccaaggagcaccgctatttaaagaaaaatatttaaaagaccatcctgaagttaaaaaaccgctcaataaattggcgaatagaatcacagatgaagaaatgcaagaaatgaactataaggtaacagtgaagaaagaggatccttataaagtagcaagagaatacttagaaaaagaaaaattaataaaataa

SEQ ID NO: 3644 - DNA, 288 bp, Staphylococcus epidermidis
aggggtgagattataccaatgataattgaagtaattttaatggtatgtctcatcattattcaacttatgataggtcatttatggcatcaaataggatggagttatactaaagctattttattaatgtgtttaccgttagggataggattatatttgatgcaattattttattatgagccccgttatacaaattgggaagtacctttgaaaactaaattaaatcttaaatatatgtatattttaactttgttagaatatattttaatctatgtttgcttttttatgtaa

SEQ ID NO: 3645 - DNA, 1323 bp, Staphylococcus epidermidis
ttaaaggagatattaaacatgccaattattacagatgtttacgctcgcgaagtcttagactcacgtggtaacccaacagttgaagttgaagtattaactgaaagtggtgctttcggacgtgcattagtaccttctggtgcttctactggtgaacatgaagcagttgaattacgtgatggagataaatcacgttatttaggtaaaggtgtgactaaagcggtagaaaatgttaacgaaatgatcgcaccagaaatcgttgaaggtgaattttcagttttagatcaagtatctattgataaaatgatgattcaattagacggtacacacaacaaaggtaaattaggtgcaaatgccattttaggtgtttctattgccgtagctcgtgcagctgctgacttattaggtcaaccattatataaatatttaggtggatttaatggtaaacaattgccagtacctatgatgaatattgttaatggtggttctcactcagatgcaccaattgctttccaagagttcatgattttacctgtaggtgctgagtcattcaaagaatcattacgttggggtgcagaaatcttccataaccttaaatcaatcttaagtgaacgcggtttagaaactgcagtaggtgatgaaggtggtttcgcacctagatttgaaggcactgaagacgctgtagaaactattattaaagctatcgaaaaagcaggatacaaaccaggtgaagatgtattcttaggatttgactgtgcttcttctgaattctatgaaaatggtgtttatgattacactaaattcgaaggtgaacacggtgctaaacgtagtgcagcagagcaagttgactacttagaagaattaattggtaaatatccaatcatcactattgaagatggtatggatgaaaacgattgggaaggttggaaacaattaactgatcgtatcggtgataaagttcaattagttggtgatgatttattcgtaactaacactgaaattttatctaaaggtatcgaacaaggtattggtaactcaatcttaatcaaagtaaaccaaatcggtacattaactgaaacattcgatgctattgaaatggctcaaaaagctggatatactgcggttgtatctcaccgttctggtgaaactgaagatactacaattgctgatatcgcagttgctacaaatgcaggccaaattaaaacaggttcattatctagaactgaccgtattgctaaatacaatcaattattacgtattgaagatgaattatacgaaacagctaaatttgaaggaattaaatctttctacaatttagataaataa

SEQ ID NO: 3646 - DNA, 660 bp, Staphylococcus epidermidis
atagtagttttttcatatttgcactccttatcactaaacattatacataaacgtatttattatgaaaatgaattgtgttatagtatgtcagactttattgtatatattatttttataaatgaggagtatttcatgtacgctaatgtccaaccttttattaaaaatgaatctgtgaaacaatttacatatgaatataacaaagtgaaagacgtattgtttactattttagattctcctattaaatacactcagcatatcggtggtacctgtcattttaattatcaaactgagcccattttagatatacttgttggtgtaaataacttgcacgatattacttcactagatgaaaagcgcctaaattatgctggtttttatcgtttgcaccattcttacaagaaaaaagttgtcatggcacgttttaataatttaagtgaattaaaacaagaagtaagattacatattattcaaatggaaacttctcttttcaaacaatatcaaacagtcaatcatttactacacaacgataaagcaatagcagaatggtttgcaagtaagaaaaatgaaattgtgcaacatgctaaaaagatacgtgaatatgagtctcaaaaacaaaatttgtttgagaaattatataaggaatctaatttgttatcgtaa

SEQ ID NO: 3647 - DNA, 888 bp, Staphylococcus epidermidis
ttgaggaggataagtattaagatgaagattgcagttatgaccgattctacaagttatttaccacaacatataatagaacaatataacataccagtcgcttcactaagtgtaactttcgatgatggagtgaatttcactgagagtgatgatttttctgtagatgatttttataaaaaaatggcttcatctaaaactataccaacaacaagccaacctgctattggcgattggattgaaaattttgagagattaagagaacaaggatacactgatgtcatcgtgattaacttatcaagtggtataagcggaagctatccttcagcaacacaagctggtgaaatggttgaagatattcaagtacatacgtttgatagccgtcttgctgcgatgattgaaggtagctttgcaatttacgctgctcaattggtacaaaagggatataaacctgatgatattattaatgaactaactgaaataagacaacatattggtgcatacttaattgttgatgatttaaaaaatttacaaaaaagtggtcgtatcactggagctcaagcttgggtaggtacattattgaaaatgaaacctgtcttgcgttttgaagaagatggtaaaatacatccacacgaaaaagtacgtactaaaaaacgtgcgctaaaatctttagaaacaaacatttttaaagaaatagaaggcatggaagatgtgacagtatttgtaataaacggtgataaaactgaagatggaaagtcatttcttcagcaattaaaggaagatcatcctaatgttcatattcagtattgtgaatttggaccagtgatagcatcacatttaggatcaggcggtttaggattgggttacttcccaagaagaatcgacattaattaa

SEQ ID NO: 3648 - DNA, 759 bp, Staphylococcus epidermidis
gggagagggattttaatcatgcaaattaaactaccaaaaccattcttttttgaagaagggaaacgtgcagtgttacttcttcacggctttacaggtaactctgctgatgtaagacaacttgggcgttatcttcaaaaaaagggctatacatcttatgctccacaatatgaaggacatgcagcgcccccagaagaaatattaaaatctagcccttttgtttggtttaaagatgttttagatggttatgattatttagtagatcaaggttacgaagaaatagcagtagctggtttatcattaggtggcgccttcgcattaaaactaagtttaaatcgtgatgtgaaggggattataactatgtgtgcacctatggagaataaaacagaaggttcgatttatgaaggctttcttgaatatgcacgtaactttaaaaaatatgaaggcaaagatcaacaaacgattgatcaagaaatggaacaatttcatccaactgaaaccctgagagaactgagtgacactctaaatggagttaaagaacatgtcgatgaagtaattgatccaatacttgtcgtacaagcagaacaagatacaatgattgatcctcaatcagcaaattatatatataatcatgtcgattctgatgaaaaagaaatcaaatggtatcaacattcaggtcatgtgattaccattgataaagaaaaagagaaagtctttgaagatgtatatcaatttttagaatcattggaatggacagagtaa

SEQ ID NO: 3649 - DNA, 147 bp, Staphylococcus epidermidis
ttaaaggttttgaagaaatgttttaataaaataacaataattattattttattaaaacattctcaaccatatattttactaattaaaatttttaagaaggagaatttatttgagtttaaaggaaatatggaaagttctcataaataa

SEQ ID NO: 3650 - DNA, 129 bp, Staphylococcus epidermidis
gcatcgtttgtaccatgtgagaatgattgtaatgctgcagtaaagatttggaaaaacctaaaattacgattagtacgtgttaaatttgaatttttaaaaacgattttaacaatcgtatacatcatataa

SEQ ID NO: 3651 - DNA, 309 bp, Staphylococcus epidermidis
atgacgtttgtatcacatcaaaggcatttgcctatatttttcaaaaaatgtgtccttttttttcaatctatttcgatatatatagtgaaaggaggttttattatgaatgaagtcaatcaagtgacgattatctttactcaaatcaaacataattctgaaggtaaagtagtcgaacataagcgtcgtttttctaacattaatccgcttgtttctaatgatcaaatcaaatcttttcgttccatcattgaacgtatcagtggcgaagagtatgacaaagtcgagatcgttaaaacagaatctttaatttaa

SEQ ID NO: 3652 - DNA, 1704 bp, Staphylococcus epidermidis
aattattctgtgagcgaattgattttaattttttgtaaacactctataatatatgtaggtgatattattgtgaaaaaactaacaaaaatggttttaagttataaattataccccacactcatgttaatcatgagcgtttttttatcttttacggtcgttgcgcaaaacatttcaatttcacactttttaaatcacttactgtattatcaacaacaatctttattattattgttatcagttatttttatctctcttattttaagagcaacatttaatatgctgattcaatttttaggagatcatttggcatttaaagtaaaacatatgcttagagaacaagtgattttgaaaaaaagtgtccgttcaattggtgaagaaataaatattttaactgaaagtattgatggtatcggtccgttctttcagagttatttacctcaagtctttaaatcaatgttgattcccatcgttattattattaccatgtgttttgttcatttacctactgctattattatgatagttaccgcaccttttattccattgttttatgttatttttggacttaaaacaagagatgagtcaaaggatcaaatgacatatttaaaccagtttagtcaacgttttttaaatacagctaaaggtcttattacatttaaacttttaaatcaaacgaaacaatctgagcaacaactttataaagacagtacacgttttagagatttaacaatgcgtattttgaaaagtgcctttttatcaggacttatgcttgagttcataagtatgttagggattggattggtcgcattggaagcggctttaagcttagttgtatttaaccatatcaactttgtgactgcagcgatagcgattattttagctcctgaattttataatgcgattaaagatttaggtcaagcatttcatacaggtaagcaaagtgaaggtgctagcgatgtggtgttttcatttttagaatctgaagataaagctgattctcctacattaaaagtggatgagcaacagtttgaacaagttttaattaagcatgttgattttcaatacgctaatagtaatcatatggctttgaaaaacatttctttttcggtaaataaaggagaaaaggtcgctattgtgggaccgagtggtgcagggaaatccactttagctaagttgcttagtcaatcagtaacacccacacatggaacactttcatttaaccaagcatcattaaatatcggatttctaagtcagcgcccacatatatttgcagattctatcaaaaataatattgcaatgtatgatgatgagatatgtgatgagcaagtgattcaagtgcttgatgaagtggggttaaaagagaaagtactttcattaaaatatggtatctatacttctattggtgaaggtggggaaatgttatcaggtggacaaatgagacgtattgagttaagtcgtttattattattgaaaccagatattgtaatttttgatgaaccagcgataggattagatattgaaactgaaaaggtcatacaacaagtattagagcatcatttttctacaacgacagtgtttattattgcacaccgtgattcaaccattcgaagttcagcacggcgtatatatatcgaaagtggtcatcttataaaagatgattcgataatttctgttacgcgtagtgaggtgaagatagatcaatga

SEQ ID NO: 3653 - DNA, 969 bp, Staphylococcus epidermidis
tgccgatatgttataataaacgaagatatattaaacaggagggtatgcgttgttatggcgactagaaatgaagaaattttacgtaaaccggattggttaaagattaagcttaacacaaacgataattatactggtcttaagaaaatgatgcgtgagaagaatttacacacagtgtgtgaagaagctaaatgtccaaatattcacgaatgttggggtgcgcgtcgtacagctacatttatgattttaggggcagtatgtacaagagcatgtcgattttgcgcggtaaaaactggtttacctaatgaattagatttaaatgaaccagaacgagttgcagaatcagtagaattaatgaatttaaaacatgttgtaattactgctgttgcacgtgatgatttaagagatcaaggctcaaacgtgtatgcagaaacagtacgtaaagtaagagaaagaaatccatttacaacaatagaaattttaccatctgacatgggtggcgattatgaagcccttgaaacattaatggcttctagaccagacattcttaatcacaacattgaaacggttcgtcgcttaacaccaagagttcgagctcgagcaacttacgatagaactttacaatttttacgtcgttctaaagaattacaacctgatattccaacaaaatcaagtttgatggttgggttaggtgaaacgatggaagaaatttatgaaacgatggatgatttacgcgctaatgatgttgatatcttaactataggtcaatatttacaaccgtctcgaaaacatttgaaagttgagaaatattatacgccattagaatttggtaaaatgagaaagattgcaatggaaaaaggatttaaacattgtcaagcaggacctttagtaagaagctcatatcatgctgatgagcaagtgaatgaagcagctaaagagaaacaacgccaaggtgaagaacaactcaattaa

SEQ ID NO: 3654 - DNA, 150 bp, Staphylococcus epidermidis
cctatacatgttacactctgtgagtgtttaacattacttcttgttatcgccgtgcagactttaattttcgtcattattaaagtaactgcattggcgtttttttatttcaaaaagattttttactacaaatataatagaattaacatttga

SEQ ID NO: 3655 - DNA, 132 bp, Staphylococcus epidermidis
tatttcaatgtaaaattacatataaaaacaaagtattttggcgagactcttgagggaacaggacaagctgaagactacaggctgaagctgtcccctaagaaagcgagccaacaatacgaagtattgttgtaa

SEQ ID NO: 3656 - DNA, 189 bp, Staphylococcus epidermidis
tttaacaatgtttgtaacatgttaacagattttacaaagacggtagctaaatatataatatggtacatagatgatgaaagtgagatgacattatgggacgtaaatggaacaacattaaagagaaaaaagcccaaaaagataaaaatactagtagaatatatgccaaatttggtaaagaaatatatgtag

SEQ ID NO: 3657 - DNA, 276 bp, Staphylococcus epidermidis
aacaacaatgtcaattctaaacagaagaaatgggtgacgataatgatttggtatgtttgtgcggccttctttccttgtatattagttgtgctgtttagtgtggtgactagaagtaaatggattggtacattagtcacactggtaataataggggcatcagtttataaaggattctttcacaacgaatggattatttttatagatgtgacaagtttattagctggttatttaataattgatcaacttgaatttcataagaaccaaaatgattcttaa

SEQ ID NO: 3658 - DNA, 519 bp, Staphylococcus epidermidis
ctattaaatgtaggcgtttttaactatagaaagagagtgttaatcatgaagaaaataagtttatttataatatttttaattcgtgtaatttcaggtattgttattttcagacaaggatgggagaaatttacaggtgattttacattaaacgggctagttccggtaattagagataacacagactctcctcaatggtataaatggttttttgaacatattgttgcacacacaacaggattatttaatataatcgtacctttaggggaaatggcaattggtttaggtttaattttaggtatatttgcatacgctgcaagtttctttggagccttcgttatgataaattatattttagcagatatgatttttacgtaccctctacaattagctttctttattattttactcatgagccactctttattggctaaggtatcacttaaagaaatcatcgcttattttagagaccgtaataaccgaggtgaagataagcatgacccacttactaatcgtggatga

SEQ ID NO: 3659 - DNA, 150 bp, Staphylococcus epidermidis
gttgtgaatgttccgaggtgtcatacagccgatactattttgatgaatcattataataaaatgcacattaaacaagttttagaattaaaaaaagcgagacatcattttgaatttgatatctcacttcatattaataaaagaacaatgtaa

SEQ ID NO: 3660 - DNA, 840 bp, Staphylococcus epidermidis
gaggcgaatgtcatgttattaacaattattctattaatattaatagggggattatcagcgattttaggatctatcgttggtattggtggtggaatcatcatcgtccccacacttgtttatttaggcgttaaccatcatcttctacatggtattacgacgcaaattgcaataggtacttcttcagttattctgattgttactggattatcttcctcattaggatatttaaaaaccaaacaagtagatataaaaaatggttcgatatttctatttggactactacctggatctttggttggttcttttttaagtagataccttacacttgattcgtttaacttatactttggcgtgtttatgatatttgtgtcgatattactgatgattcgtcacaaaatcaaaccttttaaaatttttgacaaacctaaatatgcgcgtacatatgttgatgctgaagggaaaacataccgttatagtgtaccacccctgtttgcttttataacaacgttatttattgggctattaacaggactgtttggcataggtggaggtgcattgatgacccctcttatgctcatcgtctttagatttccaccacatgttgcagtaggcacaagtatgatgatgattttcttttcaagtgtgatgagttcaatagggcacatctttcaaggacatgtggcttggggctattctatcattctcattatttcaagtgttataggtgcacaaataggtgtgagggtcaatcgatctatgaaatccgacacagttgtaatgttattgagaacagtaatgcttatcatgggtgtatatttaatcattaaatcttttatttaa

SEQ ID NO: 3661 - DNA, 123 bp, Staphylococcus epidermidis
atagtttgtgtaattagattgtttgaactttcctttatgtttgatttacattataaattaaaatttatggtattgaaacttaagtgttctataaagatagatgttccaaataaaataacataa

SEQ ID NO: 3662 - DNA, 180 bp, Staphylococcus epidermidis
ccgaaatgtgttgatgacggagccaaccctccgacacgcttaataagctcggggacccctgtcgaatccaagaacgtcccctcaattcaaatcaatctaacaaaatatttggttaaattatcaataaaacaatttgacactgcatacaatcatatcaaagatggcccgattaagcaatga

SEQ ID NO: 3663 - DNA, 660 bp, Staphylococcus epidermidis
gataaattcgtgtttaagaatgaaagagaggtaaacaatatgagcggtatctccaaatttattagtgcgattgtagttttgctattattaataggtttagcatttggtatttactcatttgtcgatagttcaaaaaaaggtaacgaacgactcagtgataaaacaacacagcaagaaaagaaaaaagacgataaagacaaaaaggaaaaaaaagataaaaaatcggtggaagaaaaaaagaataatacacaacaaacgcaacaagttcctcaaactcaacaaacgcaacaaacgcaacaaactgttcaaacgccacaaagacctacaactcaaactccggtgagacaaaatccacaaacaggagaaaagagagcaaaagaaccaaaaactgatgaaagaaaaaaaactagacaagacagttcaaattttaaagaaagcccaaatgaaaaagatcaatcgtcaacacaacaaaagccacaacaaaataaatctaaccagtcatcagagaatcgtcaaagtacccaaaataaatcaaatcaaacacagtcaaccagaccacaaaacaatggaaatagtggcaatcaaaatgctagttcggggcagaacacacaaaaacaaaataataacaatcaaaattctcaaagctcaaaaaaggattaa

SEQ ID NO: 3664 - DNA, 852 bp, Staphylococcus epidermidis
aggaattgcttaaaattttaccagataattttgaaacagaaggagaagaacaacatggcaatggatttaattactaaacaagacggtacaacattacactatagtactatgggacaaggatatcctgtcgtactcgtgcataccgcttttgataattatgctgtttttaatgatttagctaaggtattagcaaagtcttttcaggttgtgcttatcgatttgagaggacatggttactctgataagcctagaaatatagagttttatgactttgctgacgatataaaatttttattagatgctatatatatagatgaagcagcatttattgggcacgagatgggggcacttattgctgctgatatgtctgttagaaatcctggctatatatcctcaatcacattagttaatcctacttcaatagaaggtgaattgcctgaagaacgcttgttcagaaaatatgcgcataaaatacgtaactgggaagatgataagcaagaaaaatttttagataaacgtagatattataaagcgcgtaagatgaataaatttttaaagcatgtcgttgatacaaatagtatttctactaaagaagaaattcaagctgttaaagatgtcttcaaatctgaaggtattgcagatgttttcaagcatgttcaagttcctacgcttattgttgctggagaacacggagaacgtacaactacactagaagctaaagaagtcgcagatttgattcaacactgtgaatttaacgtctatcaacattcaagtgcatatccttttgttgaagaacaggctcaatttactcaagagacaacaaacttcattcaacaacatgcacctaaataa

SEQ ID NO: 3665 - DNA, 261 bp, Staphylococcus epidermidis
cttaatcacgttaatagcctccttatgttgcttagtaatcaaattaaaaatgctttctcaatttttagaaaatttgagaaagcatttgttgaaatgttctttctctcatcttctaaagttatactttatgtgaattggcaccatttctattttagacggttgccgggcttcttagggcacatccctccacctctctcgataagagttaaagcatatttaatttgtattaatcctaccatcgtactaatgtttcgtcaataa

SEQ ID NO: 3666 - DNA, 294 bp, Staphylococcus epidermidis
ttctttaacgtaacatcatgtggtgaactcagtaacacttcatttgttaacgtactacgacttaacgccgcaaaacataatacagaaactgttattgctgacacaacagtcattacagttagagaaaatgcattcttcttaacacgatatataataggtgatgtgaacataacatctgtgacacttaccgttccatttctcaaccgctgtatcgctttaaatatcaatgaaactgtacttctaaagaaaaaatatgatcctataacagttaaaaataaaatagcaaaaggttga

SEQ ID NO: 3667 - DNA, 1278 bp, Staphylococcus epidermidis
tgtttcaacgttttatcctgttcgttcaaattaattccaattgatgaaattaaaatgttgtttttgcaaggtattcataaaaaaatagggtatgaaggttcaaatattattttttgtattatgcctaacttatgccaatataagaatttgttctctcaagaagagatgaatgatatcattaaaattattattgaatatcgcttgcacgtcgcatttagcatcgataaaatcgagcaaatatatgaacttaatcaactttttacatatcaatatgaaaacttaaaaattatgaataaatgttctgtttcagattacaatgtgcaatttatatttaatttgaacgaaaaaagtattcgagaaatttatcgtaatatcttgaagatacaaaacatcgaattggaatataaaataggtttagatattagttgcatgtttaatgacactgcacaatttaaatcattagcttcgcaaataaagcgtttaaaatttgactatctttatattgataatgctagattaaagtcatcctatttacttgataatgaggaaggtttattactcaaaaatattctacaatttaagcatttaatagatgatttaaagcagtttgattttagtagtgaaaatttaatttttctaaatttatataatcatcaattactgaataataatgaaattgatttaagtaatagcgctccattactatttaaaacgatttcaaaactaaaaaaacattttaaaggctacggattaaatgtattttcaaatcctaaagtctttaacgctgtacatttatttgatgagaatgggtttaaaacaacgtttggactgatttttaatcatttgagttggatgactaatcaaaaccaaattgaacaacgattctataatattattgaaaatgctgatcaatattatctctacttatatgattggcgtgtgattgaaagtgaatctaatgagagcgactttaaagacgttgatatatggattaactttgaagatgaagcgttaatagatgaatatatttgtgtgattgctaaagttgatgatgaaggtggcaatattaatcatatgatttctcaaaacttacgtcacaaatatgtttggtctacaccgttcttgatgagagttgaggagaactttagaccatacatgcacattatggaacatgactttaaaaagggcccattgaaaatcagaatgaaatataatgcagtatatttagttgaaatatataaaaaagataaaataaataaaaggcgtagcacaacttaa

SEQ ID NO: 3668 - DNA, 144 bp, Staphylococcus epidermidis
aacataaacgtccctataaagctaaaaagaaatcacaccgacgacattaacaattttaatcaatttatcgctgatggtaagttatgtcgtttcactaagattaaagtaaaaacatatgtagggggacgctatgaaaatagatga

SEQ ID NO: 3669 - DNA, 2403 bp, Staphylococcus epidermidis
atgagtttagtatatcttatggcgactaatttattagtcatgctcatagttttattcactctgagtcatcgtcaactaagaaaggttgcgggctatgttgcattaatagctcctattgtgacatctacatattttattatgaaaataccagatgtgattcgaaataagtttattgctgttcgattaccatggatgccttcaattgatattaatttagatttaagattagatggtttaagtttaatgttcggcttaattatttcgctaataggtgtgggtgtatttttttatgctacgcaatatttatcccacagtacggacaatcttcctagatttttcatctatttactattatttatgttcagtatgattggcattgtaatagctaataataccatcttaatgtatgtattttgggaactcacaagtatttcctcattcttgcttatatcctattggtacaataatggtgaaagtcaattaggcgccattcaatctttcatgattacagtgtttggtgggctagcgttattaacaggatttatcattttatatatcattacaggaacaaacacaattactgatatccttaatcaacgcaatgcaatttcacgacatcctttatttataccaatgattttgatgctattattaggtgcttttaccaaatctgcacaatttccgtttcatatttggttaccaaaggccatggcagcacctacaccagtaagtgcttatcttcattcggcaacaatggtaaaggctggaatctttttactatttagatttacacctttattgggacttagtaatgtttatatttatacagtgacatttgttggtctaataactatgttatttggatctttaactgctttacgacaatacgacttaaaaggtatactcgcttattctacaataagtcaattaggtatgattatgacaatggtaggtctaggtggcggttatgctcagcacacatcagatgaattgtctaagttttatattttagttttatttgctggcttattccatttaatgaatcatgcggtttttaaatgtgcattatttatgggcgttggtatcattgatcacgagtccggaacacgtgatattcgtttgctaaatggtatgcgtaaagtcttccctaaaatgcatattgtcatgttgctcgctgcattatctatggcaggtgttccttttttaaatggctttttaagtaaggaaatgtttttagattcgttaactaaagcaaacgaacttgatcaatatggcttcgtattaacgtttgtgattatttcaataggtgtcatcgcgagtatattgacttttacttatgcactttacatgataaaagaaacattctggggaaattacaatatagaaaaatttaaacgtaaacaaatacatgaaccatggctatttagtttaccagctgtgattttaatgttactcattccagttatcttctttgttccaaacgtttttggcaactttgttattttgcccgcaaccagatctgtatctgggataggtgcggaggttgatgcatttgtgccacatatttctcagtggcatggtgtgaatcttccattaattttaagtatagttgttattattattggacttattttagctctagttgtgaattggaaagaggttacgcatcaaataatcaaaagtgcttcgattacagatggctatcggaaaatttatagagaatttgaattatactcagcccgtggtatacgtgcattgatgaataataaattgaattattacatcatgattacattatttatttttgtagctattgtagtttatggatatttgactgtgggttttcctcatgtacatcagcttcatattagttctttcggaccgttggaagttatcttatcagttgtaacattgattatcggcatttcattaatctttattcgtcaacgactaacgatggtggtattgaatggaatgattggattcgcagttacattatattttattgcaatgaaagctccagatttagctttaacacagttagttgttgaaactattacgacaatcttatttattgttagtttttcgagactacctaacatccctcgagttaaggcaaatttaaaaaaagagaccttcaaaatcattgtgtcacttgttatggcattgacggtggtatcacttatttttgttgctcaacaagcagatggtatgccttcaattgctaaattttatgaagatgcatatgaacttacaggtggaaaaaatattgtcaatgctatactaggtgacttcagagctttagatactatgtttgaaggactagtgttaatcatagctggattaggtatttatacgttacttaattacaaagataggagggggcaagatgaaagagaatga

SEQ ID NO: 3670 - DNA, 141 bp, Staphylococcus epidermidis
aaaatgttagtaaaattctttccaaaaagtattctttttagtataatttttattaaattaaggaaaattagaaacaatcttattttttttgaatatagcaaatgctacattgctaattcaagtataaactttaaaagataa

SEQ ID NO: 3671 - DNA, 132 bp, Staphylococcus epidermidis
cgtttcatagtttcacctcatctgaaaataaaaagctgtcatcttattgatacttattattattattcatattttatacattttttagccaataagatgtcaaagactttttttaatatgcatttaaaataa

SEQ ID NO: 3672 - DNA, 714 bp, Staphylococcus epidermidis
aaaagaatagtaaaagttatggaggcaacgtgtatggacaaaaagaaactcattaaaacacttatcaatgtattaccaatcgttatcgtaccattagtaactgaacgtaagcgtattaaagaacatccagatgtacagaaagtaactaatgctacatctaaagctacttcaaaaacaacttctgcaatttcaaataaagcttcagatgtcaaagagtacgtaggagataaaaagcaagaatttgataataagcgtgaattgaagaaaattgcgaaggaaaatgatccagcctacattgagaaaaaaggcgaaaaattagctaaacaaaatcgtaaagaagcagacaaaatggacaaaaagcttcaaaagaatattgagaaacgtcataaagaagaacaaaaacaacgtgaagctaatcagaaacaacgtattaaagacatgaaaaaaactcaaaaatacgaagagcaagttggcttaactcctggtaaaatagatcacgaaattgagaaaaaaggcgaaaaactagaaaaagataatcgtaaagatattaaaaaattagataaaaagcttcaaaagaatattgaaaaacgtcataaagaagaacaaaaacagcgtgaagaagcagagaaagctagaaaaaaagaatttaaaaaatatgaaaattacgtggctgacagtgtcgtaaaacaacataaggaatcaaatcattcttaa

SEQ ID NO: 3673 - DNA, 432 bp, Staphylococcus epidermidis
atgatgatagtgatagttactttgacgcttagaaggtggattgacatggctattgtaaataaggttattattgttgaaggtaaatcggataagaaaagagtacaacaagtaatcgctgaacctgcaaatatcatttgtacacatggcactatgagtatagataagatagacaacatgatagaaacactttatgacaaacaagtttatgttcttgctgattctgatgatgagggtgaaaaaattagaaaatggtttaaacgttatttaagcgaaagtgaacatatttatgttgataaaacgttttgtgaggttgctaagtgtcctaaaaattatttagcacatgtattaagtagatatggttttaatgtaaaaaaagaaaagaaacttatgaataatttaaaaactgaaaggctagttttagtaaatgaataa

SEQ ID NO: 3674 - DNA, 1470 bp, Staphylococcus epidermidis
gggagagtagttatggcagacttaattaatattctaaaccacttcgttcaggaacaacctgaagcagttgcggttagacatacaaatgatgagctaacatataaacaacttgatgaagaatcaagtaagctagcacatctattacaagatagtaaaaagccaatgattttatatggtcacatgtcaccttacatgattgttggtatgattggagcgattaaatccggttgtggatatgttcctattgatacttctgttcccaaagaacgtgtgaatatgattattgataaagtacaaccggaaatcatttttaatacttcagatgagactttagaacagacaaatgcacaagtgcttaaggttagcgatattcaggattcacaatatccaattgtctttgatagtcaaatgaagcaaaacgatgtagtatatacaatttttacctcaggatctacaggagaacctaaaggtgtgcaaattgaatatgcaagtttaaatgaattcgcagaatggatggtatctttaaacaaaactggtactggtaaagaatggttaaatcaagcgccattttcttttgatttatcagtaatggcaatctatccttgtttaacatcaggtggtactttaaatcttgttgataaagatatgattaaaaaacctaaactattgaacgaaatgttagttcaaacaccaatgaatgtttgggtttctacaccttcttttatagaaatgtgtttattattacctaatttaaatgaacaacaatatagtagtttaaagcaattctttttctgtggggaaatcttaccacataaaacagctaaagccttagttgaaagatttccgaattcaatgatttataacacatatggaccgactgaagctactgttgcagtcacaagtatacaaatcacagaagaaattttaaatcaatataaccctttaccagttggtgtggctagacctggtacaaaattatttgctactgaagaaggagaacttgtcattgaggggcaaagcgtcagtttaggttatttaaagaatgaagaaaagacaactgcagtatttaattttgaagacggtgtcagaacatatcatactggggataaagctaaaattgaagatggattgtggtttattcaaggacgtattgattttcaaattaaattaaatggttatcgtatggaattagaggaaattgaaacacaattacgccagtcaaaacatgtaagagaggctgttgttgtgccggtttataaaaatggaaaggtcatacatttaataggagcagtagtacctactgaacctgtagaagataatttagcaatgacaactcatattaaacacgaacttaaatcacgcttaccagaatatatgattcctagaaagttcgaatggatggaacaactaccactcacatcaaatggtaaattagatcgtaagaaaattgccgaggttgtaaacggatga

SEQ ID NO: 3675 - DNA, 1914 bp, Staphylococcus epidermidis
ttaatgcaagtgataattatgcaagaatcaaagaacttaatgaggataaagagcaacttgaagcaacctatgaagcagacatcacgagatggagtgagcttgaggaaattaaagaacaataaggggaatgtaatcatgcaagagactttatcgcattattttggttataagtcatttcgaccaggacaagaagaaattataactaaaatattaaatcatcagcatacactgggggtactacctaccggtggcggtaaatcgatatgctatcaagtaccaggtttaatgcagggtggcacaactattgttataagtccacttatttctttgatgaaagaccaagttgatcaactacaagcaatgggaattcaagctgcatatttgaatagtagtttgactcataaacaacaaaaagagattgaagagcaaataaagcgtggtgccattcagtttttatatgtagctccagagcgctttgaaaatactttttttctaaatttattacgtaaaatagaaataccccttatcgcttttgatgaagcacactgtatatcgaagtggggacatgattttagacctagttaccaaagtgtcatacaaaaagtttttaccttacctcaaaacttcacaatagttgcacttacagctacggcaactgctgaagttcaacaagatatcatgtctaagttatcaattggacaaaatgatgttgtcaaaacaagtactaaaagacgcaatttaatcttcaaagtcaatccgacttatcagcgacaaaaatttgttgtggattatgttgcaaatcatgaaggacaggcaggaatcatttattgttccactcgtaagcaggtagaagaattacacgaagctctaaatagtgaaaaaattaagagcacaatttatcatgctggtttaacgaataaagagagaattgaggcgcaaaatgatttcttgtatgatcgtgtagaggttgtcattgcgacaaatgcatttggtatgggtattgataaatcaaatgtacgttatgtcattcactataacatgcctggagatttggaatcttactatcaggaagctggacgcgcgggacgtgatggtttaaaaagtgagtgtatccttttgtttagtgaacgagataagggattacatgagtattttattactgtatcccaagctgatgatgactataaagataaaatgggcgaaaaattaacgaaaatgattcaatataccaaaacgaaaaagtgtttagaagcgacaattgttcattattttgaacccaatgaaaatttagaggaatgcaatcaatgtagtaattgtatacaggaaaataaaacgtatgatatgactcgtgaagcgaaaatgattattagctgtattgctcgaatgaagcaacaggaaaattatagtgttattatacaagttttacgtggagaagtgacagattatataaaacaccatcattataatgaattaacgacacatgggttgatgaaaaattatacaacatctgagttatcacacttaattgatgagctacgtttcaaaggatatttaaatgaaaatgatgaaattcttatgtgtgatacatcagtgaaacaattactaaataatcataccaaggtttataccactccgttcaaacaaaaaactaaagagaaggtatttatcaacactgttgaaggtgtggatagagcgttatatcgtgagcttgttgatgtacgtaaacagctaagtgataaacttggaatagcacctgtaagtatattttctgattacacgctcgaagaatttgctaagcgtaaacctgaatcgaaacaagaaatgattgctattgatggtgtaggtagttataaattaaagcattattgtcctaagtttatcgaaaccatacaaagctataaaactagaatataa

SEQ ID NO: 3676 - DNA, 483 bp, Staphylococcus epidermidis
gtgaagcaagttgtattaaatattgttatcgcgttcctttgggtactctttcaagatgaagatgaatttaaatttacaaccttctttgctggatttttaattggtttaattgtgatttatattctgcatcgcttttttggtgaagaattttatttgaaaaagatatgggtggctattaaatttttagctgtatacctataccagcttattacttctagtataagtaccataaattacatcttatttaagacgaatgaagttaatccaggtttactcacatatgaaacttcattaaaaagtaattgggctattacttttttaacgattttaattattattactccaggatcgacagttattcgaatttctaaaaatactaataaattttttattcacagtattgatgtgtcagaaaaagataaagaaaatcttctaaaaagtattaagcagtatgaggatttaattttggaggtgacacgatga

SEQ ID NO: 3677 - DNA, 186 bp, Staphylococcus epidermidis
  modified_base (106)..(106): a, c, g, t, unknown or other
gataataaagtatattcttgcaaagtaacgagattgcataaccacgcactactttctatagagtgtgataatcgagagttaatgataacttttacagtgagggatntcaaacaatttgaggtgtgttctggttatacagatgtgaaagcgaagaaaaattataccggtattttcattagactttaa

SEQ ID NO: 3678 - DNA, 1920 bp, Staphylococcus epidermidis
gaacgcaaagtgtacttggtggcatcaattatgagctttaatgaaattatcttcaaaaactttaaacaaaatgtgacgcactatgctatttatttattatctcttgttatcagcgttgtattatattttagttttgtaactttaaaatatgcgcaccatttacacggtaatcaatcgtttcctgccatcaaagaaggttcacaagtaggaagttattttttatttatcattattgtggtctttttgctttatgctaattttttatttttgaaaagacgaggtcgtgaactatcgttattacaaattattggtctaacaaagaaagatatcatgaaaatgattatgttggagcaattgatgacatttatgatgacaactattgtaggtatcatattgggaatctttggttcgaaaattttactcatgattgtattgcgattattaggaatcaacgtgagtgtttctattatatttaattatcatgccattttagaaacgttattattaatagctgtgtcatatgtacttatagtctttcaaagctatgtatatttacttaaacgttctattaaagagttagcgtctgatgtaaataaaaaagagttcagtcatacacgcacaacacttggtgaagttgtattaggtttgctagggattattatgatagttagtggttatataatgtcgactaaattagtagataacgtagaaacaattattcaaccttttgctattttatttttaactgttataggatcatattttttctttagaagtacagtttcattgatatttaaagcgatacagcggttgagaaatggaacggtaagtgtcacagatgttatgttcacatcacctattatatatcgtgttaagaagaatgcattttctctaactgtaatgactgttgtgtcagcaataacagtttctgtattatgttttgcggcgttaagtcgtagtacgttaacaaatgaagtgttactgagttcaccacatgatgttacgttaaagaatcagaaacaagcaaatgaacttgcttttaaattaaataaccgtaatattgaacattactataattataaagaggtcgtgtatgcaaaagtttataaagatcatctttttagcgaaggtgtatatagaccgaaagaaatcacagtaacgagtgataaatatattccaaatgtaagtacgaaaaaagggcagacagatattattatacctagaggatctctcaaagatgttgttaaaacagacaaaaaaaggacggcttatgtaggaagtaagaagtttcgtttaaaagtaagtttgagaaaagggataaataaagtctattttatgtctgatgttgatcgtggtagaccgacacttattttaaatgatgaagattatcaaaaaattagagaacatataaaagaaaagaatattgtttcccaatatggttttgatcttaaaaataaaaatgatttaccagaattagaaaaattagttagtagtatcaatgaagatatagaaacaagaagtgaagcggcaagtgaaatttctagtttaactggtattttattatttgtgacatcgtttttaggaattacatttttaatcgcagcaggatgtataatttacattaaacagattgatgaaacggaagacgaacttgagaactacacgattcttcgtaagctaggatttacgcatcaagatatgtctaaaggtttgaaacttaaggtaatatttaattttggtttacctttaattattgcattactgcatgcatattttgcttcacttgcttatatgcatttaatgaatgtgacaaatcaaatacctatttttatagttatggcagtttatacagcaacttatgcagtatttgctattatagcttataatcattctaaaagaacaattaaacattcgatataa

SEQ ID NO: 3679 - DNA, 1320 bp, Staphylococcus epidermidis
gaggaaaaagtgatgacaactaaaactttgaacatttctgaagaacaacttgttgattattctaaagcgcacaatgaaccttcttggatgacagagttacgtaaaaaagcgttgaaattaacagaaactttagaaatgccaaaacctgataaaacgaaattaagaaaatgggattttgatacgtttaaacaacaccatacaacaggagatgcatacactcagttaactgatttaccaaaatctgttaaagaaatcattgatgttgaaaactcagaaaacttaatcattcaacataataatgaattggcatatacacaagtatcggatcaagctaaacatgatggtgtgattattgaaggtctatctgaagcactagtcaaccatagtgatttagttcaaaagtactttatgactaaagcagtagatgttgatgaacatcgtttaacagcattgcatactgcattagtaaacggtggtatttttgtttatgtacctaaaaatactgttgtagaacatcctatacagtacgttgttttacatgatgatgaacaagcgagcttttacaatcacgtcatcattgttacagaagaaagtgcagaagttacctatgtagagaactatctttctactactagtggtgaagataaccaacttaatattgtgtcagaggttatcgctggcgcaaactctaacgtcacatatggttcagttgattatttagataaaggatttacaggtcatataattcgtcgtggttctgcagatgcagatgcttctatcaattgggcactaggtttgatgaatgaaggtagccaaattatagataatactacaaatctaaacggtgatcgttcaacaagtgcattgaaatcagttgttgttggcacaggtgatcaaaaaataaatttaacttccaaaattgttcaatacggtaaagaaacagatgggtatatattgaaacatggtgttatgaaagaaaatgcatcttctgtatttaatggaattggctacattaaacatggtggtacgaaatctattgcgaaccaagagtcacgtgtattgatgttatctgaaaatgctcgtggtgatgctaaccctattcttttaatagacgaagatgatgttgaagcaggacatgcagcctcagttggtcgtgtcgatcctgagcaattatattatttaatgagccgtggtatttcaagagctgaagcagagcgtctagttatacatggtttcttagatccagtagtacgtgaattaccaattgacgatgtaaaacgtcaacttagagaagtaattgagcgtaaagtttcaaaataa

SEQ ID NO: 3680 - DNA, 1416 bp, Staphylococcus epidermidis
aatcaaggagtgattaaaatggcaaaacaagcacctgatgttggggattataaatacggattccatgacgaagatgtttccatttttagatcagagcgtggtttaacggaaaatatagtaacagaaatctctaaaatgaaagaagagccacaatggatgttagatttccgtttgaaagcattaaaactattctataaaatgccaatgccacaatggggtggagatttatctgaattagattttgatgatattacgtattatgttaaaccttctgaacatactgaacgttcatgggatgaagtgcctgaagaaatcaaacgtacttttgataaattaggtattccagaagctgagcagaaatacttagctggagtttctgcacaatatgaatcagaagttgtttatcataatatggagaaagaactggaagaaaagggtattattttcaaagatactgatagtgcattacgtgaaaatgaagagttatttagagaatattttgcgtcagtggtacctgctgcagataataaatttgctgcattaaattcagcagtatggtctggtggttcattcatttatgttcctaagaatgttaaattagatacaccactacaagcatatttccgtattaactctgagaatatgggacaattcgaacgtacattaataattgctgatgaaggtgcatcagtaaactatgtagaaggttgtactgcacctgtatactctacaagttcgctacactcggcagttgttgaaattatagtacacaaagatgcacatgtaagatatactactatccaaaactgggctaataacgtatataatttagtaactaaacgtacctttgtccatgagaatggtaatatggaatgggtagatggaaacttaggctctaagttaacgatgaaatatccaaactgtgtacttttaggtgaaggtgccaaaggtagcacattatccattgcatttgctggtaaaggtcaagttcaagatgctggtgctaaaatgattcataaagcacctaatacatcttcaactattgtttctaaatctatctccaaaaatggtggtaaagtcatttatcgtggtatcgttcattttggacgtaaagctaagggagcacgttcaaatatcgaatgtgatacattaattttagataatgaatcgacttcagatactatcccttataatgaagtgttcaatgacaatatttcattagaacatgaagctaaagtttctaaagtatcagaagagcaattattctatcttatgagtcgtggtatttctgaggaagaagcgacagaaatgattgttatgggattcattgagccgttcacaaaagaattaccaatggaatacgcagtagaaatgaaccgtttaattaagtttgaaatggaaggctcaattggttaa

SEQ ID NO: 3681 - DNA, 177 bp, Staphylococcus epidermidis
gttgggttggtatattttatgaaatttattactattaaagcgattactgagaaagggttagataaaaaagtaaatcaatttttaaaatcacatccacaaattgaaattatcaaatttgattaccaaatgggatatagcggtgtaagtgttggtattttataccgtgataatatttaa

SEQ ID NO: 3682 - DNA, 675 bp, Staphylococcus epidermidis
gaagacgaggtggtcgtcacaaaggccctcctcccttcacaacagaggatagacttaaattcgagcatgcttttagaaaaatcattaatcaaatataggaggcatattatgaaaagaattgctgtttattgtggtgcaagtaaagggaaaaacccatcttatgttaaagaggcatacgaattaggaaaatatatggctgaacaaggatacgagcttgtattcggagcaggatcagtcggcattatgggagctattcaagatggcatacttgagcatggcggtaaagctatcggtgtcatgcctaaaatgttagatgaacgagaaataacaagccaaaaagtaagtgagcttatattagtagattctatgcatgaacgaaaaaataaaatgactgaacttgccgatgcttttattatggctccaggcggtgctggttcattagaagaattttttgaaatgtatagttgggctcaaattggtatacaccaaaagcctataggtgtatttaatttaaatggattctttgagccactacaacacttaatcgaccatatgattaaagaaggatttattgatgagaaatatcaaaagcttgcacctttatatgatactaaagaatcactcatcgaaggacttaaacattacaaaccacttggtgtacgtacatacgattaa

SEQ ID NO: 3683 - DNA, 198 bp, Staphylococcus epidermidis
ttaaaatttttaagaaggagaatttatttgagtttaaaggaaatatggaaagttctcataaataaaaaatggcaaactgaagaaatatgttatttaatattgtatatatttttagcgagtatttttaccacgccattgtttggtattcctttgggagttttagcatacttatatcttaatgaagaaatattgaagtag

SEQ ID NO: 3684 - DNA, 165 bp, Staphylococcus epidermidis
tgccttttattaattcaagtaaaaacatactttacccactttcttatctctattaatttattactagtactcaaaataccatattattatagcatagaaaatcatattgatggtgtttacaatctaaatactagaccaaagtcttataaatgtattaagttgtga

SEQ ID NO: 3685 - DNA, 180 bp, Staphylococcus epidermidis
tttagtttattggtatttattaaattatacgaaagggccttattttttaagtatttcaatgtaaaattacatataaacacaaagtattttggtgagactcttgagggaacaggacaagttgaagactataggctgaagttgtccgctaagaaaccaagccaacaatacaaagtattataa

SEQ ID NO: 3686 - DNA, 531 bp, Staphylococcus epidermidis
ttgcaattatttcgtttgtcagttcggtctcaatttcaagattcatcggggaaggacgtgtcttcaatggaaatcataaaagacatcgttagtcttattgcttcgatacttattttcttaggaagtattattgcattaattagtgcaatagggattgtaaaatttcaagatgtctttctaagaagtcacgcctcaacgaaaagttctacattgtcagtattactaactgtagttggtgtactgatctattttattgtgaattcaggttttttcagtgtcagattattattatcactagtttttatcaatcttacatctccggttggaatgcatttgataagtagagcggcctaccgtaatggtgcatatatgtacaggaaagacgatgcatctagacaatctactatcttattaagccaaaaagagtttaatacgccagaagaattaaaaaaacgtgcaaaactacgagaagaaagacgagaaaaattatactataaagaaaaagaatatattaataaaatggacgattga

SEQ ID NO: 3687 - DNA, 546 bp, Staphylococcus epidermidis
gagttgatatttatgaagcctaaagtattgttagcaggtggcaccggctatattggtagatatttaagtcgagtcattgaacatgatgctcaattatttgctttatctaaatatcccaaacctgacaaaggatctacgaacaaaatcacatggttaaaacgcgatatatataatcataaagatgtagttgaagctatgaaaggtatagacattgcggtatattatttagatccaactaaacattctgctaaattaacacatgcaacagcacgagatttaaactttatagcggcagataactttggtagagctgcatcaataaataagctgaaaaagattgtgtatattccggggagccgtcatgataatgaagctattgaacgtttaggcgcttatggcgtaccagttgattgtacggatgttgaagtgaaacgtcctcatattaacgtagaattacaaacagctaaatatgatgatgttcgaacagcgatgaagatgattttaccaaagaaaatggacgctcaatcaacttgtagactattttag

SEQ ID NO: 3688 - DNA, 159 bp, Staphylococcus epidermidis
atcacgatatttttggatagtcagttattatataaatatttatttcacttaagtattcaaaagctttgtcatttcaatgttataattaacatgaagtggcaaagctttttgatttttaaagaaaaaattaaacaagggggcattgcttatggtcaatag

SEQ ID NO: 3689 - DNA, 153 bp, Staphylococcus epidermidis
ttaaagtcattttgggctttttattatcatactgttctctacttatttattaaggacagtactactcgcttaatttactactactcatttacgaatataatatataacctagtgaaaataattgttagtcataatatagaagagatgttataa

SEQ ID NO: 3690 - DNA, 930 bp, Staphylococcus epidermidis
ataggaacattaaaaataatttgtgaaagggtgatgctccaaatgaaaagtaaactatggatagttatatgtgcattgattgtagtactggctgcatgtggtcaagatgccaatcattcatctaataataaagacactgaaaaaagcgataaaaaatatcatagaattatttcgctcattcctagtaacacagaaattttatatcgcttaggaatcggagaagatatagttggtgtatccactgtggatgattatcctaaagatgtaaaaaaaggtaaaaaacaattcgatgcgatgaatttaaataaagaagaattaataaaagctaaaccggatttgattttagcgcatgagtcacagaaaaattctgcaggtaaagtgctaaagtcacttaaagataagggagtaaaagtcgtttatgtgaaagatgcacaatcgattgatgaaacttatgatacttttaaatcaattggacaattaacggatcgtgaaaaacaagctaaagaacttgttgatgaaacaaaacacaatgtagaaaaaatcattaactccgttcctaaacatcataagaaacaagaagtgtttatggaagtatcgtctaaaccagacatttacactgccggaaaagataccttctttaacgatatgttagagaaactagatgctaaaaatagttttgatgatgttaaaggttggaaatcagtaagtaaagaaagcattattaaacgtaatcctgatattctgatttccacagaaggtaaatcaaaatcagactacatagaaatgataaaaaaacgtggcggttttgataaaattaatgctgttaaaaatacacgtattgaaacagtagatggggatgaagtttctcgaccaggtcctcgtattgatgaaggtctaaaggatttaagagacgatatatataaaaaatag

SEQ ID NO: 3691 - DNA, 210 bp, Staphylococcus epidermidis
cctatgacattattatggttagctatattaatacttcttactgtattaggtaaaaagatgtcaaaccaagccattaaaaacaatcaagtgcttattgctaagttaatagctactataactacattttgtgcgtttgtgttggtttatttgcttatgcaatctataatgccacatattattaaattgatgaatgtcttttatcatcattaa

SEQ ID NO: 3692 - DNA, 159 bp, Staphylococcus epidermidis
aaattacaattaatatttgaaattgatttaataaatcgttattttaaagttggagtggataaaagtgtttccatgattttatcgctcatcatttttaataagattatgagacacttatgtaaaaatttaatatctagtttgttaagaatttgtaaatag

SEQ ID NO: 3693 - DNA, 876 bp, Staphylococcus epidermidis
agtatgtttttacttgaattaataaaaggcatcatcttaggtatcgtagaaggacttaccgaattcgcccctgtttcatctactgggcacatgatacttgtcgatgatatgtggttaaagtcaactaattttctcggttctcaatcagcattcacatttaaagttgttatacagttaggttcagtatttgcggccgcctgggtatttagagaacgcttcttagaaattttacatattggccaacataaacctgaaccttccacttcgggagacagacgttcaaaaccacgacgtctgaatttaatacatgtattagtaggtatggtcccagcagggattttaggatttttatttgatgatttaattgaaaaatacttatttagtgtaccaacagtcttaattggtttatttataggtgccatttatatgattatagctgataagtattctaaaactgttcagcatcctcaaacagtagatcaaattaattatttccaagcatttgtcattggtatctctcaagcaatagctatgtggcctggatttagtagatccggttcaacgatttcaacaggtgttcttatgaaattgaatcataaagctgcatctgatttcacttttattatgtcggtaccaattatgttagctgcaagtggattatctttactaaaacattatgagtatattcatttagcacacataccattctacattttaggatttttagcggcatttattgttggattaattgcaattaaaacattcttacacttaattaataaagttaagttagtaccttttgctatttatagaattgtcttagttatttttatagcaatcctatacttcggattcggtattggcaaaggaatttaa

SEQ ID NO: 3694 - DNA, 354 bp, Staphylococcus epidermidis
ttgattaaattttatcagtatccgaaatgcacaacgtgcaaaaaggctgcaaagtttttagatgagcacgatgtgaattatgaatccattgatattgttcaacatacaccgactaaaaaagaattcaaaaatatcgtagataaaacgggtgtgaatattaataagttgtttaatacacatggtatcaaatatcgcgaattaaatttaaaagagaaacttaaaaatatgtctgatgatgaaaaactagaactacttgcttcagatggaatgttggttaaacgtccattagctatttctggtaaccatttgactttaggatttaaagaaaatgagtatcaacaccaatggttatag

SEQ ID NO: 3695 - DNA, 168 bp, Staphylococcus epidermidis
tcacctaaatttagcgttgaagtcaaagaaataaacacaggtattaacgcagaggctaagctcgttgcacttgcaaaacctaaatgtattaatatattaaataaggtaattaacgcaatagttgctatgatcggtaaatgtttaagacccatcaaaccaaatgtttga

SEQ ID NO: 3696 - DNA, 123 bp, Staphylococcus epidermidis
aaagctaaattgagaattttaatagagatgttttatagagataataaattggtattcgaactaccagttgaaaatctgactaaagggcttaatattaatttagttatcaacaaaaaagcctaa

SEQ ID NO: 3697 - DNA, 297 bp, Staphylococcus epidermidis
atgaataaattgaaggatattgaagacataactgttaattttaataaagaaaaacatctcatatttggttatacaccaatgtgtggaacatgtaagatttctgaaaggatgttggatattgctaatgaaatcttacaattgccaataaaaaaaatagatcttaatttttatcctgaatggagtaaagagaaacaaattatgtctgttcctgttttgttgcttatgcgtagagaggaagagataaaaagaatctacgcatttcagtcagttacttatttgttagaaaatttaaaataa

SEQ ID NO: 3698 - DNA, 180 bp, Staphylococcus epidermidis
ttcaacaaatttaatgatcactatccattactggattatattagatttgttaataccattgatttgtataacttgaaatatctattcagaaactacgattacatcttttgtattatcgttttatcagtatctgatgaatatttgagtccgaaacctaaagttctatctatactaatatga

SEQ ID NO: 3699 - DNA, 978 bp, Staphylococcus epidermidis
ctaatgaaatttatttttaaaggttataccttatttattttattagtgattttaactattgtctctttatttataggggtgagtcagctctctctaatagatattttccatttaagtgatgaacaaataaacattttgttttcgagtcgaattcccagaacagttagtattctactttcgggtagttcactagctttatcaggattaattatgcaacagatgatgcaaaataaatttgtaagcccaacgactgctggtactatggagtgggcaaaattaggtattttaatgtcattgttgttctttcctaatggtcccattttaatcaaattattatttgctgttgttctaagtattgttggaacgtttttatttgtccaattaattaatcttatccgtgtaaaagatgtaatctttgttccacttttaggcattatgattggtggtattttatccagttttactacatttgtagcgttgagaaccaatgctttacaaagcattggaaactggttaactggtaactttgcagttataacgagtggtcgttttgaggtgttgtatctcacaataccattacttattttggcatttgtatttgcaaatcattttactattgcaggtatgggaaaagactttagtcataatttaggtgtaagttatgaaaaaatcattaaaatagcattattcataacagcaacgctaacagcattagttgttgttactgttggaacattaccatttttaggtttaatcgtaccgaatatcatatctatctatagaggcgatcatttgaaaaatgctttaccacacacgcttatgctcggtgcaatttttgttttaattgctgatattattggtagaataattgtttacccttacgaaattaatattggattgacgataggtgtatttggcacaattattttcctaatcttgctaatgaaaggtaggaaaaattatgcaaatgagcgctaa

SEQ ID NO: 3700 - DNA, 1350 bp, Staphylococcus epidermidis
ttggaaacttcgaccataattagtttagttatattttttcttttgattgcattaacaacagtattcgttgggtcagaatttgcactagtaaaagtgagatcaacgcgtattgaacaattagtagatgagggtaataagagcgcaaaaattgtcaaaaaaatgatagacaatcttgattattacttatctgcctgtcaattaggtattacagtaacatctttaggcttaggttggttaggtgaaccgacatttgaaaagatgatgcacccactattcgagttattacatttaccgagtcctttaacaacgacgatttcatttgttgtttcattcattgttgtgacatatttacatgttgtattaggcgaattggcacctaaatcatttgctattcaacatacagaacaacttgcacttttatattcaagaccattattttattttggtaattttatgaaaccacttatatggttaatgaatggttcttctcgtgtgattgtcagaatgtttggatttgatccagatgctcaaactgatgcaatgtcagaagaagaaataaaaattattataaacaatagttataacggtggagagattaaccaaaccgagcttgcgtatatgcaaaatattttttcatttgatgaacgtcatgcaaaagatattatggtgccacgtacacaaatggttacgctcaacgaaccatttaatgtagatgaattattagatactatcaaagaacatcagtttacaagatatccaatcactgaagatggtgataaagaccatgtaaaaggttttataaatgtcaaagagtttttaacagaatatgcgtcaggtaaaccgattaaaatcgccaattatattcatgaattacccatgatttcagagacaactagaataagtgatgctcttgtaagaatgcaaagagagcatgtacatattagtttgattatagatgagtatggtgggacagctggtattttaacaatggaagatattttagaagaaattgttggtgaaatcagagacgaatttgatgatgacgaagttaacgatatagttaaacttgatgatcatacttatcaaattaatggtcgtgttttacttgatgatttaaatgaaaaatttggcatagagtttgaagattctgaagatattgatactattggtggttggttacaatcacaaaatactaatttgcaaaaagatgacttcgttgatactgaatatgatcgttggacgattacagaaatcgacaatcatcaaattatttgggtcaacttaaattatgaatttaatagtggacgtccttctgttaatgaagaacaagaagatgacgaacgtgattaa

SEQ ID NO: 3701 - DNA, 1509 bp, Staphylococcus epidermidis
tttatgacttcaaataagtcccatgaaaaagcagttcaagaaataccacaacatggattcttcgggcatccaaaaggattaggcgttctctttttcgtagaattttgggagagattcagctattacggaatgagagcaatgcttattttttatatgtattttgcactccaggaaaacggacttggaatggacaaaacaacagccatgtctatcatgtctgtatatggatcattaatttatatgtcttcaattccaggtggctggatagctgatagaattacaggtacccgaggtgccacattaatcggagctatattaattattataggtcacatatgtttaagccttccttttgcaatggtaggtttattcacttctatgttctttattattgtaggatcaggtttaatgaaaccaaacatttcaaatattgttggtagactctatccagaaaacgacgtacgcatggatgctggatttgttatcttctatatgtcagtgaacatgggtgcactcgtttcaccaattattttacaacactatattgatattagaaatttccatggcggcttcttgattgcagcaatagggatggctcttggattagtttggtacttactatttaaccgaaaaactttgggtagtatcggtatgaaaccgacaaacccattatcttcttctgaaaagaaaaagtacggaacaatcatcggaatcgttgttatagcaatagtattaatccttatgattgcttactttacgcatacgctatcatttaatttaatcagtaatactgttttaattttaggtattgctttaccaatcatttactttacaacaatgattagaagtaaagaagttactgatactgaaagatcaagagtaaaagcatttattccgttattcattttaggcatgttattttggtcaattcaagaacaaggatctaatgtattaaatatctatggtattgaaaactctgatatgaaattaaatttatttggttggaaaacacattttggtgaagctattttccaaaccattaacccattatttattttattatttgcacccgtggttactcttttatggcaaaagctaggaaagaaacaacctagcctacctattaagtttgcaattggtactattttagcaggcgcatcctacatacttatgggagcaatcggtcatatttatggggatacacaattctcagttaactgggttattctttcatacgttatctgtgttattggtgagctttgtctctctccaactggtagtagtgcagcagttaaattagcacctaaggcatttaacgcacaaatgatgagcctttggttattaactaacgcttcagctcaggccattaacggtacattagttaaattaattaaaccacttggtcaaaccaattactttatcttcttaggtgttgttgcaaccgtgattacgttaattatattagcgtttattcctaagatttctaaagcaatgaaaggtattcgttaa

SEQ ID NO: 3702 - DNA, 408 bp, Staphylococcus epidermidis
tataacgaatttgttataaaggttaaaaaattatgggaggttttttatatgccaacagtcattttaactgaagcggcagcatttgaagttagagacatgttaaaaaataacgacatgtctgatggttatttaaaaattaaagtaaatggtggaggatgcacaggattaacttatggtatgtcagccgaagcagaacctggtgaaaatgatgaaattctcgaatactatggtttgaaagttctagtagaccgaaatgatgctcctgtattaaatggaacaacaattgattttaaacagtcacttatgggtggaggatttcaaataaataatcctaatgctattgcctcatgtggttgtggaagttcatttaaaacagctaaagtcgctggaaatccagagcaatgttaa

SEQ ID NO: 3703 - DNA, 153 bp, Staphylococcus epidermidis
cgctggtttttaaattctaaacaaatgtatctatatagtttttgtatacggtattcattcatgatttatcggcctcataattttagatatattaattatattagagatttgttatcaaatacatttcattacaagcatataattgacctgtga

SEQ ID NO: 3704 - DNA, 126 bp, Staphylococcus epidermidis
aatatgaagttgctggatattatctatataatgctaaaaaagacttatacaaagaactttataaacctattagcgaggtgtagtatatggcttattcaaaaggaaattataaaaagaaaaaaatag

SEQ ID NO: 3705 - DNA, 1644 bp, Staphylococcus epidermidis
ggaatgactacacttttaggcgaattagaaagtaaagcaacttctataaataaaaagaatctagtaatacaagattttgatactaaatgccctaatagaaatatatttgtggtaggagggccaggttcctataagtcagctgggtatgttattcctaatgttattgttaaaaatcaacaatcaatagttgtaactgaccctagtggcgaagtttatgaaaaaacatctaatattaaacgcatgcaaggttttgatgttagagtagtaaatttcaaaaactttttagcctctgatagacaaaacttttttgattatattgataaagattctgattgttcaatagttgctgaattaattattaaatcagctggggattctaaaataaataaagacgtatggtataaagcctctgtaggattattaaattcattgcttttatacgctaaatatgaatttgaaccagaaaaacgaactataggaaacattattaaatttattcaaaataacaaacctaatcaagatgaagaaggatcagttgaattagataaacgctttaatgaattatctaaagaccacccagctagagaaagttatgaatttggttttgcagtatcagaaggaagaacaagagcaagtattatactaacctttgtagccgatttacgaaattacattgataacgaaattagaagttatacaagcgattctgattttgatttacgagatgtaggattaagaaaaactattatatatgtaatgttgccagttttggggaacactgttcaatcactttctagtttattcttctctcaaatgttccaacagctatataggttaggggacgaaaacggtgctagacttccagtcccagtagattttttactagacgaatggccaaatatcggcgcaataccagactatgaagaaactttagcaacttgtcgtaagtatggtattagtatcacaacaattgttcaatctatatcacaagcagtagataaatataataaagataaagctaacgctattataggtaaccacgcagttattttatgtttaggtaatgtgaataatgatacagcaaaatatataaaagaagaattaggtaatgctactgtagagtttgaaacaagtagtgaaggttcttctagtggtaaagatagcagaagtaaatcatcaaataaaaatgtaagctacactggaagggcattactaaatgaagatgaaataagtaatatgcaacaggataaagctattcttataactaaaaatagaaatcctaaaattattaaaaagttagcatattttaaaatgttccctaatttaacagaaacgtatatagcacctcaaaacgaatacaaacgtaaaaaaaaccagtctatgattgataagcataatagattaagagaagaatgggataaaaaacaagagaaaaataaacagcaaaaactagaagaatataaagaagaacaaagacagaaagagttagagaaagaacaacaaccacaagaagaacaacaaaatgagaaagtaaaagaaagtaaagacaaaaacgatcaagaagataagaaagacgagcaacaaaaaattaatgattctaagaaagcattctacgaaaaattaaaacaaaaacaagctaaataa

SEQ ID NO: 3706 - DNA, 168 bp, Staphylococcus epidermidis
atgaaagtaacaaatacaattagatttgaagaagaaaagaaaaacttaattgataatgtagtaaatacactagaagaatataaagatgttatcgacagtgaattgcgtactattagaaacactaatcatttagttatgagaaataatttggttctgttgcaaagttga

SEQ ID NO: 3707 - DNA, 3081 bp, Staphylococcus epidermidis
aaagttttgacaaagaaatatttaaacacccagaatgaaatatcagcattttggaatactcaaaagatatttaaaaaatcaattgacaatagaaaaggacaggaaagttttgttttttatgacggccccccaactgcaaatggccttcctcatgctggccatgttcttggaagagtaatcaaggatttagttgcaagattaaaaactatgcaaggtttttatgtagaaagaaaagcaggatgggatacccatggcttaccagttgaattagaggttgaaaaaaaaattggaattaaaggaaaacaagacattgaaaagtatggaatagaaaattttataaatgaatgtaaaaaaagtgtatttaattatgaaaaagaatggcgggatttttctaaagatttaggatactgggttgacatggactccccctatataactcttgagaataattatattgaaagtgtatggaatatattatctacattccataaaaaaggactattatataagggacataaggtgactccttattgtacacatgatcaaaccgctttaagttctcatgaagtagcgcaaggctataaaaacgttaaagatttatcagctgttgttaaatttcaacttacaaatagtaaagatacttatttcttaagttggactaccactccctggactttgcctgcaaatgtagcattagctataaataaagatcttaattattcaaaaattcgggtagaaaatgagtattatatcttagctacagatctaattaattctataataactgaaaaatacgaaattattgataccttttcaggaagtaatttaattaatttaaaatacattcctccttttgaaagcgacggtttagttaatgcatattacgttgttgatggagaatttgttactaactcagaaggaactggtattgttcatatagcaccagctcatggggaagatgactaccaattggttttagagcgtgatttggatttcttaaatgttataacaagagaaggagtatataatgataggttccctgaattagttggtaataaagctaaaaatagtgatatagaaatcataaaattattatccaaaaaacaacttttatataaaaaacaaaaatatgagcataattatcctcattgttggagatgtggtaatcctttgatatattatgcgatggaaggttggtttattaaaacaactaattttaagaatgaaattattaacaataataataatatagagtggtttccttctcatattaaggaagggagaatgggaaatttcttagaaaatatggttgattggaacattggtagaaatagatattggggaacaccattaaatgtatggatttgcaatgattgtaatcacgaatacgcaccaagtagtattaaggatttacaaaataattccatcaataaaattgatgaagatattgagttgcatagaccttatgttgataatatcactcttagttgccctaagtgtaatgggaaaatgtctcgagtagaagaagtaatcgatgtttggtttgatagcggctctatgccgtttgctcagcatcattatccttttgataaccagaaaatttttaatcaacactttccagctgattttattgcagaaggagttgatcaaacgagaggctggttttacagtttactagtaatttctactattctaaaaggaaaatcttcttataaacgtgctttatctttaggacatattctagacagtaatggtaaaaaaatgtctaaaagtaaaggaaacgttattaatccaactgaattaattaataagtacggagccgattctttaagatgggccttaatttcggatagtgctccatggaataacaaaagattctcagaaaatatagtagctcagaccaaatcgaaatttatagatacgcttgataatatttataaattttataatatgtataataaaatagatcactataatcctaataatgaaattacaaaaagtagaaatacattagataattgggctctttctcgcttaaacaccttaataaaagaaagtaatatttatgtaaataattacgatttcacttccgcagccagattaattaacgaatataccaatacaataagtaattggtatattcggagatcgagaggacgattttgggaacaaggaatttctaacgataaaaaagatgcgtacaatacgctttatgaaattttaacaactttatcaagactagtggctccatttgttccatttatatctgaaaaaatccattataatttgactggaaaaagtgtgcatttacaagattatccacaatataaagaaagttttattaatcaagcattggaagatgaaatgcataccgttataaaaattgtagaattatctagacaggctcgcaaaaatgcagatttaaaaattaagcaacctttatcgaaaatggtgattaaacctaatagtcaattaaacttaagttttttacctaattactattcaataataaaagacgaattaaatataaaaaacattgaattaactgataatattaatgactatattacctatgagcttaaattgaatttttcttctgtgggaccaaaactagggaacaaaacgaaaaatattcaaacattgatagactccctatcagagtatgataaaaaaagtttaattgagtctaataacttcaaaagtttatcttctgatgctgagttaactaaggatgattttataattaaaaccttacctaaggatagttatcaactcagtgaagataatgactgcgttatattattagataaaaatttatctcctgaattaattcgcgaaggacatgctagagagctcattagattaattcaacaattaagaaaaaagaaaaatttaccaataaatcaacgtattgatatttatatcggtgtaactggggaattattagaatcaataaaaaccaataaaaatatgtttaaagaaaatttgctgattaaaaatatacacttaaatgttatagatgaatatgaaaatactattcattttaataataaagaaataaaaatttccttattatattaa

SEQ ID NO: 3708 - DNA, 645 bp, Staphylococcus epidermidis
ctctcatttgcattgagaattaattttatagataactatacattaaaaacaatatacaacgctattttagaaaggataattacaattatggccaatattggttatgctcgtgtatctaccagagatcaaagtttagatttacaaatagacgctttgagtaattttggttgtgagaaaatatttagcgaaaaagttagtgggcgtaaagtaaatagaactgaactagataaatgtttagattatttacgtgaaggcgacactttagttatttacaagctagatagattaggcaggactactaagcaactgatagatttagcccaatggttagaaaataataatattgaattacaaattattgatatgaatatcaatacaaaagacccaatgggaaagatgttttttacaatgatgagtgcttttgctgaattagaggctaacttattaagcgaaagaactaaaaaaggtttagaatcagctagagcaagaggtaacatgggaggcagaaaagcaatgccacaagaaaaaaaagaatacattaaacatttatacgataccaaagaatatacaggacaagaaattgctaaaaaaacgaatgtaagtagagatactgtatatcgcattttacgagagtttaaaaagtaa

SEQ ID NO: 3709 - DNA, 483 bp, Staphylococcus epidermidis
tactcttatttcactctttatttttacgaacatatgttctataatttggttgaggtgtttactgatatgaaaataataaatcctaatatgcccgaaccgtacaaatatgaaactgattatagaaacatacctagggaatacttaaatccacatattccaaaaggtagaggaatagttaaatggaacgcatttaagacgataccccagcaatatgaaatattggaacaacacatagaagatcaaaataaaataaatatgcctctattgtctgatgaccagctacaagaaattaatgagaaagtaagtagtaagattagtaaaaatatattaactgatttagattactggaaagacggatatatatattcgattcaatgttacattaacaaaatagatgaatttaatggatttatgattatcactaattccaattcaaacaataaactaaaaatacctttaagtagtattgttagcgtacagtaa

SEQ ID NO: 3710 - DNA, 165 bp, Staphylococcus epidermidis
aaatttccttattatattaaacaaacatggccactctattttagtagagtggccatgagttatcaaagccaagcaaaaggtgataaactatgtataattttgattattctaaattaccaattaaaaatattcaaaaaatatttcctattgcagggggatatgtga

SEQ ID NO: 3711 - DNA, 1728 bp, Staphylococcus epidermidis
tatatggcttattcaaaaggaaattataaaaagaaaaaaatagattcaataatagaagaattgaataataagctagatgacttcaaaaacaatgacaaaacctataaggaatttttagatactacagcgaaatttcacaactattcaattaataatattattctaattgctggccaaaatccagaggctacagctgtagctggttataaagcatggaaaaataaatttgatagacaagtgcaaaaaggtgcaaaaagtatgaatataattgcccctattgtacaaaaacgaaatgtagaaattaaagatgataacggtaatatagtacgtgataataacggtaatcctaaaactgaacgaaaacccgtaattactggatatagagcgcataatgtgtttgatgtggcagatacgaaaggcaagcctttaataacagcaaaagacctaataaaaaccgaatttgaaaactctaacgactataaagacttatataatgaatttaaagattatattaatgaagaattaacacctagtgtagaggaaaaacattttcttgatgatcctactttatctaatggcgctaaaggttattatagtcctaaatctgatgaaattgtaatctctgatgatttgtcatatgatatgcgctttaaaactttaatacatgaatatgcacactctcaattacacaataatgatataggtaaaacgcaaatatctgaacatagtagatcattaaaagaaatcgaggctgaaagttctgcttatgtagtagctaattattacggtttagacactagcgattattctttaggttatttaagtggctgggggcataatataagtgatgatgaattaaaagcccacataaaaaatatacattcgttcgcaaaaactacaattgaagaaataaattcattgccagagttttctcaatatatagataaaaaattagaatcagaaatgaacaaagatgtatataaagacctttcaacaatgatagataccaatctaaaaaatggttttgataaaataactattatcaaaggtaatttagttaatgattatggacttaatgaaatttctgagaatagttatgaaaatgatgattttaaagtgaatattgattacaaaggatttaatactaataattcgcaagatcaagctaaaattgagttaattaataagcatgatgattcattgaatagagattacaacttcacgcaaacttataaccgaaatgtaattaataacaccacaactatttttgtacaagatgatgataatgaagataaaaacaaaaaatatatccatgaacgagatatagacggtaatatattagaagaaaaacataaattaagctcacaagatgaaatagtatcatttgaaaactttgtaaataaatcagttgaagaaaatggcctaaaagatacattacgccaatttgtaagtaatggtgtattaatgggctatgaattaaatgttgataatattgataatacaaatgaaacttacttttcaatgaataaaaatcaacaaaatggccaacgatcaaatatgactgctaaattagaacatgatactaacgaaaatgtttatatagattttaaaattaaaaattcagctggtattaaaaacatatcctatactgaaagtaatgaagaatttaataaagatgaacagaataaagaaattgaaaacaaacaagaagaagaaattgatatataa

SEQ ID NO: 3712 - DNA, 288 bp, Staphylococcus epidermidis
tatatggattacacaaatcaaaaaagaaaatacataatatttggtattgttcttgctataacacttctaattgttggaattgcttactatttaatcagtttgaataatgctaaaggacaagttaaagaatttgaaaaattagtacagcataatgactacaatagtattgctaaaaagttatctaataaagaagaaactttatctgaaaatgatgctaaaaactttgtgttatttgttaaaagtaaagaaaatcaagaacaatacaatgagcaaatacaaaaaaattaa

SEQ ID NO: 3713 - DNA, 195 bp, Staphylococcus epidermidis
tttttatatctgcgccacaacgccgattctagttcgtgcagtattaatttttatatctgcgccacaacgccgattctagttcgtgtagtattaatttttatatctgcgccacaacgccgattcttttcttacttatattatatcaatacctgtcatgttatgcaatgtttaggattactttttaaactctcgtaa

SEQ ID NO: 3714 - DNA, 336 bp, Staphylococcus epidermidis
aacttgaatctgtcaaacgaaaaggttataattaaattaataaaaaatatggaggttttatttatggctgatattcaaaaaatgttagaacaaaaagaaaaacttcaagaaaaaattaaagaagaaaagaaaaaagaatatgaaaaatttggaagatggttcttcaataaatttaaagtaaatagatcagcagacgcaaagaaaattataaataaaaatttgcttaatattgaagatactaaagaacacaatttagaaagaaatgaaattatagaagaaactaaaaattccaatgaagaaaacaaagaaataaatgaaataaaccacaatatttaa

SEQ ID NO: 3715 - DNA, 141 bp, Staphylococcus epidermidis
tacaccagtcaacccattataacgctattaagaaaagtaattatcagtgtaataaatacaatcgtttataatactcttatttcactctttatttttacgaacatatgttctataatttggttgaggtgtttactgatatga

SEQ ID NO: 3716 - DNA, 1647 bp, Staphylococcus epidermidis
gtttttattaaaaaaaggagtgatttaataatgagatttacaccccgaggaattttgaacaacaccgattatgaactaaattctgaattttattatgtgccagcaagtgataaacaaatgaatgatcaaagagatatgactaataaaagcatagtaggtaatttagtctatagaaataatttctataacgaagtgtatactcaaccagtttatgatttagacgattctaacgaaaaatatcaaacaccacatattataagtatagatgattctgaatttgattataacttaactaatttagatgattattttactaaagatacagcaaataaaggttatgaaaagctagtaaatgccattaaatcagaagaaattacctattttgacagtgatattaatgaagttgatgattttacacaacaagatgaatattcaaatgattggtatactaacacttttgtggatttagtattaagtatgaaaggatattcatatcatgtagaaccaaatagagaatctgttattgaggattcacatatcataacagaaaatgatattacttataatgtaagctataaccccgaaaaacatcatttatatattaatgacttcccagcaattccaatagaagaaaacgataatataagattattaaatgataacttaactcaagacatggaaaaaacttacgataatataaactataatttttcatacaatgattttaaaacacttgaagatgattcttatatttatattgatttaacagattataaagataacgaaggtaaatttgttaaaaatctaatagaagatataccacctaatgaaattattaaagatagattaaaacaaaatattaatttatttgacgaacgagcaaattataatgccttagctgtttatagaagggatttagaagatttttcagatagaaataatttagatagcttagataaagttaaagatttaaaaacattctatgatacggaaattaatattaaaggattgaacattaacaacgatattgagaaaaaggctttaaataatcaattagcctttaacctttataatgaaccgttaaataacatgtttagagataacaatgttttatatgaagtttatgaaaaagaaatttatgatgaaaaaattcccctttctatagaagatagaaaagaagtgaaaacttatttagatgacgctagaaacaatttttcaaataatttctatgaatatacaacgaacaaatcatctattttagctgaaaatagtttaactgttttagataaagctaaatatgatttagaatttgcccctgtatctaatcatttatacaaagaaagagaaaatttttacgaaggaatgaaacaagctaccctgcccttacacaatattactaaagaacaatataaagaaagagaaaatgatattgaaataatcggtcattttaaaaactatatcaatactgaattacatggaacaaagagttctgaattcaaacctaatttcgtaaatgattctttagaaaatgaaactaactcaatagcttttgaagatattataaatggatcagaagaaacacatagtaatattattaattctattaaaaatgaattaaagcaagaaagagataatttagaaatgtag

SEQ ID NO: 3717 - DNA, 309 bp, Staphylococcus epidermidis
aagacttataaaataattggtttactaatagcaaaatctacagtagtcaatactttaaaaataggaggttttattatgattttattatcaacagctggcgaaaatgctgttcatattaaccctatttttagattttttctatattttattatgtgtgttcctatgacagttgctttatgtacaatattccttaaatttatctcaatttttattcttccatggaaagtatgtttgtatattggtattgctttaggtattattgttactatttttcttttggttataacaattggtatagaaatgacataa

SEQ ID NO: 3718 - DNA, 603 bp, Staphylococcus epidermidis
actatgtataattttgattattctaaattaccaattaaaaatattcaaaaaatatttcctattgcagggggatatgtgaatctatctttttcagttgatgcttccaacaaaaaatattttttaaagctacaacctaatactaaatcaaatttttttgattatgagttatccagtttaaaagaattaactgataaaaatattcctgttcctcaaattattaataaaggagaattagacaataattcttttttactgttagagttcattgaaaatggccatgcttatcctgaaagctatagaaaactaggtaaaatagttgcaaacatgcataaaaatataaattcactaaatctatttggctttagtcataatttcaatggaggaacgattgaattcactaataaatggacttcttcttggggggatttatttattaaaagtaggatggataagctatgttctgaaatatacaagaaacgtttattttcaatttcggatcttttattatatgaagatatacgaaaaattatgttgaagagcttatattatcaccaatcgtcaccatcattacggttctgttgcaaagttgaatttatagtataa

SEQ ID NO: 3719 - DNA, 480 bp, Staphylococcus epidermidis
aaggaggataagaaagtgaaaaaaggaatattcattttaactggtattatttggctagtattaatatatttagcgcaaatattagcatatgctttaaatacactaagtaatactagcaataagcaaaagatatttagtgatatatcacagttgtttatacctccagctaaacacccaataagcactattatcggttttgtatctgataaaaatacagtgttttttgtaataggtgtaatagcaacaattatttgtatatatattcttataaaacaattatttgagagcaaagacggaaacgaaaaaaatcaagactataaaattgctaaacatggttctcatggatcagctaaatttgccgaagatagcgaattgttttcagaaggacattataaaaaaatgaaagaaaacgacattacgaactatgtttataacagtttagataaatcattaatagaagaaagaagtgataaggaatga

SEQ ID NO: 3720 - DNA, 1296 bp, Staphylococcus epidermidis
ataggaggtaatctcatgaaaattagaaattttaatgaaggaacattggtaggaaaacataaccacttagaatatatcatcaatgttgatttgtgccatatatcagatatagacgaaattagatatgacttaacagaacctaatgaattgttttttgaagttaaagatttacaaaaggaaggcgattattttcatatcatttacaacactgataatgaatataattccttcctatcagcaaaaaaagaaagcaaagcactcaaattatctttaatggattatgtgttaaaagttgatccattaaaggacaatataactgttatgcacccagcgaacctattttttaaaaatattgaggatataaaaataggattcaaaggccatgaatatttacctaaacctaaaataaataatttagaacagtataaattgttaataatgagtacattatcacaatacacgtttgataagtattatcgcaataaatttgaagttttatcaaaagaaaaagatgattttttccataaagtaaataatgcagaaacttttgaaaaattgaaagagattgtaagacatgaattgaatcaagtacagacagattatttactgaatgaagaaaaacgtaaaagagaaacacgaaaaaagtacattagaaatttaatacttggttttgttggtattgcaatagttataagtttaatttcatttatgattataaacggaaagcaacaagaattagatagcaaaatagcacaagcagacaaacaagaacaaagaagtaaagtatatgaaaatctttacaatggcaatgttgatcaagcagttaaaggcatgaaacgtgacgatagctttaacaaaaaagatattgaaaaaacattaaaaaaagaaaagaaatatgaagaactaattgaattgagtagtaaaaacacaccttatgtaattgaacaattatataaagaaggtaagcagaataaaataagagagttagctttcaattttgaaaataacgatacattgagtttagaaaagaaaatattagacaaagacggaacagcatttagtgtaggctcaacaggtaaatacgaagaacaaagtaaacgtttggctttagcgtcagctaaagaaggttatgttgaatcagctaaagatattaataaaaaacttaaagataatgaagttgaagaagaaataaataaagctgaaattaaacaactaaaagaagaaaaagacagcacgaaggataaagacaagaaaaaagaaatccaaaaagatatagaggaattagagaagaaatag

SEQ ID NO: 3721 - DNA, 234 bp, Staphylococcus epidermidis
atagtagccaacggctacagtgatgacgtccttgttaaattgtttatatctgaaatagttcatatagcatactcctttttgttaaaattatactacaaaatcaactttgcaacagaaccagatcacttatcagaagctacctatcatcgtatattcgtagatgatataatatacaagtcgtctatctctcaggcgtcaattccgacgcagagaggaggtgctaatctatgctag

SEQ ID NO: 3722 - DNA, 162 bp, Staphylococcus epidermidis
atagtagccaaccgctacagtgataacatccttgttaaattgtttatatctgaaatagttcatacagaagactcctttttgttaaaattatactataaattcaactttgcaacagaaccagttaaacaatgttatgccaagttacaatgtttttatccgtaa

SEQ ID NO: 3723 - DNA, 135 bp, Staphylococcus epidermidis
atagtagccaacggctacagtgataacatctttgttaaattgtttatatctgaaatagttcatacagaagactcctttttgttaaaattatactataaattcaactttgcaacagaaccaaattatttctcataa

SEQ ID NO: 3724 - DNA, 123 bp, Staphylococcus epidermidis
atagtagccaacggctacagtgataacatccttgttaaattgtttatatctgaaatagttcatacagaagactcctttttgttaaaattatactataaattcaactttgcaacagaaccgtaa

SEQ ID NO: 3725 - DNA, 174 bp, Staphylococcus epidermidis
atagtagccaacggctacagtgataacatctttgttaaattgtttatatctgaaatagttcatacagaagactcctttttgttaaaattatactataaattcaactttgcaacagaacctgaagagatctgcggttctttttatatagagcgtaaatacattcaatgcctttga

SEQ ID NO: 3726 - DNA, 123 bp, Staphylococcus epidermidis
atagtagccaacggctacagtgataacatctttgttaaattgtttatatctgaaatagttcatacagaagactcctttttgttaaaattatactataaattcaactttgcaacagaaccgtaa

SEQ ID NO: 3727 - DNA, 750 bp, Staphylococcus epidermidis
aacaatcacaacgatttagcagaaggcagaaagtttacttctataaaagtaaagaaggattgggtgatgatgatgtttaaaaaaaagaataagcaaaataaaaataacgaacaacaatttgaaattataaatagatatataaaaggggacggacgtaatcaaagtattcaagaagattcactaatagctggtttttataaagattacgttgttactaaagacggttatatcagtggaggtttaaatattactggtgtaaatacagagttattaacgaagtttgagcaaaatgatttattagaagaatattcatcttttatttcaaacattctttacgacgaaccaatgataaaaacaattacagaaccagtaaatatacaaaattatataaaacacctttacagacaagtattacttgatatgaagaataataataataaaccaacaagacgtggccaattaatagctggtcgtatattgtttcttcaagaaaagctagcaaaaggcgaaatgagtacaaagaaacattatattttcttttcggaaaagataacagaaaatactgtagcacaattagatcatgcagtgaatagactacatgaaaagataaaccttaataaagaggcattacaacaagcattttcacattatggtttagaaactagacctatatatcaaacagaatacttaaaccagttttatgctttatatgattataaaggttataacgactatcatcttagtaattag

SEQ ID NO: 3728 - DNA, 147 bp, Staphylococcus epidermidis
aataattcaaacaccaatgacattaaattcattggtgttttttactgtacgctaacaatactacttaaaggtatttttagtttattgtttgaattggaattagtgataatcataaatccattaaattcatctattttgttaatgtaa

SEQ ID NO: 3729 - DNA, 171 bp, Staphylococcus epidermidis
gtattccaaaatgctgatatttcattctgggtgtttaaatatttctttgtcaaaacttttcagcctcctagagtatcacttatttcgttatttttactattagtcttggtgaattttcatgaaattcatttcctttcatgtctccatagaaagatatattggataaagtaa

SEQ ID NO: 3730 - DNA, 489 bp, Staphylococcus epidermidis
aaaatgaaaaaattattaactatagttattttattcactttggttctggctggttgtggccaaaatcaaagtgagaaaaatagtgaaaaacataatgaagaaaaaacagtagatactacagaagaaagaaacgatatgataaaaggtctaattgaatatggttatgaaaatgatgattataaaggttataagcatatgaaagatatattatctgaaaagttgcaaaagcaagcagaattgcaaaatcaatcagcacaaactaaaggtgtaaaaaaagaaactaaagacattaaactttatcaagacgtagataatgatgatgaattgatttattctattaaactttcaattacaaacaaaaaagagaaaaactctgactactcaatgagatatgggaaaattgaattaacggaagaagaaggtaaacaaaagatagataatgtcgaagaactaacacaaagaaatttagtaagtatgaatcaagaatag

SEQ ID NO: 3731 - DNA, 423 bp, Staphylococcus epidermidis
aaaggagtgaattatatgtctgttgagcaagaagttaaagatataatgctcgatatgttgggcgaagaaaagaaagttaaagagaatataatacctcgtaatgtagacgctagttataaaatattcttaaatttaaacggtaaagaattagcaattgtatttgttccttttttactatttctaacaatagcatttggtgtaacgtttttaatgggcttacttaatttaataactggctttatggtttttatagtaggtttgatttttggtttaacaatatatggcttactaacaattagaccaattagtacaaaagaaaatataagaatgattgataccataaaacaatcacaacgatttagcagaaggcagaaagtttacttctataaaagtaaagaaggattgggtgatgatgatgtttaa

SEQ ID NO: 3732 - DNA, 225 bp, Staphylococcus epidermidis
aattacacgaaagcacaaaaaggaggttatattactatgaataataatgaagaaaattcagtcttttttggtaaaaagaaaaaagtatcactacatttgttagttgatcccgatatgaaagatgagattatcaaatacgcacaagaaaaagatttcgataacgtttcacaagctggtagagaaatcttaaaaaaaggattagaacaaattaaaagtaataaataa

SEQ ID NO: 3733 - DNA, 138 bp, Staphylococcus epidermidis
gcccagcagaagatagtggcaacgataaatctatctctgatgatgacttaccattttaaaactataaaaggacgtgtgaaaacacgttcttttttaaaaaataggagtgatttagatgaaagtaacaaatacaattag

SEQ ID NO: 3734 - DNA, 264 bp, Staphylococcus epidermidis
atcatgaatgaataccgtatacaaaaactatatagatacatttgtttagaatttaaaaaccagcgtcaactcataggcaagcgacaagaagaagttgcatttgatttgagtgtgactgctggtcatctttcacgtatcgagaatggtaaaaaacctagaatagcattacatacatttttagtaatgtctgaatactatggtgtagactttcataaggtagttaaaaatgcagaagaaaaaatggaattggatgaaggaatatag

SEQ ID NO: 3735 - DNA, 336 bp, Staphylococcus epidermidis
ataattatggataagaaagaaactaaacatcttctgaaaataaaaaaagaagattaccctcaaatcttcgattttttagaaaatgttcctagaggtactaaaacagcccacataagagaggcattgaggcgctatattgaagaaataggggaaaaccctccaataccttcaaaagaacacacagcgcccttaaaagagcatacagaacctattaaacgtaataaagaaagttttaaagacgcaatggaacgtaaggatcaattaaaacaagctgaaatgcctaaaatagaagaaaaagatgaagaaatggtagatattagtattgatgacctttaa

SEQ ID NO: 3736 - DNA, 786 bp, Staphylococcus epidermidis
ataacaatggaagttgttcgtttaaatcaaaacctatttaataaactacgaggaaacgaaatatcaagcaataaaaatggttcaagaccatattattattctttcaaacgtaataataatagagtttgtataccttttagaacaaatgcacaaaaggtacctaataaatataaaattaatttaggaggcgaacagcccgataaacctaattcagctattgatttaacaaagtctatagtaattagtaatgatgaatatcttaataacaggtcaaaagctaaaataccacaaaatgttaataattttttaaagcaacaagcaccagctattgaacaaaaatacgatactatgtctaatgattacataaaagcaaaagctagtttaagtaagatacctttagttaaatattcaactatgcaatacttccacaaagaattgaatattcaagatagtattgataatcaacaaactaaaaatgctattaatgaattaatatctaatgggaaatcaaataaatataataaattacaatcttctctgcctaatgaaaaattaaatttgctagatgattatgaaactctatatgagtttaaaagcctaacagactacccagctaaaataaattctaatgatattgataatcctttcttagaagttgagaaaaataacaaacattttactttgtctgcactaactattaaaaatgaaccagaaaagcatgtaaaagactttttaaattatgatatagagaatgaaaagaataaagatattgatttagatttataa

SEQ ID NO: 3737 - DNA, 129 bp, Staphylococcus epidermidis
aatcggcgttgtggcgcagatataaaaattaatactgcacggaaagaaacaactatagagatcaaaacacattatattgttttaaggaggcgtatattacgcctcttttttattaaatttatggagtga

SEQ ID NO: 3738 - DNA, 432 bp, Staphylococcus epidermidis
ttagaaaaatgttatctaaataaagaaaggaagatatttatgataaacaaagtaatatatagtggacgtatcgcaactgatttaaaattaagaaaaagtaaaaatgaaaagtcttatgttttctttaacatagctgtacctaggcagtttgataatgatagaacagattttattaattgtgttgtatggggaaaacaagcagaaagtttagttgattatcaaagtaaaggtaatctaattattattgaaggttcaactgaaacatataaaaaagacaatattaatatgtctagatgtttggttgaaaagactatctttttagaaagcaaaaaagaaaacaaaaaacatgacgtgtcagaagatgacgctataagcccagcagaagatagtggcaacgataaatctatctctgatgatgacttaccattttaa

SEQ ID NO: 3739 - DNA, 1083 bp, Staphylococcus epidermidis
agtatcatgtggagtgctattgctaaaggaataacaatgctgatgaagaaaaaagcattatccaaaatattaaaaccagtaatagctatagtaataggctttttccttcttatttttataatgattgcttatctagtaggatctttcactaaagaaattaatgagagtggcgaacaaaaaatgaaagaggctgaatcaacagcaacaggtgcgtgtactggtggaagtgttgacggttcgggtatctctgcttttgaaaaaaacgccaaaggtggcgcattagaaggtaaaggtaaggatatggttaaaattgctaaaaaaaataaaataccaccaaaattatttatagcaattgtagcttctgagtcagaatggggaagaggggcaaatgcaacaaaacaaaaaaaccccctatctataatgggggctggccctctacaagtttacccttcaattgaagaaggacttgataaaggtgcaaaaaatttatatgacttatacatttctgaaggtttgacaactcccgagaaaatcgggccaaaatacgcaccagtaggcgctagtaatgacccagatgacttaaatagtaactgggtacctacagttaagaaaatcatgaagtcattcggtggcaaagaggctaaatgttctactgaaagcagtggtggaggttcagacggaaaaggatttgattttaaaggagaattccctaaacctgacaaatcgaaatataacggtcaatcttatccatggggacagtgtacttggtatgtacatcaacgtagaaaagaaattggcaaaccagtacctttaacttggggtaatggtggggactggggcgataatgcaaaagcgcaaggctgggaagtaggtagtaagccgaaagctggcgctggcgcctctgtaaaacccggtaactttggcgcaccaccaccgtatggacacatcatgtttgtcgaaaaagttaaaaaagacggtggaattgtagttagtgaggccaatgtaaaaggcctaggagttataagttcaagagaattttcaaaagcagaaacacaacgtatgcaatttatttatgataagtag

SEQ ID NO: 3740 - DNA, 1113 bp, Staphylococcus epidermidis
ctttgcaacagaaccagatatattaaattgatttttgaatttttgaaaaaagaaagaaatgctaatgcagttattttagaccctcataaaaataatccaagagcaataagggcataccaaaaatctggttttagaattattgaagatttgccagaacatgaattacacgagggcaaaaaagaagattgttatttaatggaatatagatatgatgataatgccacaaatgttaaggcaatgaaatatttaattgagcattactttgataatttcaaagtagatagtattgaaataatcggtagtggttatgatagtgtggcatatttagttaataatgaatacatttttaaaacaaaatttagtactaataagaaaaaaggttatgcaaaagaaaaagcaatatataattttttaaatacaaatttagaaactaatgtaaaaattcctaatattgaatattcgtatattagtgatgaattatctatactaggttataaagaaattaaaggaacttttttaacaccagaaatttattctactatgtcagaagaagaacaaaatttgttaaaacgagatattgccagttttttaagacaaatgcacggtttagattatacagatattagtgaatgtactattgataataaacaaaatgtattagaagagtatatattgttgcgtgaaactatttataatgatttaactgatatagaaaaagattatatagaaagttttatggaaagactaaatgcaacaacagtttttgagggtaaaaagtgtttatgccataatgattttagttgtaatcatctattgttagatggcaataatagattaactggaataattgattttggagattctggaattatagatgaatattgtgattttatatacttacttgaagatagtgaagaagaaataggaacaaattttggagaagatatattaagaatgtatggaaatatagatattgagaaagcaaaagaatatcaagatatagttgaagaatattatcctattgaaactattgtttatggaattaaaaatattaaacaggaatttatcgaaaatggtagaaaagaaatttataaaaggacttataaagattga

SEQ ID NO: 3741 - DNA, 390 bp, Staphylococcus epidermidis
ctttgcaacagaacccctaaaaaaaattcaaaatctttcagagaagctgttaaaggaatttttaagttcacagatattaacttagcgcgtgaggctaaaaatcgattgattcatgattatatcgatcaaccaaaatattcaaaagcttgcgcatcattggatgatggattcgaagacgcctttcaatataccgtacaaggaaattcccacaatcgactaaagagtaccaatctaattgaacgactgaatcaagaagtacgcagaagagaaaagattattcgcatcttccccaatcaaacatcagccaatcgcttaattggagccgttcttatggacctacatgatgaatggatttattcttcaagaaaatacatcaattttgataagtag

SEQ ID NO: 3742 - DNA, 2037 bp, Staphylococcus epidermidis
ttagaacgaagggagtttatgattatggcatttttaaaaaagaaaagtcaagagcaagttacaaataaaattcacaatgaatcttttcaaaaattaacagaagtattagatacagattctgttgatagtatttatccttttagttggatagagaaaaaatcgcatatagaaacaggcgaaaattatattaaaaatttattagtagttgactaccctcaatcagtaaaaggggcgtacttatcaaatttattaaagaaaaacggtaatattcaaataactaaatttattagaccagcaaatatagaaagaatgattgaccatttaaacaactcaatcaaaaacaaaacagcagaacaaatgcgtactacagaccctaaacgaaatgcaacaattaaaagagaaattgaaagtagtaaaaaacaacttgataaatttttagatgaaaaaacaggatttatgtacatgtatatgtatatcacgttaaatggcgattcatacgaaaagatacaagcgctagaaaaagatgttaagcgtactttaacgagattaagacttaaaacacatacacctacaaacgcaatgcgagaatcatttcatacagttcttcctttaaatagaaacttcttatcagcatttacacaacaaaatatggatacagcaacagcagggcatttctttatgtttgatgattcagaaattattgatttaacacctaatacatcagtttttggaattaacaaaaatacagattcattagtagcagttgattttaataacaaagaaaaaactttaaataaaaatatgactattatcggtacaagtggtgtaggtaaatctaccctcaatatgagaatgattttagacaatatcaaaaaatctataagacaatttatcattgatcccgaagatgaattttcatatataactaaatattacggtggaacagttgtaaatatttcaacaagttcaaatatcaaaattaatccatttgaaattttttcagaagaagtatttgaaaaagaagatgaaacagacaatgaaacaacatcagatgttttaacggaaaacaacgaacacgaaagccaaattgacacattagttcgttctaaaatagggaagttaaaaaccttctttagagttcttaaagatgaaatatctcaaacagaaatatctgtattatcttcaactttaagacagttatatcaagataaaggatttaaaggtaatgcgaaattatcagatttcaaaagcgaagattatccaactttaacagaattatataacaaactaaaagacttagacccagaaaaatatgaggtattaaaggacttaacacttatcatagaagattacacaatggaacatggtactactacaatctttgacggttatacaaacatcaaattagataatgaaattgttacttttaaccttaaaccattacaaacagaaaaagatgttcaaagtgcagcgtatttgaatatattcagtttcttatgggacgaaataacaaaagatagaacaacagaaacagtattaatgactgacgaattacatttcttagcaacaaatgaatatagcttagatttttattatcaagcatacaagcgtattagaaaatatggcggtggcgctattgcctctactcaacaaattaaagatattcttagaacatcacaagaaataggttcagctattattgaaaatagtcatactaaattcttctttggaatggataacgtaggcgttgatgatgttgttgataaattaggattgaaatttagcgatcaagaaatatctcatttaactaaaaagaaaaaaggcgaggcattattactatacggaacacaaagagcatttataagaattgatttagatagagaagaaacaagactttggaataaagaattatatgaaacaatttatgaagaaccagcagacgtagagccgaattatgttgaacaactaggattaacagatattgatttagcagagttggaagaagaattaagacaagcagaaatgatttatgaatag

SEQ ID NO: 3743 - DNA, 207 bp, Staphylococcus epidermidis
aaatgtaggaggtacaatatgctaaaaacatatactgaaatcattggaagtgaattgccaatttatataacaaaatcagaaacaagcgaattactattttcagaagaattagataaaaatttaaaatatgaagttgctggatattatctatataatgctaaaaaagacttatacaaagaactttataaacctattagcgaggtgtag

SEQ ID NO: 3744 - DNA, 1062 bp, Staphylococcus epidermidis
ataatatgtggaggttttattatgagtaacgtatatgtaatggctttagattttggtaatggatttgtaaaagggaagattaatgatgaaaaatttgtaatcccttcaagaatcggaagaaaaactaatgaaaacaatcaattaaaaggatttgttgataataaattagatgtatcagaatttattatcaatgggaacaatgatgaagtattactatttggtaatgatttagataaaactacaaatactggtaaagatactgcctcaacaaatgatagatatgatattaaatctttcaaagatttggttgaatgttctataggattattagcaagagaagtaccagaagaagttgtcaacgttgtaattgctactggtatgccaagtaatgaaataggaactgataaacaagctaagtttgaaaaacttttaaataaaagtcgtttaattgaaattgacggtatcgctaaaacaattaatgttaaaggcgttaagatagtagctcaacctatgggaactttacttgatcttaatatggaaaatggaaaagtattcaaagcatttacagaaggcaagtacagtgttcttgactttggtagtggtactacaattattgatacttatcaaaatatgaaacgtgtagaggaagaaagttttgttataaacaaaggtactattgatttttataaacgaattgctagtcacgtatctaaaaaatcagaaggtgcctcaatcacaccacgtatgattgaaaaaggattagaatacaagcaatgtaaacttaatcaaaaaacagttattgactttaaagatgaattttataaggaacaggatagtttgatagaagaagttatgagtaactttgaaatcactgtaggtaatataaattcaattgacagaattattgttactggtggtggtgcaaacattcattttgattcattaagtcattattattcagatgtgttcgagaaagcagatgatagccagtttagtaatgttcgtggatatgaaaaattgggggaattgttaaaaaacaaagtagagcaagaaagtaaataa

SEQ ID NO: 3745 - DNA, 132 bp, Staphylococcus epidermidis
ataatatgtggaggttttattatgagtaacgtatatgtaatggctttagattttggtaatggatttgtaaaagggaagattaacgatgaacaatttgttatcccttgccagaagtactcacatgcggggaag

SEQ ID NO: 3746 - DNA, 774 bp, Staphylococcus epidermidis
aagtatacaggaatggagagagcaataatgaatcggctaaatacaaattactttgataacttttatattgattggcagaacaatgaaatatcagaaaattatgttgaattttgtcaaaagcaaattaataacttaagtcacattgttccttcattaaaaaaagagaaaagaaaaatcatcgatacttgttgtggctgtggttttcattctaaatttttgatagataaaggtcatcatgttattagctttgacaaatctgaggaaatgttgaactttgcatataaaaaaaatggcattttaggtaaaagacaatctttagatgaagaattcccagaaaatcacgtcgacttaattcttaatttaaatacttctatcggatataaaaaaaatgatttaaaaaatttgttaagaaatagttatacctccttaaaaaaaggtggtattttaattatagatttgatgaaccccgcctttttctataaaaattttgaagaacaaatgattttcaacttcaaagattacgaagttaatcaaactattaaaataaataaaatttataatagtatagtttcaacatgggatgtttataaaaataacgaatatagcaaagacctttcaagagaattaaaatttaaattatatactactaatgatataatttgcagtagtttgtattataactttactttatccaatatatctttctatggagacatgaaaggaaatgaatttcatgaaaattcaccaagactaatagtaaaaataacgaaataa

SEQ ID NO: 3747 - DNA, 630 bp, Staphylococcus epidermidis
tataggaggggttttttggggaatttagattttgatcacgaaggatacagaaaactattaccattaaaagatttcaaacattttataaaacatagcgacagcaagactagaaatcattttattggtatggcttttaataataaaacagatgtgtttagtcgtaacttctctaataaaatgataaacatattccctaaaaatgaattttatattcatatacaacaatttccagagaatgatagcccttcttatatggtatacaacactgatattacagcatttattcagtttaggttagttgggcgatcagaaaataagtatttagaaaacattatcagagattatggcgtattaatagaagttgaggccttacattcatttaaaaaaggtatgggggcaatgcttgtaagtcaattggaaaagttatcagataaactgtttatacctatatatctttatgatactaatttaaaagatgaattatattatcaagacttaggattctttgatactactaaaaaagggaatcatggagaaccacttttagtatataaacctaaaaatctagaaactaataaaaaagaaaagcctattaaatctttattcaagaaagtattcaatatcaattag

SEQ ID NO: 3748 - DNA, 2010 bp, Staphylococcus epidermidis
ggagattttattatggcaatgtaccattttcaaaataagtttgtatcaaaagcaaatggacaaagtgcaactgcaaaaagtgcctataatagcgctagtaggattaaagattttaaggaaaacgaatttaaagattactcaaataagcaatgtgattatagtgaaattttattacctaataatgctgatgataagtttaaagatagagaatatttgtggaataaagttcatgatgttgagaacagaaaaaatagtcaagttgcacgagaaattataattggtttgccgaatgaatttgatccaaatagtaatattgaattagcaaaagaatttgctgaatccttatctaatgaaggaatgattgttgatctaaatattcataaaataaatgaagaaaatcctcacgcacatttattatgtacattacgtggtttagataaaaataatgaatttgaacctaagcgaaagggcaatgattatattagagattggaatacaaaagaaaaacataatgaatggcgaaaacggtgggaaaatgttcaaaataaacacctagaaaagaatggtttttctgttagagtttctgctgattcatataaaaatcaaaatatagatttagagccaacaaaaaaagaaggttggaaagcacgaaaatttgaagatgaaacaggaaaaaaatcttcaatatcgaaacataatgaaagtattaaaaagagaaatcagcaaaaaattgataagatgtttaatgaagtagatgatatgaaatctcacaaattaaatgcttttagttatatgaataaatcagattctactacattaaaaaatatggccaaagatttaaaaatttatgtaacacctataaatatgtataaggaaaatgaaagactatatgatttaaaacaaaaaacttcattaatcactgatgatgaagatagattaaataaaattgaggatatagaggatagacagaaaaaacttgaatctataaatgaggtatttgaaaaacaagctggaattttctttgataaaaattatcccgatcaatcattaaactatagtgatgatgaaaaaatctttatcacacgcactatattaaatgatagagatgttttaccagctaataatgaactagaggatatagttaaagagaaacgcataaaagaggctcaaataagccttaatacagttttaggtaacagagatataagtttagaatctattgaaaaagaatcgaatttctttgccgataaactttcaaatattctcgaaaaaaataacttgtcttttgatgatgtgttagagaataaacatgaaggtatggaagatagtttgaaaatagattattatactaacaaattagaagtttttagaaatgctgaaaatatactagaagattattatgatgtacaaataaaggaattatttacagatgatgaagattataaagcttttaatgaagtaactgacattaaagaaaaacaacaattaattgattttaaaacttatcatggtacagaaaacacaattgaaatgttagaaacaggtaattttattcctaaatacagtgatgaagatagaaaatatataactgaacaagttaagttgttacaagaaaaagaatttaaacctaataaaaatcagcatgataaatttgtatttggggctattcaaaagaaattattgagtgaatatgactttgattatagtgataacaatgatttaaaacatttatatcaagaatccaatgaagtaggggacgaaataagcaaagataacattgaagagttttatgaaggtaatgatattctagtagataaagaaacttacaataattacaatagaaaacaacaagcctatggtttaataaatgctggactagattcaatgatatttaattttaatgagatatttagagaacgtatgccgaagtatataaatcatcagtacaaaggtaagaatcacagtaaacagcgccatgagttgaaaaataaaagaggtatgcacttataa

SEQ ID NO: 3749 - DNA, 123 bp, Staphylococcus epidermidis
accagttttatgctttatatgattataaaggttataacgactatcatcttagtaattagaacgaagggagtttatgattatggcatttttaaaaaagaaaagtcaagagcaagttacaaataa

SEQ ID NO: 3750 - DNA, 126 bp, Staphylococcus epidermidis
attttcttcattattattcatagtaatataacctcctttttgtgctttcgtgtaattctatttaattacacaataccacatttacacatgacatgtcatgacaaaaaagttaaaaaagttttataa

SEQ ID NO: 3751 - DNA, 168 bp, Staphylococcus epidermidis
atatcagccataaataaaacctccatattttttattaatttaattataaccttttcgtttgacagattcaagttttaccgttataatctagttaaatcccgtaagggcgcacttatgcgaacgttccgttcgcgtgctaaattcgtgaaattaaaaattaatttttaa

SEQ ID NO: 3752 - DNA, 975 bp, Staphylococcus epidermidis
ttggataacataacatttcgtaaacgtattgaagaatatcgaaagcgatctattgagcaaaagaaatatgagagcaaactaaattatcaatcaagatttggtgtgaaagatgatgaagttagtacttttaatatcaaaggcattgctacagataaaaaagaaaataagttagtcatggccgaagatagagaggataaacaaaaagttcttttatacgccaataaagataatgatatgtattatttgaattctggtagcacttataaagaggctgttcaaaacacttttggtaatgaaaccaattacgaaatggtagatgatgaattatttatttataattcaaaaaatcaagcacttacaaactatgaccaacttgatgagtatcacaatcgacaaaagcaattacaatataacaccaaattagaacaggaacgaaagcaaagattgactgatacaaataaagttagtgaaaatgctaaagaagatttagcgttaagtttaggacttacagcaacagcattgaaaggtaacataaacatttctaatgttgaaaaagtcactgataatgaaagtatggttactatagaaaatgaaattaatggtaagtcagaacatttaatttcagactttaaagatagtttcattgaaaaggctaaagaaaagctaactgtttccccttcaatgaggttaggatttgaagaatttaaaaacgcctcgggacaaatagcaatgggatttacagagttttttggcgctaggtatgacgaaagcactttagaaaacgaccctaaagttgtggcaacagaaaaagggtactctgtttctgtttttgataaagacggaaacaaaaaagatttaacatcagctgacacttttgaggaggcagtaaaattatccaaagaaatgaaacatgataactcgctttctcgtagtgaaatagaattaaatcaagaattagaaaagaaaaaaatataa

SEQ ID NO: 3753 - DNA, 141 bp, Staphylococcus epidermidis
aaagaaggcatatacgccttctttttttatacaatactatttataagtgcatacctcttttatttttcaactcatggcgctgtttactgtgattcttacctttgtactgatgatttatatacttcggcatacgttctctaa

SEQ ID NO: 3754 - DNA, 1134 bp, Staphylococcus epidermidis
tacagcataatgactacaatagtattgctaaaaagttatctaataaagaagaaactttatctgaaaatgatgctaaaaactttgtgttatttgttaaaagtaaagaaaatcaagaacaatacaatgagcaaatacaaaaaaattaaaagtaatattgataaaaataaagacaataataccgtgtatggctctataacagatcaatacggaaataacctaataactattaagaaaaacggaaagactttcttttttatagataaattagaattcaaacctaaacttaccagcgtttatgtgaaagaatttaataacactggaatttacaaatatcagcaagaaaatgctaaaaaggtaatagcagaaagcaatcaaacaacagaattaggcaagttctttattggtaaatatagtattaaaacagataaaacaattgaagattcaattcacaatgggactttgacaggaaaaatagatatagatttaagcaatagaggaaacaataataagatatatgcagatgaagattttaaccaaagctggtttaaggttaagctaaacaatgatagtttattagaaaaaaatagttacaaacttttaattgatgataaagatgttgattataattccaaaaagacatatggaaagtattacaatccaactgaattaagtgtatatgcgattggaaaattagagggtaaagagtttaaaactaacagaataaatataagacgtaattatgataataaacctcaaaatttaaaattaagttttaaggaatctcaaataagagattatgagagtaaaagtaaaaaggttaaagaaaaagctaaaagctatattaaagaatatacgaaagagttaaacaaagcatataaaaagaaagattataaatatatatctgactacgttaaaaataactctcaattagaaaaacaactaaaaaaacaggttaagtctaaatcaaaagttaaatttaaagatgttaagataaacaacgttaaacgtgataaaaacaaaatatatattgagttaagtaaaaccaacaatggtaatgtgtttcaaacgaaatataccttagattacgataatgtatcaaatgaatttctagtagaagattcacatgataattaa

SEQ ID NO: 3755 - DNA, 2118 bp, Staphylococcus epidermidis
aaagaggtaatacttatgaacactttaattctatgtgaaaaaccttcacaagcaatggacttaagcactgtttttgcaaaaaagaaaaagcaaaatggatatatggaaatttcagatgaacaattaaatgtaagtggctttttaacttgggcagttggtcatttagtcgaattgaaggaaccacaagaatatgacgaaaaatataaaaattttagcacatatcctatattgttagaaaaagacgattttcaatttaaagtatctgacaaaacgaaagatcaatttaacaacattaaaaaaatatttaaagaaaacaagattgatgaagttattattgctactgacccagctagagaaggcgaaaatatagcatataaaattttaaatcaattgaaagtaacagataaagttactataaaaagattgtggcttacttctaaagtagaaagcagtataagaaaggcttttaaaaatatattacctaaagaaaaaacttatggattttacaaagagggcagggctagagaattaagtgattggttagtaggaattaacttatcacgtcatttcactaaaatttcacgagaattaggaaatgacggtgttattcatatcggtagagtatctagtcctacattaaacatggtttacaacagagagaataacattaaaggttttaaaggtaaaaagttttataaagtttcagcgactattaacaaagatgaacaagaagtgaaaacagagttaaaaaacaaatttgacagtgaagatgaattgcacgaatttttgtttgaaaatgatattacagatttaacacaaaaagggttagttactgatattgaaaaagaaataggctatacaatgccacctaaattttatgacttatcagctttacaagaagatatgaatgataaatataaaataagtgcgaaacgaacattagaaatcgcacagacattatatgagaagaaattaatcacatatccaagaactgattcaagatatatcacagaagatgaaaaagaaatgttattagaaaatatagactatttaaaagaaataacaaagattaatttgaataatgaattaactaataacagcttgattaatccttctaaaatagaagatcattacgcaatattaataactggaaatgattttaacaaagtagatttaaaagaagaagaaatcaatgtttataaaagtatattacaaaatgtggccatgaattttatggataaagaacaatatgaaacgactactatagaaatcgctgttaaaaagcttatgtttgaagtgaaaggtaaaattattcaagataacggatttaaagctttgttaaataaacaaaaaacttccgaagaaacaattcctaattttgaaaaaaatgaagaagtagacattgaattagatttgttagaaaaagaaacgacacctccaaaaagatatacagaaaaaacattgttaaaagcaatggccaatcctatagaaacactagaagatgaaggcttaaagtctacacttaaagaagttaaaggtttaggcacaccagcaactagagccgatattatagaaaacttgaagaaaaataaatatattcaagtacaaaaaaacaaaatttatattactaaaaatggtatattagcttgtttattattggaaggacatttactttcaaaaccagacttaacaggacaatgggaaaaatatttgaatggtattagtaaaggcgaaaaagatgatgattcatttataaataccattaatgaaatgattaaaaaaacaattaatgaagaagttaaaaataaagaaagtatacaaaaagtggccaaagagaaagtatcgactaacaatatagcaaaatgccctgcttgcgataatggctatttaatagatagaaaaggtttttatggttgtacagagtacaataacggttgtgaatttactattcctaaaaaattgttagaaaaaagtatacctccaactgtagtaaaagcattatgtgaaagtaagacaacaaaaaaattgaaaggctttaaatcaaaaaaaagtggaaagtcatttgattgtaagttgatattaacaaaagaaaacaaacttcaattttcattcgattaa

SEQ ID NO: 3756 - DNA, 324 bp, Staphylococcus epidermidis
ttaattatgattaaaaaattcagtttaacaactgtttatgtagcatttttaagcattgttttatcaaatataacacttggcgcagaaaatccagggccgaaaattgaacaaggtttacaacaagtacaaacattcttaacaggcctaattgttgctgttggtatctgtgctggtgtttggatagttcttaaaaaattacctggaattgatgatccaatggtaaaaaatgaaatgtttagaggcgttggaatggtattagctggtgtggctgttggggcagcacttgtttggttggttccatgggtatacaaccttttccaataa

SEQ ID NO: 3757 - DNA, 918 bp, Staphylococcus epidermidis
atggattggattaaagacgctattaaagaactgaccgaaggtattgcagacggtatgatgaattttatatttcagtttctttatacgttattttacgaacctttaaaattctttatatggttgttagataaaatacttattgatcctaatagtatttcaagtgattacatttcaaacgcctctgtattagttaatagcttaatcacttcaatagcaatatgtgtgtttgcttttaaaatggttcaagttatgaaacaaaatgcagaaggtaatgctgaaagtccaggctattatgtagcacaattattaccaagttctttattggtagcagttttaccatggctagttgatataatgactaaattatcttattcagcgactagggcatttttagatgtaggtcaaaaaagttatttagaaactattaaagaatggagttctttaaaaaaaggtcaagacggatttaaagaaatgctaggttctatggggactatggcaggtagtcaaattatgtttattctatttattctattgattttagtatttactgtagtatttattttccaatttgttagtaggatagctgatttagtaataatgaaagttgttgccccgttagtagcagtttctttattagcagatgaaaataattatataggtgtatggtggcgtgaattattagcaattagtattcaattaccattacaagtgtttactttctttggaggaataaatttattctttggtgcaaagctagacgtaggcacattattattaggtataggattctttattattacagttaaatcgccttcctttattagatcaatggtttactctactggaagtgggcgcatggcaactggaatggctggaagtggtgcaaaacttctagttagaaaaatgttatctaaataa

SEQ ID NO: 3758 - DNA, 693 bp, Staphylococcus epidermidis
caaaaaggagtcttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgccccaattttatatcaaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggttaaagtaattaaagcttttaaacttaaacctgactgccattgtacatcgaaatatctgaataacctcattgagcaagatcaccgtcatattaaagtaagaaagacaaggtatcaaagtatcaatacagcaaagaatactttaaaaggtattgagtgtatttacgctctatataaaaagaaccgcaggtctcttcagatctacggattttcgccatgccacgaaattagcatcatgctagcaagttaa

SEQ ID NO: 3759 - DNA, 693 bp, Staphylococcus epidermidis
caaaaaggagtcttctgtatgaactatttcagatataaacaatttaacaaagatgttatcactgtagccgttggctactatctaagatatgcattgagttatcgtgatatatctgaaatattaagggaacgtggtgtaaacgttcatcattcaacagtctaccgttgggttcaagaatatgccccaattttgtatcaaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaagtagcaatagctaaagtaattaaagcttttaaacttaaacctgactgtcattgtacatcgaaatatctgaataacctcattgagcaagatcaccgtcatattaaagtaagaaagacaagatatcaaagtatcaatacggcaaaaaatacactcaaaggcattgaatgtatttacgctctatataaaaagaaccgcagatctcttcagatctacggattttcgccatgccacgaaattagggatatgttagccagttaa

SEQ ID NO: 3760 - DNA, 693 bp, Staphylococcus epidermidis
caaaaaggagtcttctgtatgaactatttcagatataaacaatttaacaaggatgttatcactgtagcggttggctactatctaagatatgcattgagttatcgtgatatatctgaaatattaagggaacgtggtgtaaacgttcatcattcaacggtctaccgttgggttcaagaatatgctcccgttttgtatcaaatttggaagaaaaaacataaaaaagcgtattataagtggcgtgttgatgagacatatatcaaaattaaaggacagtggtgttatctgtatcgcgcgattgatgcagatggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaaccggactgtcattgtacatcgaaatatctgaataacctcattgagcaagatcaccgtcatattaaagtaagaaagacaaggtatcaaagtatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 3761 - DNA, 660 bp, Staphylococcus epidermidis
caaaaaggagtcttctgtatgaactatttcagatataaacaatttaacaaagatgttatcactgtagccgttggctactatctaagatatgcattgagttatcgtgatatatctgaaatattaagggaacgtggtgtaaacgttcatcattcaacagtctaccgttgggttcaagaatatgccccaattttgtatcaaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaagtagcaatagctaaagtaattaaagcttttaaacttaaacctgactgtcattgtacatcgaaatatctgaataacctcattgagcaagatcaccgtcatattaaagtaagaaagacaagatatcaaagtatcaatacggcaaaaaatacactcaaaggcattgaatgtatttacgctctatataaaaagaaccgcagatctcttcaggttctgttgcaaagttga

SEQ ID NO: 3762 - DNA, 693 bp, Staphylococcus epidermidis; identical to SEQ ID NO: 3759

SEQ ID NO: 3763 - DNA, 684 bp, Staphylococcus epidermidis
caaaaaggagtatgctatatgaactatttcagatataaacaatttaacaaggacgtcatcactgtagccgttggctactatctaagatatgcgcttagttatcgtgatatatctgaaatactaagagaacgtggtgtcaacgttcatcattcaacggtctaccgttgggttcaagaatatgctcccgttttgtatcaaatttggaagaaaaaacataaaaaagcgtattataagtggcgtgttgatgagacatatatcaaaattaaaggacagtggtgttatctgtatcgcgcgattgatgcagatggacatacattagatatttggttacgcaaaaaacgagatcatcaatcagcatatgcgtttattaagcgccttattaaacaattcggtaaacctcaaatgataattacagatcaagcaccttcaacgaaggtagccatggctaaaataattaaagtgtttaagttgaaacctaactgtcattgcacatctaaatatctcaataacttcattgaacaagatcatcgtcacattaaggtgagaaagacaagatatcaaagtgtcaatacggcaaaaaatacactcaaaggcattgaatgtatttacggattatataaaaaaaccgtaggtctcttcagatctacggattttcaccatgccacgaaattagttatatgttag

SEQ ID NO: 3764 - DNA, 1011 bp, Staphylococcus epidermidis
ataacgatattacttaaactccttaaatatacatttaaaggagtttttatcatgtctaaacaattttttacagtagaagaaaattataaagaacgcttttaccaattacctaaagtattttttactaatcctaattataaagatttatcgaatgacgctaaaattgcttacgcaatattgagagatcgtttacaattatctattaaaaataactggatagatacagaaggtaacatatatttcatttatacagttgctgatttagaagtgatattaaattgtgggaacaaaaaaatcactaaaattaaaaaagaattagaaaatgtagatttactaatccaaaaaaggcagggtttaaacaaaccaaatctactttatttattaaaaccagccataactaaaaatgatatttatgaaatagataaggctgaaaatgaagttgaggccttacaagacaaggaagtgtcaaaaggacacgtccagaaatgtcaaaaggacacgtctagaaatgtcaaaaggacacgtctagaaatgtcaaaaggacacacaaatgatactgattttattgatactgattttattgatactgaaagtaatgatatgaataatatgaatgatacaaatcaacattcaaatcattcaaatcacttttcaaatattcatgataaagaatctcttaaatatatagaacttcaagaactccccgaattaattaaaagttatattaataatttcagctatgaagaagttaaaagtattaaatctgttattttaaaagctaaaaaatcatttaataacaaatacgatactttctatatgttagaagatatagatgaagaattactattggttttaaaacgatttaaaggttatcttgttaaaaaacaagaaaaagtagctaatatggaaggttatttaatgagaagtatcattgctgaacttgaagaaatgcactcaactattatgagaagaaaaaatatggaaaacaatccattatctctatttaattag

SEQ ID NO: 3765 - DNA, 144 bp, Staphylococcus epidermidis
gcgtgcaggtttaaagtacataaaaaatataatgaaaaaaagcatcattatactaacgttataccaacattatactctcattatactaattgcttattccaatttcctattggttggaaccaacaggcgttagtgtgttgttga

SEQ ID NO: 3766 - DNA, 144 bp, Staphylococcus epidermidis; identical to SEQ ID NO: 3765

SEQ ID NO: 3767 - DNA, 159 bp, Staphylococcus epidermidis
tatttttgtaatcagcacagttcattatcaaccaaacaaaaaataagtggttataatgaatcgttaataagcaaaattcattataaccaaattaaagagggttataatgaacgagaaaaatataaaacacagtcaaaactttattacttcaaaacataa

SEQ ID NO: 3768 - DNA, 207 bp, Staphylococcus epidermidis
cgtcagatactgcaccccctgaacccccatgctccaacagcaaaaaggaaactttttgctgcttttccgacgcttattcgcttcgctcatatttatatagaaaagaagcgaatgcgcaaaagacataatcgattcacaaaaaataggtacacgaaaaacaagttaagggatgcagtttatgcatcccttaacttacttattaaataa

SEQ ID NO: 3769 - DNA, 123 bp, Staphylococcus epidermidis
ccaaagctttggcgagttggttgggggtttcatgggattaatcccatgaaagtaccaactcaacaacacactaacgcctgttggttccaaccaataggaaattggaataagcaattagtataa

SEQ ID NO: 3770 - DNA, 123 bp, Staphylococcus epidermidis
ccaaagctgtggcgagttggttgggggtttcatgggattaatcccatgaaagtaccaactcaacaacacactaacgcctgttggttccaaccaataggaaattggaataagcaattagtataa

SEQ ID NO: 3771 - DNA, 501 bp, Staphylococcus epidermidis
tttaaaataaggagtgagaaaaagatgaaagaaagatatggaacagtctataaaggctctcagaggctcatagacgaagaaagtggagaagtcatagaggtagacaagttataccgtaaacaaacgtctggtaacttcgtaaaggcatatatagtgcaattaataagtatgttagatatgattggcggaaaaaaacttaaaatcgttaactatatcctagataatgtccacttaagtaacaatacaatgatagctacaacaagagaaatagcaaaagctacaggaacaagtctacaaacagtaataacaacacttaaaatcttagaagaaggaaatattataaaaagaaaaactggagtattaatgttaaaccctgaactactaatgagaggcgacgaccaaaaacaaaaatacctcttactcgaatttgggaactttgagcaagaggcaaatgaaaaacaagaaaatgcattatctgattattattctttcaaggactag

SEQ ID NO: 3772 - DNA, 771 bp, Staphylococcus epidermidis
gcaaaattcattataaccaaattaaagagggttataatgaacgagaaaaatataaaacacagtcaaaactttattacttcaaaacataatatagataaaataatgacaaatataagattaaatgaacatgataatatctttgaaatcggctcaggaaaaggccattttacccttgaattagtacagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatttggtaatataccttataacataagtacagatataatacgcaaaattgtttttgatagtatagctgatgagatttatttaatcgtggaatacgggtttgctaaaagattattaaatacaaaacgctcattggcattacttttaatggcagaagttgatatttctatattaagtatggttccaagagaatattttcatcctaaacctaaagtgaatagctcacttatcagattaaatagaaaaaaatcaagaatatcacacaaagataaacagaagtataattatttcgttatgaaatgggttaacaaagaatacaagaaaatatttacaaaaaatcaatttaacaattccttaaaacatgcaggaattgacgatttaaacaatattagctttgaacaattcttatctcttttcaatagctataaattatttaataagtaa

SEQ ID NO: 3773 - protein, 44 aa, Staphylococcus epidermidis
INISSSNHSFFELDIKCDSLQSQASHSIGKASVARERFKSAICA

SEQ ID NO: 3774 - protein, 169 aa, Staphylococcus epidermidis
SIISKSDINFYYCINKKIWRSDIMKTFKAVRFQIVNEHGAISEYVIEDGVIINKEGSGTGWLLEIVISNEHYETFKQYKDNKQLLDIRVVITRPANDPALFNATVKSVKNFKYSMSVVLECHIYTLRQEYAESLLEELVDEGLTGEKLKKTFNRMMQSKPKLKDEKIER

SEQ ID NO: 3775 - protein, 44 aa, Staphylococcus epidermidis
DKSSVLKIFPNTLFTDKKKKTANMRATNLNPHLLSSIYEFTPFF

SEQ ID NO: 3776 - protein, 230 aa, Staphylococcus epidermidis
ENKSLLGGFLIMKKTLVASSLAIGLGVVAGNAGHDAHASETTNVDKAELAQKALTNDQSLNESPVQEGAYNINFDYNGNSYHFESDGSTWSWSYESTNNATQPVQPSQSQVATQQQPVQVSAPQNEQTAQPQTKSTSTSQTSSSKASSGSSVNVNSHLQQIAQRESGGDIHAINPSSGAAGKYQFLQSTWDSVAPSQYKGVSPAKAPESVQDRAAVKLYNTGGPGHWVTA

SEQ ID NO: 3777 - protein, 50 aa, Staphylococcus epidermidis
MRLSSHSFLIATLKIFEIVNLKLKCKLLKINDLNKIVTSNYAYQLKFACR

SEQ ID NO: 3778 - protein, 41 aa, Staphylococcus epidermidis
SFMLGFLYCNCIFVKILFKYFINAHAYNLNKHNEPVDKYII

SEQ ID NO: 3779 - protein, 141 aa, Staphylococcus epidermidis
GDFPPNSRDTFLKSFAAFSIIFEPVGPEPVNDIILTFGCSLKGFPTPDPSPLTKLNTPLGTPTLSKISAKIIAANGVSSDGFKTTGLPAANAAANLSEVWFVGKFQGVTSPATPIASLTTKSSPRCSSNWKLSKASLAAVK

SEQ ID NO: 3780 - protein, 99 aa, Staphylococcus epidermidis
GSIPPTPPRKLALTFQRLLPILYKLCRISISGYSKAPRGLSVLSRVTCIFTGTMISPSLSLRQCPNRYAFRAGRNLPDKEFRYLRTVIVTAAVYWGFDS

SEQ ID NO: 3781 - protein, 237 aa, Staphylococcus epidermidis
FYFLRRLIMTFSKELREASRPIIDDIYNDGFIQDLLAGKLSNQAVRQYLRADASYLKEFTNIYAMLIPKMSSMEDVKFLVEQIEFMLEGEVEAHEVLADFINEPYEEIVKEKVWPPSGDHYIKHMYFNAFARENAAFTIAAMAPCPYVYAVIGKRAMEDPKLNKESVTSKWFQFYSTEMDELVDVFDQLMDRLTKHCSETEKKEIKENFLQSTIHERHFFNMAYINEKWEYGGNNNE

SEQ ID NO: 3782 - protein, 45 aa, Staphylococcus epidermidis
HVSPPSYVLIITELSSLVKTTILLKLLVNDDEILIYLKKILKYYI

SEQ ID NO: 3783 - protein, 376 aa, Staphylococcus epidermidis
TITLKKKAKRTVIVMEENEMTKENICIVFGGKSAEHDVSILTAQNVLNAIDKERYQVDIIYITNDGEWKKKDNITQEIKNTDELVINDVETGEISQLLSKGSLGKSYDAVFPLLHGPNGEDGTIQGLFEVLDIPYVGNGVLAASSSMDKLVMKQLFEHRGLPQLPYISFLRSEYEKYENNIIKLVNDKLTYPVFVKPANLGSSVGISKCNNEEELKSGIAEAFQFDRKLVIEQGINAREIEVAVLGNDYPETTWPGEVVKDVAFYDYKSKYKDGKIRLDIPADLDQDVQMTLRNMALEAFKATDCSGLVRADFFVTDDNQIYINETNAMPGFTAYSMYPNLWKNMGLSYPDLIAKLIDLAKERYEDKKKNKYKIDY

SEQ ID NO: 3784 - protein, 223 aa, Staphylococcus epidermidis
RRTFEMSILVIGANGGVGSKLVSQLNEEHVDFTAGVRKEDQVKELENKGIKATLIDVEKNSINDLKNIFTDYDKVIFSVGSGGSTGADKTIIVDLDGAVKTIKASKEAGIKHYVMVSTYDSRREAFDASGDLKPYTIAKHYADDYLRTSDLNYTIVHPGSLTDDAGTGKIEADLYFDKAGSIPREDVATVLKEVVTSDGFNNQEFQILSGNHGVKDALKNYES

SEQ ID NO: 3785 - protein, 80 aa, Staphylococcus epidermidis
NFFFPLKKRVFCSENPSSFKRGCFVKAFAHCGRFPTAASRRSMDRVSVPVGADHPLRSATHRCLGKPLPYQLANAARIHL

SEQ ID NO: 3786 - protein, 404 aa, Staphylococcus epidermidis
YAKFQRELDTMHNKQKILDFIENNKYDYVEISHRIHERPELGNEEIFASRTLIDQLRANRFEIETDIAGHATGFIATYDSDMTGPVIGFLAEYDALPGLGHACGHNIIGTASVLAAVALKEVVDEIGGKVVVLGCPAEEGGENGSAKASYVKAGVIDEIDVALMIHPGNETYRTINTLAVDVLDIKFYGRSAHASENADEALNALDAMISYFNGIAQLRQHIKKGQRVHGVILDGGKAANIIPDFTHARFYTRATSRKELDVLTEKVNQIARGAAIQTGCDFEFGPIQNGVNEFIKAPKLDDLFEKYATELGEEVIDDDFGYGSTDTGNVSHVVPTIHPHIKIGSRNLVGHTHRFREAAASLQGDQALIRGAKILALMGLELIENKPLLDEIIEEHTHIKGHVK

SEQ ID NO: 3787 - protein, 397 aa, Staphylococcus epidermidis
MMTTPFKRIHLIVMDSVGIGEGPDAAAFNDEGSHTLKHTLEGFKQKLPHLEQLGLGNIAPLPVVSKVTHPGAFYTKLSEASVGKDTMTGHWEIMGLNIMQPFKVYPNGFPEELVKEIEDMTGRKVVANRPASGTQIIDEWGEHQMKTGDLIVYTSADPVLQIAAHEDVIPLEELYEICEKVRELTKDPKYLIGRIIARPYVGEPGNFTRTSNRHDYALKPFGRTVMNSLKDSGYDVIAIGKINDIYDGEGVTEAIRTKNNMDGMDQLIEVVKKDFEGISFLNLVDFDALYGHRRDKEGYAQAIKDFDLRLPELMNHLREDDLVIITADHGNDPIAKGTDHTREYIPLLMFSPKIKDYHELSQDTTFSSIGVTIADNFNVELPKYGKSYLKEMGVEHQ

SEQ ID NO: 3788 - protein, 303 aa, Staphylococcus epidermidis
IMWFCFLKSGFIIIKQILSTPFFSYKYNIKILINFKLISNIIEHKMLEYANKITLKGDNIMKFAVITDIHGNFDALQTVLDDIDSRDDIEKIYNLGDNIGIGHETNKVLDTIFDRDDMEMIAGNHDEAIMSLVNGTPYPEDLKGKFYEHHQWIEGHLDESYYDEINQLPRYIEMTIKGKKILFIHYEIENDKMSAPIDEQPFAPITKDDEQAISELFKDKEADLILFGHNHRLHMFDDKSTVYFNPGSVGLNNGSNTVYGIITVNEKGISVERVKLAYNNEEFLAGFEEKQVPAREFIFKNFI

SEQ ID NO: 3789 - protein, 53 aa, Staphylococcus epidermidis
SAPTGTETRSILLREAAVGNLPQWAKALTKQPRLNEEGFSEQKTLFFRGKKKF

SEQ ID NO: 3790 - protein, 342 aa, Staphylococcus epidermidis
MIYTFQLYLNKPFTTPNILVKVEFLMTNHNHQHHHSHAHGHVHTDNKKVLMFSFIIISLFMLVEIIGGFLANSLALLSDGFHMLSDAISLGVALIAFIYAEKHATKSKTYGYKRFEILAALFNGVTLFIISIIIIIEAIRRFLEPPEVQSKEMFIISVIGLMVNIIVAILMFKGGDTSHNLNMRGAFLHVLGDLFGSVGAIVASLLIWGFNFTIADPIASILVSLIILKSAYGISKSSLNILMEGTPNDIDLNAVIKAISKDERIQNVHDCHVWTISNDMNALSCHAVVPEYLSVQTCETMLKSIESDLLQLNIQHMTIQLETPEHKHDESTLCSGIHEHSH

SEQ ID NO: 3791 - protein, 561 aa, Staphylococcus epidermidis
IHRLLTVFNRFYQSLNSLLNFTGGQTMTKFIFVTGGVVSSLGKGITAASLGRLLKDRGLKVTIQKFDPYLNVDPGTMSPYQHGEVFVTDDGAETDLDLGHYERFIDINLNKYSNVTAGKVYSHVLKKERRGDYLGGTVQVIPHITNEIKERLLLAGESTNADVVITEIGGTTGDIESLPFLEAIRQIRSDLGRENVMYVHCTLLPYIKAAGEMKTKPTQHSVKELRGLGIQPDLIVVRTEYEMTQDLKDKIALFCDIKKESVIECRDADSLYEIPLQLSKQNMDDIVIQRLQLNAKYETQLDEWKHLLNTVNNLDGKITIGLVGKYVSLQDAYLSVVESLKHAGYPFKKDVVVKWIDSSEVNDDNVEAYLSDVDGILVPGGFGFRASEGKIAAIRYARENNIPFFGICLGMQLATVEFARHVLGYEGAHSAELDPSTPYPIIDLLPEQKDIEDLGGTLRLGLYPCHIKEGTLAEKIYNKNDIEERHRHRYEFNNEFREQLESNGMVFSGTSPDGRLVEIIEIPKNDFFIACQFHPEFLSRPNRPQPIFKSFVEAALNYQQK

SEQ ID NO: 3792 - protein, 45 aa, Staphylococcus epidermidis
YNLTCTKIRDTIHNEQCLSLYINLDNQYIKYYIIMQIILIHDLLD

SEQ ID NO: 3793 - protein, 41 aa, Staphylococcus epidermidis
SKITLRDKINNTLISQNICLNDLNFELVHLLLLSIKLYFIN

SEQ ID NO: 3794 - protein, 56 aa, Staphylococcus epidermidis
LLQTHIYVKVRFELTKLHSYNNKHNFHHNKLLACVYTPFSLLNYLYSHLGIINKPY

SEQ ID NO: 3795 - protein, 97 aa, Staphylococcus epidermidis
GSLTARPTSRAGSKDGLSDPVVPHGRAIAQRIKATPGITGLSPPRVHIDGEVWHLDVGSSHPGAVVGPKGWAVRPLKRYASWVQNVVRQFGPYPSWA

SEQ ID NO: 3796 - protein, 156 aa, Staphylococcus epidermidis
LWLTQMNNLALQSLTESIAIKYFGKAFKHEVYYNKRLRTTGGRYILSSHNIEINPKQYEMFGEKAVIDIIKHELCHYFLHLAGEGYQHRDKAFKILSAKVGAPRFCTPTESYQDRANYKYRCIYCEQEFIRIKRVNLEKMRCGRCGGILKLIQTRK

SEQ ID NO: 3797 - protein, 40 aa, Staphylococcus epidermidis
LRHALVRIQLAQPLEPLAQLVEHLTFNQRVRGSNPLWLTF

SEQ ID NO: 3798 - protein, 261 aa, Staphylococcus epidermidis
SYCALYYKGSKNLIERGEFMDHKSPLVSWNVFGFDIVFNLASVLMVVITAILVFILAIVCTRNLKKRPTGKQNFIEWVFDFVRGIIESNMAWKKGGNFHFLAVTLILFIFVANMLGLPFAIVTHDHTLWWKSPTADATVTLTLSTTMILLTHYYGIKMRGTKAYAAGYFKPFWPLAIINVFEEFTSTLTLGLRLYGNIFAGELLLGLLASLFFEQPAWGWIISIPGLIVWQAFSIFVGTIQAYIFVMLSMVYMSHKVADGH

SEQ ID NO: 3799 - protein, 51 aa, Staphylococcus epidermidis
DMYLKLTIFLTRIECSIYDYFTNYYMNILSFYKLSILCPFDVGFLHIISTA

SEQ ID NO: 3800 - protein, 54 aa, Staphylococcus epidermidis
PLYYHFKITFVYLFCEFLYYIIEGKYVLFFNDILKLYEDLLFGDSNKLKNMEEK

SEQ ID NO: 3801 - protein, 404 aa, Staphylococcus epidermidis
AMNYSSRQQPKRNWLRKVDWILVLVISLLALTSVILISSAMGGGQYSANFSIRQIIYYIFGAIIAFLIMIISPKKIKNNTYILYSIFCVLLIGLLILPETSITPIINGAKSWYSFGPISIQPSEFMKIILILALAKTISKHNQFTFNKSFQSDLMLFFKILGVSIIPMALILLQNDLGTTLVLCAIIAGVMLVSGITWRILAPLFIVAFVSGSSIILAIIYKPSLIENLLGIKMYQMGRINSWLDPYSYSSGDGYHLTESLKAIGSGQLLGKGYNHGEVYIPENHTDFIFSVIGEEMGFIGSVLLILLFLFLIFHLIRLASKIDSQFNKVFIIGYVSLIVFHVLQNIGMTVQLLPITGIPLPFISYGGSSLWSLMTGIGVVLSIYYHEPQRYEIPTLSKKSNTI

SEQ ID NO: 3802 - protein, 211 aa, Staphylococcus epidermidis
LSDYVLKKVELSMYETYHSGWIETITGSMFSGKSEELIRRLRRGIYAKQKVVVFKPAIDDRYHKEKVVSHNGNEIEAINISTAQEILNHMLEEVNVIGIDEVQFFEDDIVNIVEKLAENGHRVIVAGLDMDFRGEPFKPMPKLLAVSEHITKLQAVCSVCGSPSSRTQRLINGEPAKVDDPIILVGANESYEPRCRAHHIVAPSENEKEEM

SEQ ID NO: 3803 - protein, 54 aa, Staphylococcus epidermidis
IYTYSINHLYRLFSISPIIFYQVFYISSFNFSNEVTFVVIDFCCLICFFNLCAS

SEQ ID NO: 3804 - protein, 190 aa, Staphylococcus epidermidis
QVCYVPFLFYTKGWVQMRDLQQLLDELKDMSFFNPGEMCIIGCSTSEVIGKRIGSVGSMDVAKEIYENLKQLEIDTGVTFAFQGCEHINRAVTIERANFNPLTMEEVTVVPDVHAGGSLSTYAYQQMEDPIVVEHITVSKGIDIGQTLIGMHIKHVCVPVRTSVKQIGEAIVTIATSRPKKIGGERAKYQ

SEQ ID NO: 3805 - protein, 528 aa, Staphylococcus epidermidis
VNIYVKKHIKKYTRKRRIILQNFKELGISDKTVQTLEAMGFKEPTPIQKDSIPYALEGDDILGQAQTGTGKTGAFGIPLIEKVVGQQGVQSLILAPTRELAMQVAEQLREFSKGQKVQVVTVFGGMPIERQIKALKRGPQIVVGTPGRVIDHLNRRTLKTQGIHTLILDEADEMMNMGFIDDMRFIMDKIPAEQRQTMLFSATMPKAIQELVQQFMKAPKIIKTMNNEMSDPQIDEYYTIVKELEKFDTFTNFLDVHQPELAIVFGRTKRRVDELTSALLSKGYKAEGLHGDITQAKRLEVLKKFKNDQIDILVATDVAARGLDISGVSHVYNFDIPQDTESYTHRIGRTGRAGKEGIAVTFVNPIEMDYIRQIEDVNNRRMKALRPPHRKEVLKAREDDIKDRVQNWMSRENEPRLQRISSELLKEYDSTELVASLLQELVEANDEVEVQLTFEKPLARKNRSNKGGSRRSNHKRGNGKFDNKNRRSKGSKGQSSKKKNQKKFDRRDKQQKSGNQSLKGRTFADHQK

SEQ ID NO: 3806 - protein, 46 aa, Staphylococcus epidermidis
KYVYWRKLSLKFSSIFRLSNAIEFKNMIILSFRSRYVLKVVNKKIN

SEQ ID NO: 3807 - protein, 108 aa, Staphylococcus epidermidis
IIRYNMNRGDFMADMESAHHSEQIKTNLKSRLNRIEGQVRAINRMIDDDVYCDDVLTQIRATRSALNSVATKLLDHHMKGCIMEKINDGAQEEAMDELLVTFQKLIKD

SEQ ID NO: 3808 - protein, 68 aa, Staphylococcus epidermidis
SVRYSLNKFYYFVITIRIILPKEFNYLRLSILNSKSKFTATSKLAINSRFSRTLTNRTFYFSYFNFQH

SEQ ID NO: 3809 - protein, 48 aa, Staphylococcus epidermidis
KLKYLKTNYNNSNDNRNELCIKLYYKRQIIFNTYLILNFKIHSFSMHL

SEQ ID NO: 3810 - protein, 42 aa, Staphylococcus epidermidis
FKYLCYWSLNISSVASFYAIIMTEIYILWLQYSISGRFYIIK

SEQ ID NO: 3811 - protein, 49 aa, Staphylococcus epidermidis
NSHLDYLCRFAVRAPVIYLEAFLGSVKSTTRGNNFLSPSQLSLMSAGFA

SEQ ID NO: 3812 - protein, 124 aa, Staphylococcus epidermidis
TNIHMLECEFSMSGYHINVESNQDTLIKVTHIFKALSDFNRVRIMEFLENGEASVGHISHSLNMTQSNVSHQLKLLKSTHLVKSKRQGQSMIYSIDDIHVSTLLKQAIHHSKHPSEGGISNDKS

SEQ ID NO: 3813 - protein, 43 aa, Staphylococcus epidermidis
MISHQPFLLCNLEFSYKNTSFQRIFFKLTSNNHLLIVTKINYK

SEQ ID NO: 3814 - protein, 223 aa, Staphylococcus epidermidis
KSSQKGRDMNMMFDSKQLSVYFICGTQDIPKNKSIEQVLKEALEAGITLYQFREKGPNALKGEKKKQLALKLKQLCHSYHVPMIVNDDVQLAQEINADGIHVGQDDMEIQQFASQFKNKIIGLSVGNLKEYQQSDLSKVDYIGVGPMYTTSSKDDASKPVGPSMISQLRLYIHDFPIVAIGGINETNVQPIVDEGADGISVISAITRSTNIDKTVKYFLRYFT

SEQ ID NO: 3815 - protein, 222 aa, Staphylococcus epidermidis
VRSLSMNSRMKIKKAYEYMKSFHQHDTTGHDIAHVERVYNNACYIAKRENITDTLVIELSSLLHDTVDSKLTDEILAYDQLKQFLSTLDLSSEISQQVLYIIKHMSYRAGKNNHVKLSIDGEIVRDADRLDAIGAIGIARTFQFSGHFGEPMWTETKLSNEELHTSLVEELDNSAIKHFYEKLFKLKDLMHTPTAKKLAEERHQFMIQYLKQFMSEWNFNKE

SEQ ID NO: 3816 - protein, 228 aa, Staphylococcus epidermidis
TKKHGGKMMNKAKLIDHTLLKPDSTKEQIDTIINEAKAYQFKSVCVNPTHVQYASEQLKGTDVLVCTVIGFPLGATTTAVKSYETKDAINNGAQEIDMVINIGALKDGCFDEVQNDIEAVVQAANGKTVKVIIETVLLTEKEKIKACQLSEAAGAHFVKTSTGFAGGGATVEDVKLMKDTVGDRLEVKASGGVRNLEDFNNMIEAGATRIGASAGVQIIQGLESNTDY

SEQ ID NO: 3817 - protein, 161 aa, Staphylococcus epidermidis
NNMQSTQDYIEMRLPASAEYVSLIRLTLSGVFSRAGASYDDIEDSKIAVSEAVTNAVKHAYKKNSEIGMINLCFEIFDDRIKIVISDQGESFDYEATKSHLGPYNDNENIDFLREGGLGLFLIESLMDEVTVYKESGVTISMIKYIKKEQVRNNGERVEIS

SEQ ID NO: 3818 - protein, 728 aa, Staphylococcus epidermidis
VIFKEKRGRKKQMDNSLIETIVSKYQFSEKQIKAVLKLLKENNTVPFIARYRKEATGGLDEVEIKQINDEYNYMLNLQKRKEEVIHNIDQQGLLTSDLKQDILTQTKLQRVEDLYRPYKQKKKTRATEAKRKGLEDLADWFSQSKLDTKIEDKAQLFLNDEVTTIEDAIEGAKDIIAERISDNPQYRSKILKDVFNQGLIVSSKKKKAEDEKQTFSMYYDYNEPIKRIANHRVLAMNRGEKEKVLSIKIDFDTTRIQREIANVEIKTQNEATPFIKEAIQDSLKRLILPSIEREIRGDLTQNAESHAIDVFSENLRNLLLQPPMKGKQILGVDPAFRTGCKLAVVNPFGTFIAKGVIYPHPPISKVEEAEKELVKVISDYNIELLAIGNGTASRETEQFVAKVIKKYQLQAQFIIVNEAGASVYSASEIARQEFPDFQVEERSAVSIGRRVQDPLSELVKIDPKSIGVGQYQHDVNQKDLSSALTFVVETAVNQVGVDVNTASKSLLQYVSGLTSTIAQNIIDYREENGPIKHHKEISSIKRLGAKTFEQSIGFLRIVDGEEPLDNTAIHPESYDVAYRMLHQLDLTAQDIGSVKLKNTLSNVNISTLVSQLNIGEPTLKDIIQSLIAPNRDPRDEFETPILKSDVLSIEDLSKGMKLNGTVRNVVDFGAFVDIGVKQDGLVHISKLSKKFVKNPMDMISVGDIVEVWILDIDENKGKVSLTMVDPNE

SEQ ID NO: 3819 - protein, 467 aa, Staphylococcus epidermidis
INFKIRSIIMTEEINYFWLNCGYNRWNHNEPLVGQTALFESGAHFNPTQGYRAFKKAKAGDQVIFYQVQTDSGLLGIGEIISVQSGAQNKIRVEFKFKETLKPLTTDYLKRSETLDFRMSNMRETLFNQIRESEFELIVSLGKGKSKIPRYFLLAETEAFEPGKNYTIFTHTFNGIKRNGYHFYTQLEVGDNIIIYNKYQNQSVIGIGEVSKHIHEKPPIPGRTNSTAIEIFYEKDIKPISLGHLNKHPKLKNLYFLQENAKQSIASMSQAQYDAILDMSMNNGIKHPFETVKKAELSTQNAEDDSLKPFVLLVVEQKGEGLKAAEELLQKTNANPVITSGHPDFTEDMLYGKYLPNESGALYYREGFITHLMPKKDKSYLVIDNFNRIDVDIFQTYINVLEGYEVTLPRYNKDGSMIKWSKNKDSFYHFNPNWHIVGITYDSIEKIKQKYSSQFLKYTRIVKVNHD

SEQ ID NO: 3820 - protein, 384 aa, Staphylococcus epidermidis
NLFNYYKSGFQKAKPHNLKLILLSLITFVICYITSNIAFSLVILRAQRLPMLAQLGESTTKPIISIIFILLILALLFIFVGYPLITGTVYAIQKAINKEKVLFSDLFFAFKKGKYAKSVILALITLVLFIVIVLILVLLNKLYSLALSPILIGLQQSISGYDNPMGILITIQIVLLLITGFISSIFYWFVIIFIINYTTAYTEDSSRKVMSNLKEGFKGIKNGKKTWFKFFIGVLLISLLASIINKPLLFGVQYLTSSMSQTVAQTIIIIARIVSIVLRLCLYYILIFGIINYFVRRGDKPVKSKRRHKNKDINKGNVNDKVDTKLNASNSKDTEADKMKDQQTHIQQDKTDSQENNIYDSIKEKVNENKENVTEQSKNLFDKK

SEQ ID NO: 3821 - protein, 60 aa, Staphylococcus epidermidis
TIYKIFFIVVLYKKNVTFDQQHSTGGILIQLFENELNSALISLQHIITEEVKTCTHKYGI

SEQ ID NO: 3822 - protein, 166 aa, Staphylococcus epidermidis
NHYNIITIVKMRFEGVFDMSQQQDVVKELNQQVANWTVAYTKLHNFHWYVKGPNFFSLHTKFEELYNEASQYVDDLAERILAIGGNPIGTLSECLDKSIVNEAGKHYSAEEMVEELSKDFSKISKQLEQAIEVSGSASDDVSEDMFIGMQTSVDKHNWMLQSYLGH

SEQ ID NO: 3823 - protein, 320 aa, Staphylococcus epidermidis
AFNNGGVNMPLFLKPIFLDKVWGSDNLRQFGYQLPNNHIGECWGISAHPHGKSVIENGIFAGQTLDQVWNNHREIFGDFPSKDFPLMAKIVDAAAPLSIHVHPDDSYAYEHEEGQYGKSECWYIIEADEGAKITIGTYAKSRDEFEEQLEQGTFENYLRTIQVQPGDFYFIPAGTIHSIGAGIMAYEVMQSSDISYRIYDYHRKTDNSEERELNIDKALDVINYSNELPNITPQNEVIENHNCTHIVSSDFFTMVKWDISGTLNYMKPREFCLVSVLDGQGKLIVDGDIYEISKGSNFVLTSEDLDSVFEGDFKLIISYI

SEQ ID NO: 3824 - protein, 72 aa, Staphylococcus epidermidis
NVNNHKNYMFDDCCLMNFIIRRLINCKVIIDDLNMMMSLFYIINVHIKVILVILDLRYGSKINKKNIFVFFN

SEQ ID NO: 3825 - protein, 397 aa, Staphylococcus epidermidis
VMNNKVNGPFLTLSDLYNDDIVYTSRPSYVSNPWLKPDEHQSNFLTGRELLIANRFPVIVHEASVTNKLEQLFNIVGREIPPHTYKFKDQETYESLIRNLALHQGKKIYFQYIHNEDILPKEYYALDKDVFVALNNKARIPEWTNNKYLPQREIVSIKDFESRIQAWSYPFVIKPGDDLPTAGGYGVMICYNDTDLDKAITRINNASAETEHLIIEQKINAVNNYCVQFAYSDDIGIKYLGTAQQLTNDYGFYNGNENVNDVPQNVIDAGREIMEIGVSKGFFGVAGFDLLVDDNNDVYAIDLNFRQNGSTSMLLLAKDLTHGYHKFYSYFSNGDNTKFYNAILKYVELGVLYPLSYYDGDWYGKNQVNSRFGCIWHGENKELINQYEQQFILEAGL

SEQ ID NO: 3826 - protein, 263 aa, Staphylococcus epidermidis
MMNNLERLRSENPLVICYTNDVVKNFTANGLLSLGASPAMSEAPEEAEDFTRMASALLINIGTLTRENEEDIIKIGKIANQQGTPIVFDPVAVGASTYRKNFCQRFLGEVNVTVIKGNASEILTLIDFNTTMKGTDSDSELDSVNIAKKAANTLNTAIVITGKDDIIAKNEKIIKLSNGSPLLTKITGAGCLLGGVLASFLFRNTQPSIDLLVEAVSVYNIAAEFAEQAPHVNGPGTFLSELLDQLYQMNDITYKNQVKKVEI

SEQ ID NO: 3827 - protein, 289 aa, Staphylococcus epidermidis
MEDNMKNIKAIFLDMDGTILHENNKASEYTKQVINELREQNYKVFLATGRSYSEISQLVPDGFTVDGIISSNGTSGEIHGDNLFRHSLTLERVQKIVELAKKQHIYYEVFPFESNRISLKEDEDWMKEMISTIEPPDAVSQSEWSSRREAIKGKIDWRDTLPDAHFSKIYLFSPNLDKITDFRNQLVENQSNLGITVSNSSRYNAETMPYHTDKGTGIKEMIDHYGIKQEETLVIGDSDNDRAMFNFGHHTVAMKNARQEIKNLTDDITEYTNEEDGAAHYLKSHLLDN

SEQ ID NO: 3828 - protein, 341 aa, Staphylococcus epidermidis
SGSKEAHFVEEFTKSYKALVKESLITNNKTLLIKKCEAFTNEVIKKDVLPEDIVEIHKDYINTLDLTEEDILETLDVLQEVVKGFGYSYRDYQRLVNKLQVHDKEMDLASRLQQTMLKADIPQFDSIQIGVISVAAQKVSGDYFNLIDHKDGTMSFAVADVIGSGIPAALAMSMIKFGMDAYGHSQLPSDGLKRLNRVVEKNVNQNMFVTMFYGLYEEMNHLLYCSSAGHEPGYIYRAETEAFEEIGVRGRVLGVSPKTRYSQQEIPIYLDDLIIIFTDGVTEARDVEGNFIDKDKLLDLIQKYKHMHPQDIVQIIYEAILKLQNPARKDDMTILIIKRVN

SEQ ID NO: 3829 - protein, 74 aa, Staphylococcus epidermidis
ANILVVWATPHPFPLNIYFGTLAGGLGCFPFEHGPYHPCSDSQVKLIGIRSLSEFGNPRGALRPNSALPPIIIT

SEQ ID NO: 3830 - protein, 132 aa, Staphylococcus epidermidis
VRILPAEPWLLGQAVKTPPFHGGNTGSSPVGVILWRISSAGRASALQAEGRRFEPVILHHLIKYCGGVAKWLNAADCKSAPSGSAVRICPPPPFLGYSQAVRQRTLTPSCAGSNPASPAIRAISSVGRASDF

SEQ ID NO: 3831 - protein, 154 aa, Staphylococcus epidermidis
KFNKNLNRIDTIPQAILSFRLYEWNGLHDWYRTLGGYKMRRFNIIFKQYLQYYLYILVIIGILYSISPHPFLLGLMIGTCGSLVNTYIFEIYLAKSMHKETTQMSTGSTWRYLVAVIACVLWLFFKEHINIIGVLIGLMISYIVIILRPLLQRE

SEQ ID NO: 3832 - protein, 443 aa, Staphylococcus epidermidis
NGCKSMPGRERTSPQYESFHELYKNNTTKELTQKAKSLKLTNYSKLNKKELVLAIMEAQMEKDGNYYMEGILDDIQQDGYGFLRTVNYSKGEKDIYISASQIRRFEIKRGDKVTGKVRKPKDNEKYYGLLQVDFVNDHNAEEVKKRPHFQALTPLYPEERILLETQSTNYSTRIMDLVTPIGLGQRGLIVAPPKAGKTSLLKEIANAIASNKPEANLFILLVGERPEEVTDIERSVESAEVVHSTFDEPPEHHVKVAELLLERAKRLVEIGEDVIILMDSITRLARAYNLVIPPSGRTLSGGLDPASLHKPKAFFGAARNIEAGGSLTILATALVETGSRMDDMIYEEFKGTGNMELHLDRKLSERRIFPAIDIGRSSTRKEELLITKAELDSLWQLRNLFTDSTDSTDVLLENLSVRKVMKNCLSNCQKAVEESTKTGRPII

SEQ ID NO: 3833 - protein, 132 aa, Staphylococcus epidermidis
HMLNKIVIVGRMTKDAQIYEKEDNKIATFCVATERNYKDDNNEISTDYLLCKAFGKTATNIEKYTSQGTLVGITGQMRSRKYEKEGQTHFVTELYVETIKFMSPKNKNNETPSDNQFENNTYQPDDLEIIHI

SEQ ID NO: 3834 - protein, 108 aa, Staphylococcus epidermidis
MNLNIETITHDDFYEVKVGGELDVYTVPELEEVLVPMRQEGTHDVHVNLANVSYMDSTGLGLFVGTLKALNQNDKNLYILGVSERIGRLFDITGLKDLMHVNEGTEVE

SEQ ID NO: 3835 - protein, 237 aa, Staphylococcus epidermidis
MKLKREFTHSHLNIHYIINRHTHWRKMIMSKVHVFDHPLIQHKLSYIRDARTGTKEFRELVDEVGMLMAYEVTRDLELQDVEIQTPVTKMTAKRLAGKKLAIVPILRAGLGMTDGVLSLVPAARVGHIGLYRDPETLEAVEYFAKMPQDIDERQIIVVDPMLATGASAIEAISSLKKRGAKSIRFMCLIAAPEGVEKMQEAHPDVDIYIAALDEKLNDKAYITPGLGDAGDRLFGTK

SEQ ID NO: 3836 - protein, 503 aa, Staphylococcus epidermidis
MAIKAEEISALLRSQIENYESEMSVTDVGTVLQIGDGIALIHGLNDVMAGELVEFHNGVLGLAQNLEESNVGVVILGPYEEISEGDEVKRTGRIMEVPVGEEMIGRVVNPLGQPIDGQGPINATKTRPVEKKATGVMDRKSVDEPLQTGIKAIDALVPIGRGQRELIIGDRQTGKTTVAIDSILNQKDQDTICIYVAIGQKDSTVRANVEKLRQAGALDYTIVVSASAADPAPLLYIAPYSGVTMGEEFMFNGKHVLIVYDDLTKQAAAYRELSLLLRRPPGREAYPGDVFYLHSRLLERAAKLNDDLGGGSITALPIIETQAGDISAYVPTNVISITDGQIFLQSDLFFSGVRPAINAGQSVSRVGGSAQIKAMKKVAGTLRLDLASYRELESFAQFGSDLDEFTAKKLARGERTVEVLKQGQNNPLPVEHQVLIIFALTKGYLDDIPVQDINRFEEEFNHWAESNATELLNEIRETGALPDADKFDSAITEFKKGFNKSEE

SEQ ID NO: 3837 - protein, 41 aa, Staphylococcus epidermidis
KIINNNLRHQSLSQVFFVVDANGLWLKHELTIYLLFEFTLY

SEQ ID NO: 3838 - protein, 43 aa, Staphylococcus epidermidis
VTAKPSFTIEPCGSIYYPVLAPVSRSYPSLIGRLSTCYSPVRR

SEQ ID NO: 3839 - protein, 180 aa, Staphylococcus epidermidis
IMAKVAKKYAKALFDVALDTNQLDVVYEDLETISHSSFDFIKQLKAIDSNPSLTANQREEFVERVYNEANPYVVNTLKVLADNRHISIVENVFKSFQNLYNKYYKQDFAIIESTYELSEDEISRIVELIKKQTELSNVIVNTKINQDLIGGFRVKVGTTVMDGSVRNDLVQLQRKFERAN

SEQ ID NO: 3840 - protein, 67 aa, Staphylococcus epidermidis
GNQKSYLVPFLYSKLNILMSIIILNFLLLNELEKSVMLDSIESNLKHCYFKGSFSENNGIVINKTLY

SEQ ID NO: 3841 - protein, 431 aa, Staphylococcus epidermidis
YFKKKETKEKSDMAQEVIKIRGGQALKGEVEISGAKNSAVAIIPATLLAQGQVKLEGLPQISDVETLVSLLEDLNIEARLNGKQLEVDTTQIENAPLPNNKVESLRASYYMMGAMLGRFKKCVIGLPGGCPLGPRPIDQHIKGFKALGAEIDESSNTSMKLVAKELRGAHIFLDMVSVGATINIMLAAVHAKGQTVIDNAAKEPEVVDVANFLMSMGADIRGAGTTSIKINGVEELKGSEYQIIPDRIEAGSYMCMAAAMGEEVILHNIVPKHVEALTVKLQELGVDIEIEDEKIIIRKQTPYKNVDIKTLVYPGFATDLQQPITPLLFMTEGPSFVTDTIYPARFKHVEELQRMGANIKSDEGTAVIKPSTLNGAEVYASDLRAGACLITAGLIAEGVTTIFNVKHIYRGYTNIVEHLKALGADIWTETV

SEQ ID NO: 3842 - protein, 47 aa, Staphylococcus epidermidis
PHKNHHELLFQYLDSFNTLLVFIKCVYPTYVLKITYTLHELTLIYIL

SEQ ID NO: 3843 - protein, 144 aa, Staphylococcus epidermidis
AMKKECIHMPIIYYDGNCVYCYNYAIWLIQNGLSHKYEFATIKGQIGKQFFENYPDAQNKNSVILQKGNHLEFESQAVATLISSLPNHSKFLGIGLRLIPKPLRDLGYRLFANNRDKMWKTHWHKPTDYEKSFFLDDNEKIKLT

SEQ ID NO: 3844 - protein, 363 aa, Staphylococcus epidermidis
EGGNVVFDQLDIVEERYEQLNELLSDPDVVNDADKLRKYSKEQADLQKTVDVYRSYKTKKEELRDIEDMLNETSDKEEVEMLKEESSALKTELPDMEEELKILLIPKDPNDDKDVIVEIRAAAGGDEAAIFAGDLMRMYSKYAEANGFKTEIVEASESDHGGYKEVSFSVSGTGAYSKLKFENGAHRVQRVPETESGGRIHTSTATVAVLPEAEDVEIEIRNEDLKIDTYRSSGAGGQHVNTTDSAVRITHLPTGVIATSSEKSQIQNREKAMKVLKARLYDMKLQEEQQKYASQRKSAVGTGDRSERIRTYNYPQSRVTDHRIGLTLQKLNQIMEGNLDEIVEALTLSEQTEKLKELNNGEL

SEQ ID NO: 3845 - protein, 61 aa, Staphylococcus epidermidis
RLLKLNIIIFLNSIAFDNLNIELNFNDNLRQYTYFYYDYYILKVNKVLSFCDILANLKEVM

SEQ ID NO: 3846 - protein, 141 aa, Staphylococcus epidermidis
KAMKIIFVCSGNTCRSPLAESIAKSLLPHDSIASRGLFAVEGQAISKESLELIHKYDLPEPSRAQAFHIDDLDADIILTMTQAHKDLIFSMYGRQSNVFTLNEYVGDTQEIDDPFGGSFDVYEQTYTKIYDLVDKIKFKHE

SEQ ID NO: 3847 - protein, 71 aa, Staphylococcus epidermidis
EGMKLKKGLINVSGIKTTEQAKQLKDHLSKMIGINSVDIDYQMNEIRVEFDTPANLNNIEKEIYDYGFRIL

SEQ ID NO: 3848 - protein, 118 aa, Staphylococcus epidermidis
ASMKVLRFLLGLAFGTAGVLHFTRERQFRNIVPDYLPLQKTAVLVTGVIEIFFGIMLLIKRPASWLKKGINLFLLAVFPANIYMARKGLPLGDKELPKWALYSRLPLQFVLIKAIKKL

SEQ ID NO: 3849 - protein, 279 aa, Staphylococcus epidermidis
TMVNYKEKFAEAKTIAVNEGFESTRAEWLFLDVFGWSKTDYLIHKDEQMSLTSINKLDKALDRMITGEPIQYIVGFQSFYGYQYKVNQHCLIPRPETEEVMLHFLELCKKTDTIADIGTGSGAIAITLKLLQPELNVIATDLYEDALNVAKQNASHYHQNIQFLRGNALKPLIENDIKLDGLISNPPYIGHSEIIDMESTVLNYEPHHALFAEKNGFAIYESILEDLPFVMKQGGHVVFEIGYSQGDILKRMIQDLYPEKEVEIFKDINGNQRIISIIW

SEQ ID NO: 3850 - protein, 116 aa, Staphylococcus epidermidis
LSNLFLNFKMLKSNIHFYKYLYCLFSCTMLYSNLTKELNMDYLGQFAIVHLILHVVCICVAYWALNSIKLDQFFKKGYPLQVQVCMIFISILLGTAVSNFIVDLLQYSTQVKYLIK

SEQ ID NO: 3851 - protein, 67 aa, Staphylococcus epidermidis
PLIDCCKPINIGLRAKLYNLFNSTRISTITMNKTKVIKAKITDLAYLPFLKAKNKSLKRTFSLLIAF

SEQ ID NO: 3852 - protein, 61 aa, Staphylococcus epidermidis
LCLDIVLAKASISIIFMNSEGWMLIGPKLYQLLAPLIIGVIEVSGKISNPINRTQNILYKI

SEQ ID NO: 3853 - protein, 40 aa, Staphylococcus epidermidis
SKLDGKGSNNPYQFASSHFPIRGKVLLKRLKKHHSQYSTV

SEQ ID NO: 3854 - protein, 495 aa, Staphylococcus epidermidis
PMIEVFTMALHQSNIIINILLVSAFLLNLVFAFIIIFMERRTANSIWAWLLVLVFLPLVGFILYLLLGRQIQREHIFKLAKEDKVGLEMIVDEQLEALKKQDFSKGNHQIVKFKEMVQMLLYNNAAFLTTDNDLTIYTDGHQKFDDLINDIRHAQSYIHIQYYIIHSDNLGKQLLHELEKKAEEGIEVKMLYDDMGSRDLRKKDLKKFRQKGGHAESFFPSKLPLINLRMNNRNHRKIVVIDGTIGYVGGFNVGDEYIGKSKKFGYWRDTHLRIKGDAVNALQLRFILDWNSQSTRDNLTYESRYFPDVDSGGTIGIQIASSGPDEDWEQIKYGYLKMISSAKESIYIQSPYFIPDQAFLDSIKIAALGGVDVNIMVPNKRDHPFVYWATLKNVASLLEAGVNVYHYDNGFLHSKTLVIDDEVASVGTANMDNRSFTLNFEVNAFIYDEGVARSLKQAFINDMKLSNKLTSEEYAKRNLLVKFKEGISQLLSPIL

SEQ ID NO: 3855 - protein, 124 aa, Staphylococcus epidermidis
YTKEAIQVIYGIGIDLIEIERIKNLQNQTKFIERILTIEERDKLNQYTNEQRRLEFLAGRFTVKEAFSKALGTGLGKSVSFQDINCYNDALGKPCIDYPGFYTHVSITHTENYAMSQVILEKNE

SEQ ID NO: 3856 - protein, 163 aa, Staphylococcus epidermidis
SNKEDKCMTKMNVESFNLDHTKVVAPFIRLAGTMEGLNGDVIHKYDIRFKQPNKEHMDMPGLHSLEHLMAENIRNHTDKVVDLSPMGCQTGFYVSFINHDDYDDVLNIIDQTLHDVLNASEVPACNEVQCGWAASHSLEGAKTIAQAFLDKREQWNDIYGEGK

SEQ ID NO: 3857 - protein, 458 aa, Staphylococcus epidermidis
IQKERLKMGKYFGTDGVRGVANQELTPELAFKLGRYGGYVLAHNKGEKHPRVLVGRDTRVSGEMLESALIAGLISIGAEVMRLGVISTPGVAYLTKEMEAALGVMISASHNPVADNGIKFFGSDGFKLSDDQENEIEQLLDQTNPDLPRPVGEDIVHYSDYFEGAQKYLSYLKSTVDVNFEGLKIVLDGANGSTSSLAPFLFGDLEADTETIGCNPDGYNINEQCGSTHPEKLAEAVLETESDFGLAFDGDGDRIIAVDENGQIVDGDQIMFIIGQEMYKNQELNGNMIVSTVMSNLGFYKALEKEGIQSNKTKVGDRYVVEEMRRGNYNLGGEQSGHIVLMDYNTTGDGLLTGVQLASVIKMSGKTLSELASQMKKYPQSLINVRVTDKYRVEENIHVQEIMTKVETEMNGEGRILVRPSGTEPLVRVMVEAATDADAERYAQSIADVVEDKMGLDK

SEQ ID NO: 3858 - protein, 173 aa, Staphylococcus epidermidis
KVILMKSYKYMHQNGIKVMRISGAFWTLLLVIALSILILLNELKFHFIDTKNLIIGVIILTTIVCILFMIIVPWFKFKHLRYFLDDKEIHIREGIIFIDVHVIPYFRIQNIDIVEGFIMRKFQLASLSLSTAGGNSEIALIDIQEAQRLKKQIKQQKSITTNVTSLEKLNDDI

SEQ ID NO: 3859 - protein, 46 aa, Staphylococcus epidermidis
FIKLFNFQKGRAICNVSVFFIIHQKIKACDESNILINLQMLFHCML

SEQ ID NO: 3860 - protein, 54 aa, Staphylococcus epidermidis
KAFCDAKSYLLSSFECIIIHLSGDNGKEVTPVPMPNTEVKLLSADGSRTDVPLE

SEQ ID NO: 3861 - protein, 365 aa, Staphylococcus epidermidis
IKFCPYFFTAYNHRRGENMHTQIWDLRMYKNNVSQYPHIDEIKQTFLDGGLVAIPTETVYGLGANARNEEAVENIYVAKGRPSDNPLIVHIHSIEQLDDFVEYIDDKVKVLMDEFWPGPISFILPLKQGYLCSKVTGGLESIAVRMPSHKIGRALLQIVDEPIAAPSANISGRPSPTTFEHVNRDLNGKVNGIVNGDQCEEGLESTVIDCTQFPFRIARPGSITQDMIETKLPHSINRQIYEENEKPIAPGMKYKHYSPETPLTIVKDLNKKIANDDKWSKVAFVFPESQRSLIPENSIFISLCENKGDFKSAGHNLYEILHELDQNEEIEEAYIYGFEDNHHTEAIMNRMLKAASYKLIKGEKL

SEQ ID NO: 3862 - protein, 62 aa, Staphylococcus epidermidis
TYNWNGFYIKRQLFKTFGKHILNDSQLSVILVTHIIEEMPLFLKKIYLKTFKYLTRLIFKML

SEQ ID NO: 3863 - protein, 178 aa, Staphylococcus epidermidis
RKECHEPVTATANTFILGAGVEWGTTFVTLVTFVILIILLKKFAWGPLKEVMDKRERDINKDIDDAEQAKINAQKLEEENRKTLKETQDEVQKILDDAKIQARKQHEEIIHEANEKANGMIETAQSEINSQKERAISDINNQVSELSVLIASKVLRKEISEQDQKELVEKYLKEAGDK

SEQ ID NO: 3864 - protein, 296 aa, Staphylococcus epidermidis
NVILSYDSVNNDWYNNQYGKVLPGGDVMDFSNFFQNLSTIKIITSLLDLLIVWYVLYLLITVFKGTKAIQLLKGIVVIVIGQQISKILNLTATSKLFDIVIQWGVLALIVIFQPEIRRALEQLGRGSFLKRYTNTYSRDEEKLIQSVSKAVQYMAKRRIGALIVFEKETGLQDYIETGIPMNSDISQELLTNVFIPNTPLHDGAMIIQGSKIAVAASYLPLSDSVKISKSLGTRHRAAVGISEVSDAFTVVVSEETGDISVTFDGKLRRDISKDVFEELLAEHWFGAHFQKKGVNS

SEQ ID NO: 3865 - protein, 293 aa, Staphylococcus epidermidis
LIDRGKAMFIKKDFDDITVQVFEEKYRDALNQFELSERQQIYSSLPQTVLDDALKDENRIANVALNKEGKVVGFFVLHRYYQHEGYDTPNNVVYVRSLSVNEKFQGHGYGTKMMMFLPEYVQALFPDFTHLYLVVDAENQSAWNVYERAGFMHTATKEEGPIGKERLYYLDLDSKHVSSLRLKEGEAAYNDDIHVINLLKDDVKVGFIALEQNDNKMNISAIEVNKQNRNEGIAESALRQLPTYIRKQFEDIEILSITLYGERNELKPLCLNSNFVAIEETEDYTRFEKYINY

SEQ ID NO: 3866 - protein, 68 aa, Staphylococcus epidermidis
LCWLSNPHHLSWWETVSGGQFDWGGRLLKGNGGAQRFPQNGWKSFIECKGIRELDCETYKSSRVERRT

SEQ ID NO: 3867 - protein, 98 aa, Staphylococcus epidermidis
LCSRWFRAKELKKMKQGIHPEYHKVIFLDTTTNFKFLSGSTKTSSETMEWEDGNEYPVIRLDVSSDSHPFYTGRQKFAAADGRVERFNKKFGLKSNNN

SEQ ID NO: 3868 - protein, 156 aa, Staphylococcus epidermidis
YYYSLSSEVLKMETIFDYNQIKQIIPHRQPFLLIDKIVEYEEGKRCVGLKQVSGNEPFFQGHFPNYAVMPGVLITEALAQTGAVAMLNSEENKGKIALFAGIDKCRFKKQVVPGDTLMLEVEITKIKGPIGKGSAKATVDGQLACSCELTFAIQDA

SEQ ID NO: 3869 - protein, 263 aa, Staphylococcus epidermidis
KKSRCEIMAKESKSASEVSPEQINQWIKQHQENEDSQAQDKLVKHYRKLIESLAYKYSKGQSHHEDLVQVGMVGLIGAINRFDLSFDRKFEAFLVPTVIGEIKRYLRDKTWSVHVPRRIKEIGPRIKKVSDELTNELERSPSISEIAQRLEVSDEEVLEAMEMGQSYNALSVDHSIEADKDGSTVTLLDIMGQQDDNYDLTEKRMILERILPILSERERQIIQCTFIEGLSQKETGERIGLSQMHVSRLQRTAIKKLQEAARQ

SEQ ID NO: 3870 - protein, 360 aa, Staphylococcus epidermidis
VVSRRTYMSEKFYRATYLNVNLDAILANYQNFNQLHANKTVISVIKANGYGLGSVKIAQHLMRHGATFFAVATLDEAIELRMHGVDAKLLVLGVVPTEDIEKAIQHRVALTVPSKAWLKETIKQIPDDNQKNLWLHVKLDTGMGRIGMKDIDEYKEVVDLINKRDHLVFEGVFTHFASADEPGNSMNEQYTLFKEMVNQVEKPNYIHCQNSAGSLLMDGQFCNAIRLGISLYGYYPSEYVKDNVKVHLRPSAQLVSETVQVKTLKAGETVSYGRTYIADEEMTIAILPIGYADGYLRSMQGAFVNVNGSQCEVIGRICMDQLIVKVPSHVKTGDKVILMDNHVDSPPSAETVPNKQGRTN

SEQ ID NO: 3871 - protein, 166 aa, Staphylococcus epidermidis
ILKRSTFMKNDSTFHRSPIQALKYYYITSCIGLFILLVILSLLLYFSYLNHWWPFTSYIFLGLGLLSILNTCISPLIKYRYHYYKIHEDFVILKRLFIFRKEELSKIERIQFIDIGTNPLSKKLNLNSITLFTAGHTISFPIISEKEAQNIQQQILLRLRGANDDV

SEQ ID NO: 3872 - protein, 311 aa, Staphylococcus epidermidis
MLESKWGLRFVALILAVFFFLSVNNVFGNIFNTDDLSQKSSKTIQDVPVDVIYNSKDLHVTKIPENVDVNLTGPQSKLIKIENPEDLKVVVDLSGKKAGKYQKKYQVRGIDSGINYQIKPEVAHINLENKITRVMHVQPDISSNSLDPKYKISKQSISPETVKVTGGEQQLKNIAYLKATFKNSSKVNKDTNDVADVSAFDKQLNKLNVSINPNEVNLKVTVEPFSKMVKVRKKTTGKLNENKELDSVKLEDKEVEIFGNRDELQNINEITAEVDIDGISESTEKTVSFNLPKDVTKVNPKETKAYINVKN

SEQ ID NO: 3873 - protein, 41 aa, Staphylococcus epidermidis
FVERFILRRCSFSTRHRLAPISLIIYFTKFKNNKRIVSLTK

SEQ ID NO: 3874 - protein, 120 aa, Staphylococcus epidermidis
MIRRGDVYLADLSPVQGSEQGGVRPVVIIQNDTGNKYSPTVIVAAITGRINKAKIPTHVEIEKKKYKLDKDSVILLEQIRTLDKKRLKEKLTFLSESKMIEVDNALDISLGLNNFDHHKS

SEQ ID NO: 3875 - protein, 81 aa, Staphylococcus epidermidis
YKERGFVKQFIYISLVCGIISGAGIFLQLPHYPSMMIPRFVAILGIISAAITIRDKEISGMLKLGGIMINIMPLLGSVIAK

SEQ ID NO: 3876 - protein, 179 aa, Staphylococcus epidermidis
RDWRFTMSKILNTQLTGIFNRLEKQELDIQMAAQCLIQAIGGEGHVYIKGYDDLKFYESFILQSHEKLASSLPLEDLQNFNDIDTTDRVLLFSPYYTSEVESDVLQLIDLDVDLVLICNNPKRDDFPNHLIHYVNLSTPRPIVYTEDYDKIIQPHPMALNYIYYDIYTQMIEMTRDLDL

SEQ ID NO: 3877 - protein, 272 aa, Staphylococcus epidermidis
LLWSDRHMKIGIDAGGTLIKIVQEHDNRRYYRTELTTNIQKVIDWLNNEEIETLKLTGGNAGVIADQIHHSPEIFVEFDASSKGLEILLDEQGHQIEHYIFANVGTGTSFHYFDGKDQQRVGGVGTGGGMIQGLGYLLSNITDYKELTNLAQNGDRDAIDLKVKHIYKDTEPPIPGDLTAANFGNVLHHLDNQFTSANKLASAIGVVGEVITTMAITLAREYKTNHVVYIGSSFNNNQLLREVVENYTVLRGFKPYYIENGAFSGALGALYL

SEQ ID NO: 3878 - protein, 243 aa, Staphylococcus epidermidis
LLRRRYIMTESTPHINPNGVKIAKTVLMPGDPLRAQYIAENFLENVEQFNTVRNMFGYTGTYKGKEVSVMGSGMGIPSIGIYSYELYHFFDVDTIIRVGSCGALQEDVNLYDVIIAQAASTNSNYVDQFNIPGHFAPIADFNLVAKAKKAADEIGAISHVGNVLSSDTFYNADSTFNDSWKKMGILGIEMESAGLYLNAIHANKKALGIFTVSDHILRDEATSAEERQTSFTQMMEIALEIAE

SEQ ID NO: 3879 - protein, 75 aa, Staphylococcus epidermidis
PKNGGGGQIRTAEPEGADLQSAAFSHFATPPQYLIKWWRMTGSNRRPSACKADALPAELILHKMTPTGLEPVLPP

SEQ ID NO: 3880 - protein, 229 aa, Staphylococcus epidermidis
ATPGVEITPKRITSAPIEIKPAINADSSISPDTLVSLPTKTRGCFSPLLCARTYPPYLPSLKANSGVSSWLATPRTPSVPKYFPIFKRSFCIYQFLTFIYAFVSFGFTLVTSLGKLNDTVFSVDSEIPSISTSAVISLIFCNSSLLPKISTSLSSSLTLSNSLFSLSLPVVFLRTLTILLNGSTVTFKLTSFGLIDTFNLFNCLSNALTSATSLVSLFTLLEFLKVAFK

SEQ ID NO: 3881 - protein, 295 aa, Staphylococcus epidermidis
YSKGGEIMASLKEIDSRIKSTSKMKQITKAMNMVSSSKLRRAEKNTKSFRPYMEKMQDAITAVAGSNSTSNHPMLKSRDIKRSGYLVITSDKGLAGAYSTNVLKSLVNDINSKHNDSSEYSLIVLGQQGVDFFKHRGYEIESSLVEVPDQPSFKSIQSIAKHAIDLFSEENIDELTIYYSHYVSVLENKPATKQVLPLSQEDSGQGHGQMSSYEFEPDKESILSVILPQYVESLIYGTILDAKASEHASRMTAMRNASDNATELIDDLSLEYNRARQAAITQQITEIVGGSSALE

SEQ ID NO: 3882 - protein, 77 aa, Staphylococcus epidermidis
ILGGNFIMNLIAAAIAIGLSALGAGIGNGLIVSRTVEGVARQPEARGQLMGIMFIGVGLVEALPIIGVVIAFMTFAG

SEQ ID NO: 3883 - protein, 43 aa, Staphylococcus epidermidis
TTMGFISNHFNVIIIIIKYFHLFYHNIIHYSKQHLSLKVDFKN

SEQ ID NO: 3884 - protein, 55 aa, Staphylococcus epidermidis
NKAISNEVIIVKNQDKIQNVVKLLSSLGVNIKKTKSRLDIINTLPTSNQVSHELK

SEQ ID NO: 3885 - protein, 412 aa, Staphylococcus epidermidis
MSYIEKKDKVVYDAIQKEFQRQNSNIELIASENFVSQAVMEAQGSVLTNKYAEGYPGRRYYGGCEHVDVTESIAIERAKALFGAEHVNVQPHSGSQANMAVYLVALEMGDTVLGMNLSHGGHLTHGATVNFSGKFYHFVEYGVDQENELINYDEVRRLAIEHQPKLIVAGASAYSRTIDFKKFKEIADEVGAKLMVDMAHIAGLVAAGLHPNPLEYADFVTTTTHKTLRGPRGGMILCKEEYKKDIDKTIFPGIQGGPLEHVIAAKAVAFGEALNDDFKDYQNQVIKNAQALAQTLIEEGFRVVSGGTDNHLVAVDVKGSINMTGKLAEETLDKVGITCNKNTIPFDKEKPFVTSGVRLGTPAATTRGFDESAFVEVAKIISLALNNYDNDTKLNEAKERVHALTSKYPLYN

SEQ ID NO: 3886 - protein, 71 aa, Staphylococcus epidermidis
KLILKIKNASIIVRHLHIIIFYLAMTLPSNGIILIIIPPSLSIPLISLSLIVIAALIIPRIATNLGIIIDG

SEQ ID NO: 3887 - protein, 488 aa, Staphylococcus epidermidis
YMYISFLRSEYNKMRNFTKQYINGEWVDSASGETIDVINPATEEVMGKIAKGNEEDVNKAVDAADKVYLEFRHSSVEERRELLDKIVKEYQNRKNDLIEAITDELGAPLSVSENVHYQMGLNHFTAARDALDSFQFEEQRGDDLVVKEAIGVAGLVTPWNFPTNQTSLKLAAAFAAGSPVVLKPSEETPFAAIILAEIFDKVGVPKGVFNLVNGDGSGVGNPLSEHPKVRMMSFTGSGPTGSKIMEKAAKDFKKVSLELGGKSPYIVLDDVDVEEAANATTKKVVNNTGQVCTAGTRVLIPESIKEDYLTAVKEAFSKVKVGQPREEGTQVGPIISKKQFDQVQDYIDKGINEGAELFYGGPGKPEGLDKGYFARPTIFINVDNHMTIAQEEIFGPVMSVITYNNLDEAIEIANDTKYGLAGYVIGKDKDTLRHVARSIEAGTIEINEAGRKPDLPFGGYKESGLGREWGDYGIEEFLEVKSIAGYFK

SEQ ID NO: 3888 - protein, 48 aa, Staphylococcus epidermidis
HHHIQVIDYYFTINKTSNDKIHKTTIIKHIIFMIINISFFSIKSKTVR

SEQ ID NO: 3889 - protein, 44 aa, Staphylococcus epidermidis
PLLLTFQHRAGVSPYTSPYGLAETCVFDKQSLGPIHCGSSGREP

SEQ ID NO: 3890 - protein, 224 aa, Staphylococcus epidermidis
GLSMSYKYEAFFKDILINEYIYFASKNKKLIRIQHENLPYIAMWTDENVAESYLLHHSIDYDKIIRADIDRFVTYEMDEIFDPGDKVLVNVNNGEEGNIVDIVKMTDELMSELDDIRMREFIKDVAKYDEVYGLTNKGEKNFIMISDDDHNKPHIMPVWSIKSRARKVRDQDFEECDLIEIEGEVFSEWLDKLRDDNKAVAIDLKSGVVGTVVSAQKLSNEATF

SEQ ID NO: 3891 - protein, 40 aa, Staphylococcus epidermidis
LFVIEMSWSNYFLRWEVVLFFEEANYDIFKRVEGSIKTYY

SEQ ID NO: 3892 - protein, 619 aa, Staphylococcus epidermidis
AVIINHNSRVIPFVGGYYMCGIVGYIGYDNAKELLLKGLEKLEYRGYDSAGIAVVNDDGTKLFKEKGRIAELRKVADNSDEDGTLGIGHTRWATHGVPNYENSHPHQSTSGRFTLVHNGVIENYEELKAEYLSDVTFSSETDTEVIVQLVDYFSRQGLATEDAFTKVVKLLHGSYALGLLDDNDKDTIYVAKNKSPLLVGVGEGFNVIASDALAMLQTTNQYKEIHDHEIVIVKRDTVEIKDLEGHIQQRDTYTAEIDAADAEKGVYDHYMLKEIHEQPAVMRRIIQEYQDEKGNLKIDSEIINDVADADRIYIVAAGTSYHAGLVGKEFIEKWAGVPTEVHVASEFVYNMPLLSEKPLFIYISQSGETADSRAVLVETNKLGHKSLTITNVAGSTLSREADHTLLLHAGPEIAVASTKAYTAQIAVLSILSQIVAKNHGRETDVDLLRELAKVTTAIETIVDDAPKMEQIATDFLKTTRNAFFIGRTIDYNVSLEGALKLKEISYIQAEGFAGGELKHGTIALIEDGTPVIGLATQENVNLSIRGNMKEVVARGAYPCMISMEGLNKEGDTYVIPQVHELLTPLVSVVTMQLISYYAALQRDLDVDKPRNLAKSVTVE

SEQ ID NO: 3893 - protein, 188 aa, Staphylococcus epidermidis
RKSFERKYFYMKIQDYTKEMVDEKSFIDMAYTLLNDKQTTMNLYDIIDEFKSLGGYEYEDIENRIVQFYTDLNTDGRFLNVGENLWGLRDWYSVDDIEEKIAPTIQKFDILDDEDEEDQNLKLLGDDDADEDDDIPAQTDDQETLDESDNDEDDVEMNEADIVIDEDEDEDIAEGEEEAFEDAEDFND

SEQ ID NO: 3894 - protein, 506 aa, Staphylococcus epidermidis
EVQMTMYSPQKLHPISYIDGLISVIKSNFIVIIIFLFNIKDFKYDDFSSYIIPGIMTLIFSIGFIHNIIKVYNTRYWIEEDHFILTTGVFNKERKELNISRIQSADTSQGLINQIVGGVELIIKTPSDGIELGTISKKQSEVIEQELRSIQERMNNQVNQEAKELNDENHTQTYQQHAKPQYAIFKMPFKQLLFMSMTSGAIALAFVTLSPIIGSLSSVIPWDKFGEEISSVFKTIYFIVIFIVILVLLLSYIIGTIMYLIKFYGYQVIQDNHQLKIQYGLFTKKNITVPTDRLQGVLEHQSFIRKLFGYTSIHFYITSDIDTTEGEPTDNDGRIMILPFIPRKEAYKVIRPLVPEMTFNHAKIGMPLKGFHRHFLIPSLCIIGMGIIGWYMWSLWSLIIALLPILLFFVYAILYTRFSGFAFSESELVVQKASILNIKRFYVKKEKVLGMAISQHPFLERSQLANFQFVIAKGSSQQNIGLKFSEVDNVLKLKNWYMKGDTHEVL

SEQ ID NO: 3895 - protein, 56 aa, Staphylococcus epidermidis
NLKIERMIYKKFYTPLYIIILIVDFIDIKSFDIELMIQQNSIIKNCLQYPNGKVDS

SEQ ID NO: 3896 - protein, 49 aa, Staphylococcus epidermidis
ILKIKKSLPLTAIVRGAYLFNTRVLIKGAQIKYYHLLNKNKSPTLMFLL

SEQ ID NO: 3897 - protein, 475 aa, Staphylococcus epidermidis
KEEINMGIGRVAQVMGPVIDVRFEHNEVPEINNALHIEVPKEDGALQLTLEVALQLGDDVVRTIAMDSTDGVQRGMEVKDTGRDISVPVGDVTLGRVFNVLGETIDLDEKIDDSVRRDPIHRQAPGFDELSTKVEILETGIKVVDLLAPYIKGGKIGLFGGAGVGKTVLIQELINNIAQEHGGISVFAGVGERTREGNDLYYEMSDSGVIKKTAMVFGQMNEPPGARMRVALSGLTMAEYFRDEEGQDVLLFIDNIFRFTQAGSEVSALLGRMPSAVGYQPTLATEMGQLQERISSTNKGSVTSIQAVFVPADDYTDPAPATTFAHLDSTTNLERKLTEMGIYPAVDPLASTSRALEPSVVGQEHYDVAREVQSTLQKYRELQDIIAILGMDELSDEDKQTVERARRIQFFLSQNFHVAEQFTGQKGSYVPVKTTVADFRDILDGKYDHIPEDAFRLVGSMEDVIEKAKDMGVEV

SEQ ID NO: 3898 - protein, 434 aa, Staphylococcus epidermidis
IMRMIDIIEKKRDGKSLTKEEIEFFVNGYTHEEVPDYQASSLAMAIFFQDMNDEERAALTMSMVNSGEKIDLSDINGIKVDKHSTGGVGDTTTLVLAPLVAAVGVPVAKMSGRGLGHTGGTIDKLESVKGFNVEISEKDFIKLVNDNQVAVIGQSGNLTPADKKLYALRDVTGTVNSIPLIASSIMSKKIAAGADAIVLDVKTGSGAFMKTLDDAEALAHAMVRIGNNVGRNTMAIISDMSQPLGNAIGNALELKEAIATLKGNGPKDLTELVLTLGSQMVVLAEQATSLDEARQMLIDAIKTGKALNKFKTFLSNQGGDDSIVDSPEKLPSAKYQVEFKAKKDGYITEIIANEIGVASMMLGAGRQTKEDVIDLGVGIVLNKKVGEHVEKGENILTIHTNTKEIDDILYKLDNSITIESKGEAPTLIHKIITE

SEQ ID NO: 3899 - protein, 353 aa, Staphylococcus epidermidis
IFLMKKVMTIFGTRPEAIKMAPLIKTLEKDSDLEPVVVVTAQHREMLDSVLNTFNISADYDLNIMKAGQTLSEVTSEAMKKLEDIIQKEVPDMVLVHGDTVTTFSGALAAFYSQTPIGHVEAGLRSYNKYSPYPEEINRQMVGVMADLHFAPTYNAAQNLVKEGKLAKHIAITGNTAIDAMNYTIDHQYSSSIIQKHKNKNFILLTAHRRENIGKPMINVFKAIRKLIDEYQDLALVYPMHMNPKVRDIAQKYLGNHPRIELIEPLDVVDFHNFAKQAYLIMTDSGGIQEEAPSLHKPVLVLRDSTERPEGVDAGTLRVIGTNEEDVYNETKKLIENPDLYQKMSQAVNPYGG

SEQ ID NO: 3900 - protein, 307 aa, Staphylococcus epidermidis
ISMIKYTLCEYNIRGGKMKKKALLPLFLGIMIFLAGCDYSTPEKQDGFFFNTFVQPMKHLLQWLGNDVFHNNFGLAIIVLVLFIRLILLPFMLSNYKNSHMMREKMKVAKPEVDGIQEKVKRARTQEEKMAANQELMEVYKKYDMNPMKSMLGCLPILIQMPIIMGLYFVLKDKLVNGLSEHPHFLWFNLTKPDIWITVIAGVLYFIQAVVSSKTMPQEQRQMGYMMMVISPIMIIWISLQASSALGLYWSVSALFLVIQTHFANIYYSKLAKKEVQPFIEKYEREHNPSSKKKGKNTQVVSKKNKK

SEQ ID NO: 3901 - protein, 69 aa, Staphylococcus epidermidis
ISVITANFMILSPFNVILLAYSNILCSIMLDINLKFIRILILYLYEKKGVLKICLIIINPDFKKQNHII

SEQ ID NO: 3902 - protein, 51 aa, Staphylococcus epidermidis
YLWIITLIHHHQLKPYPINKVGLTRTYYVIYQDVFQEYIIMIIMKRLLTNC

SEQ ID NO: 3903 - protein, 138 aa, Staphylococcus epidermidis
EVWIMNTLRLNIVTPNGSVYEREDVEMAVLQTTAGEMGIMYGHIPTVAALKTGHVKVNFHNGNEFIAVSDGFIEARQHQLSIIVQTAEPASEIDVERAKLAKSRAESHLEDDDDNTDINRAKRALERANNRLRVAELQ

SEQ ID NO: 3904 - protein, 68 aa, Staphylococcus epidermidis
YNNFWNQMEVLFMLSFNQNRNHSLEQSLKEGYAQMADLNLSLATEAFPIECEACDCNESHLISNSKNE

SEQ ID NO: 3905 - protein, 315 aa, Staphylococcus epidermidis
LNIVVRQKKKRLKKISCKVLFMRDISSIWHILMKNGNMGEITMNKPKIALTIAGTDPTGGAGVMADLKSFHACGVYGMATITSIVAQNTLGVQHIHNLESSWVKEQLDSVFDDELPQAIKTGMIATKKTMELIQSYLKEHSNIPYVIDPVMLAKSGDSLMDENTKNHLQSTLLPLADVVTPNIPEAEEITGIKINDEESIRKAGQIFINEIGSKGVVIKGGHSADLNNAKDFLFTKNETYTFENKRFDTKHTHGTGCTFSAVITAELAKGRSIKDAVKKAKEFISLSIEHTPEIGKGRGPVNHFAYMKKVGLDDE

SEQ ID NO: 3906 - protein, 43 aa, Staphylococcus epidermidis
RNNVFNMNSDTLTISYHSNINVVNLKIVLRIIPFPSKYQHQVL

SEQ ID NO: 3907 - protein, 303 aa, Staphylococcus epidermidis
YNDVEKNVHCCTQGGTLMPLVSMKEMLIDAKENGYAVGQYNLNNLEFTQAILEASQEENAPVILGVSEGAARYMSGFYTVVKMVEGLMHDLDITIPVAIHLDHGSSFEKCKEAIDAGFTSVMIDASHSPFEENVEITSKVVEYAHDRGVSVEAELGTVGGQEDDVVADGVIYADPKECQELVEKTGIDTLAPALGSVHGPYKGEPKLGFKEMEEIGASTGLPLVLHGGTGIPTKDIQKAIPYGTAKINVNTENQIASAKAVREVLNNDKDVYDPRKYLGPAREAIKETVKGKIREFGTSNRAK

SEQ ID NO: 3908 - protein, 54 aa, Staphylococcus epidermidis
GDLVDKVNKIAKLNKLFWETTDSVYKIHIIARLFHDVFVDNDYDRGLSNLSSDN

SEQ ID NO: 3909 - protein, 44 aa, Staphylococcus epidermidis
RLIVNNVKIQILFVNWDMIDYSNFFIKHYLIFLKNHTLIIQLPI

SEQ ID NO: 3910 - protein, 50 aa, Staphylococcus epidermidis
IFSVFSFKHLFNIKFIMFVYKKSTPKVKLKSNLWGVNTINMSQTFSNIIN

SEQ ID NO: 3911 - protein, 431 aa, Staphylococcus epidermidis
LIRVLSGGLKMDKIVINGGNRLTGEVNVEGAKNAVLPVLTASLLASEGHSKLVNVPELSDVETINNVLSTLNANVEYDKDKNAVKVDATKTLNEEAPYEYVSKMRASILVMGPLLARLGHAIVALPGGCAIGTRPIEQHIKGFEALGADIHLENGNIYANAKDGLKGAHIHLDFPSVGATQNIIMAASLASGKSIIENVAKEPEIVDLANYINEMGGKITGAGTDTITIHGVEKLYGVEHAIIPDRIEAGTLLIAGAITRGDIFVRGAIKEHMASLIYKLEEMGVDLEYYEEGIRVTANGDLNPVDVKTLPHPGFPTDMQSQMMALLLTANGHKVITETVFENRFMHVAEFRRMNANISVEGRSAKIEGKSHLQGAQVKATDLRAAAALILAGLVAEGTTQVTELKHLDRGYVNLHGKLKSLGANIERVNR

SEQ ID NO: 3912 - protein, 457 aa, Staphylococcus epidermidis
LLEVLVMINVTLEQIKNWIDCEIDEKHLKKTINGVSIDSRKINEGALFIPFKGENVDGHRFITQALNDGAGAVFSEKENKYSEGNQGPIIWVEDTLIALQQLAKAYLNHVNPKVIAVTGSNGKTTTKDMIESVLSTEFKVKKTQGNYNNEIGMPLTLLELDEDTEISILEMGMSGFHQIELLSHIAQPDIAVITNIGESHMQDLGSREGIAKAKFEITTGLKTNGIFIYDGDEPLLKPHVNQVKNAKLISIGLNSDNTYTCHMNDVKNEGIHFTINQKEHYHLPILGTHNMKNAAIAIAIGHELGLNETIIQNNIHNVQLTAMRMERHESSNNVTVINDAYNASPTSMKAAIDTLSGMKGRKILILADVLELGPNSQLMHKQVGEYLKDKNIDVLYTFGKEASYIHDSGKIFVKEAKYFDNKEQLIQTLISQVKPEDKVLVKGSRGMKLEEVVDALL

SEQ ID NO: 3913 - protein, 41 aa, Staphylococcus epidermidis
LKRVLHVLVLVPVCKLFKDLNQILITNTKFMSKGMMNNEND

SEQ ID NO: 3914 - protein, 46 aa, Staphylococcus epidermidis
FILSFNYTRAAFVNHKILIKGRFKYIAKAYNFNNYLINFICITTIL

SEQ ID NO: 3915 - protein, 42 aa, Staphylococcus epidermidis
NPISIILYIKSVGHQLCSHALKIFNRFYKFQMNLSQYLLFHI

SEQ ID NO: 3916 - protein, 50 aa, Staphylococcus epidermidis
TICSSVKSSALNTSGDEIPMLGLAKTTHAEGGLFRKVTCSPRPVHTAVWL

SEQ ID NO: 3917 - protein, 506 aa, Staphylococcus epidermidis
IDKSKFKGEKFMSEEMNDQMQVRRQKLQELIDLGIDPFGHRFNRSSTSSELKEQWDQFSKEELHEKEDESHVSIAGRLMTKRGKGKAGFAHIQDLKGQIQIYVRKDQVGDDQFNIWKMADLGDIIGVEGVMFKTNTGEISVKAKSFTLLSKSLRPLPDKFHGLQDIEQRYRQRYLDLITNEDSTQTFINRSKIIQEMRNYLNKQGFLEVETPMMHQIAGGAAARPFVTHHNALDATLYMRIAIELHLKRLIVGGLEKVYEIGRVFRNEGVSTRHNPEFTMIELYEAYADYHDIMDLTENMVRHIAQEVFGSAKVQYNDEEIDLESSWKRLHIVDAVKEVTGVDFYNVNSDEEAIRLAKEHDIEITENMKYGHILNEFFEQKVEETLIQPTFIYGHPIEISPLAKKNPNDERFTDRFELFIVGREHANAFTELNDPIDQRQRFEAQLVEKEQGNDEAHDMDEDYIEALEYGMPPTGGLGIGIDRLVMLLTDSPSIRDVLLFPYMRQK

SEQ ID NO: 3918 - protein, 64 aa, Staphylococcus epidermidis
RTRSSDFNGNVAKAGTDIKENDELIIRFGQKLVTVKVTGLSDHATKENAKGMYDLIKEERINEE

SEQ ID NO: 3919 - protein, 45 aa, Staphylococcus epidermidis
SRTLPGKYRIRCDEPNRDRKVSFFYTKIVLKNRFLGEEKVLGTYE

SEQ ID NO: 3920 - protein, 269 aa, Staphylococcus epidermidis
FKMPNVVGVQFQKAGKLEYYAPNQLDVKVGDWVVVQSKRGIEIGHVKFPLREVDVEDVTLPLKNIIRKMNEDDQETYYRNERDANDALELCKKVVKDQQLDMRLVNCEYTLDKSKVIFNFTADDRIDFRKLVKVLAQNLKTRIELRQIGVRDEAKLLGGIGPCGRSLCCSTFLGDFEPVSIKMAKDQNLSLNPTKISGACGRLMCCLKYENDYYEEARTQLPDVGDMIQTPDGHGKVIGLNILDISMQVKIEGLEQPLEYKMEEIEVLN

SEQ ID NO: 3921 - protein, 204 aa, Staphylococcus epidermidis
EMSTFITFEGPEGAGKTSVIKKVSERLAKEYDIVTTREPGGVLTSEEIRRIVLDGDSIDIRTEAMLFAASRREHLVEKIIPSLQAGKIVLCDRYIDSSLAYQGYARGIGIKEVKLLNEFAINGLYPDLTIYLDVDAEIGRQRILKNNREQNRLDKEEKAFHEKVIEGYQKVISDNPHRFIKVNANHSLDKVVEETYQSIIKYLK

SEQ ID NO: 3922 - protein, 46 aa, Staphylococcus epidermidis
CSLTRLDYLNSLSLSFIHKFLILSPRRETYFLELFLYKKKRPFGLD

SEQ ID NO: 3923 - protein, 50 aa, Staphylococcus epidermidis
  modified_base (42)..(42): Variable amino acid
MLSALIPSIHSYPAMAVGTTTGTPEGMFHPPVLFVTKDSSSXIFLRPTNG

SEQ ID NO: 3924 - protein, 198 aa, Staphylococcus epidermidis
RPTASISSIKMIHGAFFLAFSNKSRTRLAPTPTNISTKSDPLIEKNGAPASPATARANNVLPVPGGPTSKTPFGILEPICLNFLLSFKKSTISINSCFSSSAPATSEKRTRRLLLSYILALDFPKFIIRPPPPPPWAWLRKKINNNAMINTGISVVKILTNTLCFSSSLTVNLRLSCFLAVSVIFCKSFSLLYKIVDE

SEQ ID NO: 3925 - protein, 159 aa, Staphylococcus epidermidis
MVKAYLGLGSNIGNRELQLNEAIKILHDYQGIQVTQVSHIYETEPVGYTNQPKFLNLCIEIETELNPQSLLKCCLTTEQQLHRKREIRWGPRTLDIDILLFGDQIIEQDNLSVPHPRMKERSFVLIPLNDIATKQIEPISNKSIGQLVVPDNSVKKYKE

SEQ ID NO: 3926 - protein, 69 aa, Staphylococcus epidermidis
FINLLFHVFLLKTLGAIYCFLISFNLYLSLLLYPSYLHMYCYSMKVDIASNQSKSTHFIILQDHQNVIK

SEQ ID NO: 3927 - protein, 461 aa, Staphylococcus epidermidis
SVNFNGGLAFMQRHAIILAAGKGTRMKSKKYKVLHEVAGKPMVEHVLNNVKQAGVDQIVTIIGHGAESVKDTLGNQSLYSFQDKQLGTAHAVKMAHEHLADKEGTTLVVCGDTPLITYQTLQSLIEHHESTQSHVTVLSASTINPYGYGRIIRNHNGILERIVEEKDANDSERAIKEISSGIFAFNNRVLFEKLEQVKNDNAQGEYYLPDVLSLILKDGGKAEVYCTEDFDEIIGVNDRLMLSEAEKALQQRINRYHMENGVTIIDPSSTFIGTDVKIGIDTTIEPGVRIGGHTTIEEDVWIGQYSEINNSTIHSNANIKQSVINDSIVGENTTVGPFAQLRPGSNLGSEVKVGNFVEVKKADIKDGAKVSHLSYIGDAEIGERTNIGCGSITVNYDGANKFKTIVGKDAFIGCNTNLIAPVTVGNHTLIAAGSTITDNIPEDSLALARARQVNKEGYLKK

SEQ ID NO: 3928 - protein, 50 aa, Staphylococcus epidermidis
IKLYTTLVFTIRHFLQKIKLNVKKDSRTKVRTTNNPPFRRLLHYYMTNFY

SEQ ID NO: 3929 - protein, 298 aa, Staphylococcus epidermidis
KGDLTMTHDYIVRGLAYGGEIRAYAAITTESVQEAQTRHYTWPTASAAMGRTMTATVMMGAMLKGNQKLTVTVDGKGPIGRIIADADAQGNVRAYVDHPQTHFPLNDQGKLDVRRAVGTDGSIQVVKDVGMKDYFSGASPIVSGELGDDFTYYYATSEQTPSSVGLGVLVNPDNSIKAAGGFIIQVMPGATDETVTKLEEAISQMQPVSKLIEQGLTPEGILNEILGEGNVQILNSTSAQFECNCSHEKFLNAIKGLGEAEIHSMIKEDHGAEAVCHFCGNKYQYSESELEDLLETMK

SEQ ID NO: 3930 - protein, 40 aa, Staphylococcus epidermidis
PAPHLPINVTVACKCLFVRNSTNDSIIHVDVGYVKFNCKF

SEQ ID NO: 3931 - protein, 181 aa, Staphylococcus epidermidis
IIMHKDLKNVLLSEEDIQNICKEMGAIITEDYKDRPLVCVGILKGSVMFMADLIKRIDTHLSIDFMDVSSYHGGTESTGEVQILKDLGASIENKDVLIIEDILETGTTLKSITELLQSRKVNSLEIATLLDKPNRRKADIEAKYVGKKIPDEFVVGYGLDYRELYRNLPYIGTLKAEVYSK

SEQ ID NO: 3932 - protein, 138 aa, Staphylococcus epidermidis
SQFNIHVTDEWIIQIAYDKLIIMAKSEMDQYILDRICIRKPGTYEFNDYQIDIHPDLPQQLYPLTVRVRQNGDVYKLNGQKGHKKVSRLFIDKKVTLAERQRIPLIINQENAVLAIGDLYVKENFKEFILISNNGDEL

SEQ ID NO: 3933 - protein, 296 aa, Staphylococcus epidermidis
MEYKDIATPSRTRALLDQYGFNFKKSLGQNFLIDVNIINKIIEASHIDCTTGVIEVGPGMGSLTEQLAKNAKKVMAFEIDQRLIPVLKDTLSPYDNVTIINEDILKADIAKAVDTHLQDCDKIMVVANLPYYITTPILLNLMQQDVPIDGFVVMMQKEVGERLNAQVGTKAYGSLSIVAQYYTETSKVLTVPKTVFMPPPNVDSIVVKLMQRQEPLVQVDDEEGFFKLAKAAFAQRRKTINNNYQNFFKDGKKNKETIRQWLESAGIDPKRRGETLTIQDFATLYEQKKKFSELTN

SEQ ID NO: 3934 - protein, 47 aa, Staphylococcus epidermidis
EGYNKRLKYKLKLIRKQYIAPKVFNRKTWNNKLINQSSKERNLCQKK

SEQ ID NO: 3935 - protein, 321 aa, Staphylococcus epidermidis
MLNNEYKNSSMKIFSLKGNEPLAQEVADHVGIELGKCSVKRFSDGEIQINIEESIRGCDVFIVQPTSYPVNLHLMELLIMIDACKRASAANINIVVPYYGYARQDRKARSREPITAKLVANLIETAGANRMIALDLHAPQIQGFFDIPIDHLMGVPILAQHFENDPDINPEECVVVSPDHGGVTRARKLADILKTPIAIIDKRRPKPNVAEVMNIVGDIEGRTAIIIDDIIDTAGTITLAAQALKDKGAKEVYACCTHPVLSGPAKERIENSAIKQLIVTNSIQLEENRKPNNTKELSVAGLIAKAIIRVYERESVSVLFD

SEQ ID NO: 3936 - protein, 118 aa, Staphylococcus epidermidis
YNDKKRCIKMKMIIAIVQDQDSQELSDQLVKNNFRATKLATTGGFLRAGNTTFLCGVKDDRVDEVLSVIDNTCGNRDQLVSPITPMGGSADSYIPYPVEVEVGGATVFVMPIEAFHQF

SEQ ID NO: 3937 - protein, 293 aa, Staphylococcus epidermidis
MNIKTDGWSKKAHIVVAVSTGIDSMSLLYSLLNDYQHTYRKLTCVHVNHGLREQSYEEEAFLREYCHQHHIDIYIKRLDLSDIVADGNSIQQEARQRRYEWFGDIIAQLRADVLLTAHHLDDQLETIIYRLFTGRSTRNSLGMTYESYFNQYKVYRPMLNLKKTEILAYQYANQIPYYEDMSNQDRKYVRNDIRQRIIPAINENPHLNAHQLLKLKDWHDIELQSLKEQAETFINNEVSKSKYLTYSFSRTAFNELNVNIKSVVMDLLFQKLDCHLAMPQHAYDECFEQIRNE

SEQ ID NO: 3938 - protein, 43 aa, Staphylococcus epidermidis; identical to SEQ ID NO: 3838

SEQ ID NO: 3939 - protein, 135 aa, Staphylococcus epidermidis
QAMNKKVEHIGNQYTSQENKKKQRQKMKMRVVRRRIALFGGILLAIILILLVLLVIQRHNNDQDAVERKEKETEFQKQQDEEIALKEKLNNLNDKDYIEKIARDDYYLSNKGEVIFRLPDDKKSSQSKTSNEKGN

SEQ ID NO: 3940 - protein, 125 aa, Staphylococcus epidermidis
RRMNMNDIIFLNGMRFYGYHGVLAAENDIGQIFVVDITLKVDLSYAGQSDDVKDTVNYGEVYKDVKSIVEGPRSCLIEHLAERIAKHINSHYNRVMETKVRITKENPPIPGHYDGVGIEIVREND

SEQ ID NO: 3941 - protein, 626 aa, Staphylococcus epidermidis
SQVKSMIANYISEDNRFQELDEVFGQENILVTGLSPSAKATIIAEKYLKDHKQMLLVTNNLYQADKIETDILQYVDDSEVYKYPVQDIMTEEFSTQSPQLMSERVRTLTALAQGEKGLFIVPLNGFKKWLTPVDLWKDHQMTLKVGQDIDVDAFLNKLVNMGYRRESVVSHIGEFSLRGGIIDIYPLIGTPVRIELFDTEVDSIRDFDVETQRSNDNINQVEITTASDYIITDEVIQHLQNELKKAYEYTRPKIEKSVRNDLKETYESFKLFESTFFDHQLLRRLVSFMYEKPSTLIDYFQKNAIIVVDEFNRIKETEETLTTEVEDFMSNLIESGNGFIGQGFMKYESFDALLEQHAVAYFTLFTSSMQVPLQHIIKFSCKPVQQFYGQYDIMRSEFQRYVHQDYTVVVLVETETKVERIQSMLNEMHIPTVSNIHEDIDGGQVVVTEGSLSEGFELPYMQLVVITERELFKTRQKKQRKRTKTISNAEKIKSYQDLNVGDYIVHVHHGVGRYLGVETLEVGDTHRDYIKLQYKGTDQLFVPVDQMDQVQKYVASEDKSPRLNKLGGTEWKKTKAKVQQSVEDIADELIDLYKAREMSVGYQYVLDTAEQSAFEHDFPYELTPDQ

SEQ ID NO: 3942 - protein, 45 aa, Staphylococcus epidermidis
HIAKSFLHASFPPTSNNKTNKNCNTTLYIQASISTLVLHLQFCRF

SEQ ID NO: 3943 - protein, 701 aa, Staphylococcus epidermidis
RMQKAFRNVLVIAIIGVIIFGLFSFLNGNGNMPKQLTYTQFVNKLNKGDLKTLEIQPEQNVYMVSGKTKKDEDYSSTILYNNEKDLQKITDTAKKQDNLKFTVKEEEKQSVFVSILTTLIPVLIIALLFIFFLSQAQGGGGGGRMMNFGKSKAKMYDSNKRRVRFSDVAGADEEKQELIEIVDFLKDNKKFKQMGSRIPKGVLLVGPPGTGKTLLARAVAGEAGAPFFSISGSDFVEMFVGVGASRVRDLFENAKKNAPCIIFIDEIDAVGRQRGAGVGGGHDEREQTLNQLLVEMDGFGENEGIIMIAATNRPDILDPALLRPGRFDRQIQVGRPDVKGREAILHVHAKNKPLDETVDLKAISQRTPGFSGADLENLLNEASLIAAREGKNKIDMRDIEEATDRVIAGPAKKSRVISEKERNIVAHHEAGHTIIGMVLDEAEIVHKVTIVPRGQAGGYAMMLPKQDRFLMTEPELLDKICGLLGGRVSEDINFGEVSTGASNDFERATQIARSMVTEYGMSKKLGPLQFSSNSGGQVFLGKDMQGEPNYSGQIAYEIDKEVQRIVKEQYERCKQILLEHEEQLKLIAKTLLSEETLVAEQIQSLFYDGVLPEVDYDSAKVVKNENSDYSDGKYGKSYNDIRKEQLEDDDKEDDDNHEKDEVNQDNTDREADNTSHTNEPGHQQSPNIDKPYNPNDPNHRQ

SEQ ID NO: 3944 - protein, 242 aa, Staphylococcus epidermidis
WVSEEQVRRIQCLNLEIRKVEIRMASLKSIIRQGKQTRSDLKQLRNSGKVPAVVYGYGTKNTSVKVDEVEFIKVIREVGRNGVIDLGVGSKTIKVMVSDYQFDPLKNQITHIDFLAINMSEERTVEVQVQLVGEAVGAKEGGVVEQPLFNLEVTATPENIPETIEVDISELQVNDSLAVSDIKISGDFTIENNPEDSIVTVVPPTDEPSEEEVEAMEGESATEEPEVVGEDKEDDEEENKED

SEQ ID NO: 3945 - protein, 47 aa, Staphylococcus epidermidis
QSIEFLMSKIDFGILPHLTTHYILPYLSRFRQIKFKFYQCEGPLSTF

SEQ ID NO: 3946 - protein, 284 aa, Staphylococcus epidermidis
YRRDNMTTLYLVGTPIGNLGDITFRAIETLKKVDVIACEDTRVTRKLCNHYEIQTPLKSYHEHNKEQQTDYLIKQLQTGLNIALVSDAGLPLISDPGYELVVEARKNNINIETVPGPNAGLTALMSSGLPSFTYTFLGFLPRKEKEKIEVLEDRMFQNSTLILYESPYRVTDTLKAIAKIDSQRWITVGRELTKKFEQVLTLTVDDMLKLINHDKLPLKGEFVILIEGALPKSGESWFESYTVKEHVDYYIETKHVKPKKAIKFVATDRHMKTGDIYNIYHNID

SEQ ID NO: 3947 - protein, 319 aa, Staphylococcus epidermidis
IVKLKGVFWMAQKPVDYVTQIIGNTPVVKLRNVVDDDAADIYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEIHELTTGPELVEQFEGRQIDAFLAGVGTGGTLSGVGKVLKKEYPNVEIVAIEPEASPVLSGGEPGPHKLQGLGAGFVPDTLNTEVYDSIIKVGNDTAMDMARRVAREEGILAGISSGAAIYAAIQKAKELGKGKTVVTVLPSNGERYLSTPLYSFDN

SEQ ID NO: 3948 - protein, 40 aa, Staphylococcus epidermidis
NYFCIKKRDLSVSIRLIASYTIFAWQRPTLAERQSDYHRR

SEQ ID NO: 3949 - protein, 54 aa, Staphylococcus epidermidis
KTFCDAKSYLLSSFECIIIHLSGDNGKEVTPVPMPNTEVKLLSADGSRTDVPLE

SEQ ID NO: 3950 - protein, 116 aa, Staphylococcus epidermidis
PLNRNELFERLMKLEHHVEQLTTDMSELKDLTVELVEENVALQVENENLKRLMNKTEESVETHLDKDNYKHVKTPSPSKDNLAMLYREGFHICKGELFGKHRHGEDCLLCLNVLSD

SEQ ID NO: 3951 - protein, 62 aa, Staphylococcus epidermidis
QLKRITFGYYKNWTYSNGYSFNLNELCINNKRKLHNLMKMGINKDYNNKESEHIFNVQTHLK

SEQ ID NO: 3952 - protein, 288 aa, Staphylococcus epidermidis
SLLSKIIRIEGFEKMRYKRSERIVFMTQYFMNHPNKLIPLTYFVKKFKQAKSSISEDVQIIKNTFQNEKLGTIITTAGASGGVTYKPMMSKSEATEVVDEVIEQLQEKDRLLPGGYLFLSDLVGNPSLLNKVGKLIASIYMNEELDAVVTIATKGISLANAVANVLNLPVVVIRKDNKVTEGSTVSINYVSGSSRKIETMVLSKRTLAENSNVLVVDDFMRAGGSINGVMNLMNEFKAHVKGVSVLVESKEVKQRLIEDYTSLVRLSDVDEYNQEFKVEPGNSLSKFS

SEQ ID NO: 3953 - protein, 110 aa, Staphylococcus epidermidis
RYTRGAHYMKVTDVRLRKIQTDGRMKALVSITLDEAFVIHDLRVIEGNSGLFVAMPSKRTPDGEFRDIAHPINSDMRQEIQDAVMKVYDETDEVIPDKNATSDNEESDEA

SEQ ID NO: 3954 - protein, 265 aa, Staphylococcus epidermidis
YNLRIGEIMMLIDTHVHLNDEQYDEDLNEVISRAREAGVDRMCVVGFDTPTIERTMELIDKYDFIYGIIGWHPVDAIDCTDERLEWIESLSKHPKIIGIGEMGLDYHWDKSPSDVQKEVFKKQITLAKRVQLPIIIHNREATQDCIDILIEEHAEEVGGIMHSFSASPEIADVVINKLNFYVSLGGPVTFKNAKQPKEVAKHVPMDRLLCETDAPYLSPHPYRGKRNEPERVTLVAQQIADLRGMTYEEVCRQTTENAERLFNLN

SEQ ID NO: 3955 - protein, 94 aa, Staphylococcus epidermidis
CVVRWGNMPKSILDIKNSIDCHLGNRIVLKANGGRKKTIERSGVLKETYPSVFIVELDQDKHNFERVSYTYTDVLTENVQVSFEEDNHQEAVAH

SEQ ID NO: 3956 - protein, 535 aa, Staphylococcus epidermidis
HGKSKTMDRLLCGDVGYGKTEVAVRAAFKAVMDGKQVAFLVPTTILAQQHYETLLERMQDFPVEIQLVSRFRTAKEIRETKEGLKSGYVDIVVGTHKLLGKDIQYKDLGLLIVDEEQRFGVRHKERIKTLKKNVDVLTLTATPIPRTLHMSMLGVRDLSVIETPPENRFPVQTYVLEQNTNFIKEALERELSRDGQVFYLYNKVQSIYEKREQLQMLMPDANIAVAHGQMTERDLEETMLSFINHEYDILVTTTIIETGVDVPNANTLIIEEADRFGLSQLYQLRGRVGRSSRIGYAYFLHPANKVLNETAEERLQAIKEFTELGSGFKIAMRDLNIRGAGNLLGKQQHGFIDSVGFDLYSQMLEEAVNEKRGIKERSPDAPDIEVELHLDAYLPAEYIQSEQAKIEIYKKLRKVETEEQLFDVKDELIDRFNDYPIEVERLLDIVEIKVHALHAGVELIKDKGKSIQIILSPKATEDINGEELFKQTQPLGRAMKVGVQNNAMNVTLTKSKQWLDSLKFLVRCIEESMAIKDED

SEQ ID NO: 3957 - protein, 46 aa, Staphylococcus epidermidis
NKPGTLMIYCLRHFNVLLVNGKISNDCVMDYLKFIPYCSGGTATSY

SEQ ID NO: 3958 - protein, 323 aa, Staphylococcus epidermidis
VVFLHNEYHKGSKSLMDEQQQLANAYHSNKLSHAYLFEGDDAQTMKRVAIHFTKLILCNNSNQCELKVDTFNHPDFSYVSSDENTIKKEQIEQLVHHMNQLPIEGQYKVYIIEDFEKLTVQGENSILKFLEEPPDNTIAILLSTKPEQILDTIHSRCQHVYFKPIDKRQFIERLVEMSIARPVAEMLSTYTTQIEAASSLNEEFDLVTLRKSIIRWCQLILSNKAMALIGVIELLKQAKNRKLQLLTLSAVNGFFEDIMHAKIEMDNYYTFSDLTEEIENYANQLTFNQLILMYDQITEAHKKLNQNVNPTLVFEQIVIKGVI

SEQ ID NO: 3959 - protein, 86 aa, Staphylococcus epidermidis
KVFIMDKHFVYIVKCNDGSLYTGYAKDVNARVIKHNNGKGAKYTKIRRPVELVYQETYTTKSEALKREYEIKTYTRQQKLKMIQEG

SEQ ID NO: 3960 - protein, 61 aa, Staphylococcus epidermidis
LVIIHLLLANMKSIAHTCLLSIITMRDDNNIFTKSLKMYWYKLYIKKSLFTQFIREQKETY

SEQ ID NO: 3961 - protein, 281 aa, Staphylococcus epidermidis
EYIIEKGEIMIKTKIMGILNVTPDSFSDGGQYHSVDQAVKRAKEMIDEGVDIIDVGGVSTRPGHKEVSHKEVSLKEEMNRVLPVVESIVKYDVQISVDTFRSEVAEACLKLGVSMINDQWAGLFDSNMFNVVSQYGAEIVLMHNGDGHRDKPVVEEMLVSLLAQANKAELAGIPHNKIWLDPGIGFAKTREEENEVMARLDELVATEYPVLLGTSRKRYIKEMMNQDSSPSDRDEATAATTAYGIMKGVRGVRVHNVLLNTRLAQSMDFLKENEYERHHLS

SEQ ID NO: 3962 - protein, 47 aa, Staphylococcus epidermidis
TIAIIIFIFIHLFLSLYHNYFKYLMIDWYVSSTTLSKLWLALTLINR

SEQ ID NO: 3963 - protein, 201 aa, Staphylococcus epidermidis
RYIILIVEVTIMKCIVGLGNIGKRFELTRHNIGFEVVDDILERHQFTLDKQKFKGAYTIERLNGEKVLFIEPMTMMNLSGQAVAPLMDYYNVDVEDLIVLYDDLDLEQGQVRLRQKGSAGGHNGMKSIIKMLGTDQFKRIRIGVGRPTNGMSVPDYVLQKFSKEEMIIMEKVIEHSARAVESFIESSRFDHVMNEFNGEVK

SEQ ID NO: 3964 - protein, 134 aa, Staphylococcus epidermidis
KMSIEVGNKLKGKITGIKKFGAFVELPEGKSGLVHISEVADNYVENVEDHLSVGDEVEVKVLSIADDGKISLSIKKAKDRPRKPRHSKANHGKPVQKTEDFEKKLSNFLKDSEDKLTSIKRQTESRRGGKSSRR

SEQ ID NO: 3965 - protein, 182 aa, Staphylococcus epidermidis
FMKINEFIVVEGKDDTERVKSAVDCDTIETNGSAIDTYTLEVIQHAQQTRGVIVLTDPDFPGDKIRNTIREHVSGVKHAYVDREKAKSKRGKIGIEHANIKDIQEALMHVSSPLEEAKETIDKSVLIDLGLIIGKDARYRRNILGRKLHIGHSNGKQLLKKLNAFGYTEDDVRKALFEEEEN

SEQ ID NO: 3966 - protein, 58 aa, Staphylococcus epidermidis
LNWIERLTTDQEVMGSTPIGRAILCIDLIYIREVAQLGRALGLGPRGRRFESCLPDFF

SEQ ID NO: 3967 - protein, 426 aa, Staphylococcus epidermidis
CIRIQRNKALTFWRQIISNEERKTVMTHTITIVGLGNYGIDELPLGIYRFLEKESKVYARTLNHPVINTLKKEIEFESFDSIYEAHDRFEDVYEAIVTSLIELAQSEDIVYAVPGHPRVAETTTVKLLEYSHFNKDISVKVLGGKSFIDDIFEAVDVDPNDGFTLLDGTSLKESALNVRTNTVITQVYSVMIAADLKLTLMERYPDDFNVKIITGSHSDGAHVIECPLYEIDRYDDYFNNLTSLFIPKINEDTLLYQDFDYAVQTIDLLVDNEKGCPWDKVQTHDSLKRYLLEETFELFEAIDNEDDWHMIEELGDILLQVLLHSSIGKKEGYIDIKEIIESLNTKMIHRHPHIFGNAHVTSQEDLKDIWSRAKEKEGKVPRVKFEKVFADHFLKLYDKTKNRQFDEDISNNFYNKERKFMRLDKY

SEQ ID NO: 3968 - protein, 180 aa, Staphylococcus epidermidis
ERGMTLIIRALEKTDLSFIHHLNNEYSIMSYWFEEPYQSLSELENLYTKHILDETERRFIVEEGSTSVGVVELLEINFIHRTCEVLIIIDPQYANNGYAKKAFKMAIDYAFLVLNMNKVYLYVDIKNEKAVHIYQSNNFEIEGTLKEHFYTRGEYRDCYVMGLLKRNWVNKNDDDLSHIR

SEQ ID NO: 3969 - protein, 60 aa, Staphylococcus epidermidis
YFNFSIASTILSILKCIILCLLSVNINYLNSFNQFITFLNCYFESTLNLRTVHYTNILIN

SEQ ID NO: 3970 - protein, 299 aa, Staphylococcus epidermidis
RLYVKIILITIQSEGGKMIYETAPAKINFTLDTLFKRDDGYHEIEMVMTTVDLNDRLSFEKRTDNKIVVDIEHNYVPNDNKNLAYKAADLMFERFNINEGVTISIDKDIPVSAGLAGGSADAAATMRGLNRLFGLGQSLDALAALGIQIGTDIPFCIYNQTAVCTGRGEQVTFLKRPPSAWVVLAKPNIGISSPDVFKALDLTEEHIVHNEKCKQALENNDYHLLCNSLSNRLEPVSMAMHPDIKKIKDNMLQCGADGALMSGSGPTVYGLAQKERQAKNIYNAVNGCCNEVYLVRLLG

SEQ ID NO: 3971 - protein, 133 aa, Staphylococcus epidermidis
KRSVKFIMKIINSDKVPEALGPYSHATVINGFVFTSGQIPLTLDGTIVSDDVQEQTKQVLENLTVVLKEAGSDLNSVVKATIYISDMNDFQQINQIYGNYFVEHQPARSCVEVSRLPKDVKVEIELIGKVKEL

SEQ ID NO: 3972 - protein, 660 aa, Staphylococcus epidermidis
GGPVMAKDTFYITTPIYYPSGNLHIGHAYSTVAGDVIARYKRMQGYDVRYLTGTDEHGQKIQEKAQKAGKTELEYLDEMISGIKNLWSKLEISNDDFIRTTEERHKQVVEKVFERLLKQGDIYLGEYEGWYSVPDETYYTESQLVDPVYENGKIVGGKSPDSGHEVELVKEESYFFNINKYTDRLLEFYDENPDFIQPPSRKNEMINNFIKPGLEDLAVSRTSFDWGVRVPSNPKHVVYVWIDALVNYISSLGYLSDDETLFNKYWPADIHLMAKEIVRFHSIIWPILLMALDLPLPKKVFAHGWILMKDGKMSKSKGNVVDPNVLIDRYGLDATRYYLMRELPFGSDGVFTPEAFVERTNYDLANDLGNLVNRTISMINKYFHGELPAYQGPKHELDEKMEAMALETVKSFNDNMESLQFSVALSTVWKFISRTNKYIDETQPWVLAKDENQREMLGNVMAHLVENIRFATILLQPFLTHAPREIFKQLNINNPDLHQLDSLQQYGMLSEAITVTEKPTPIFPRLDTEAEIAYIKESMQPPKSIKQSDEPGKEQIDIKDFDKVEIKAATIIDAENVKKSEKLLKIKVELDNEQRQIVSGIAKFYRPEDIIGKKVAVVTNLKPAKLMGQKSEGMILSAEKDGVLTLISLPSAIPNGAVIK

SEQ ID NO: 3973 - protein, 49 aa, Staphylococcus epidermidis
ILKVSRLVKRRTLAKEISEQGRVTSMEMWQKQVQISKKTMNSLFVLDKN

SEQ ID NO: 3974 - protein, 52 aa, Staphylococcus epidermidis
LSLVEHLVWDQGVAGSNPVFPTSFDIGGLAQLGERLLCTQEVSGSIPLVSTI

SEQ ID NO: 3975 - protein, 249 aa, Staphylococcus epidermidis
HPFFRSKDMLEDNERVDHLIKEGYEIIQNDEVFSFSTDALLLGYLTEVRKNDKVMDLCSGNGVIPLLLAAKSTQPIEGIEIQEQLVSMARRSFKLNDLNDRLTMHHMDLKDVYQTFQPAQYTLVTCNPPYFKMNQNHQHQKEAHKIARHEIMCNLKDCIEAARHLLKEGGRFIMVHRAERLMDVLTELRHGKIEPKALTLVYSKHDKPAQTIVVEGRKGGNQGLDIRNPLYIYNEDGSYSDEMKGVYYG

SEQ ID NO: 3976 - protein, 524 aa, Staphylococcus epidermidis
LDVLKKVWRLKMKTKSETAFNGVVILTLALIIVKILSAIYRIPYQNVLGDDGLYAYQQIYPVVALGVILSMNAIPSAVTQVIGVNRSDEVYTRVMFRLQCIGFIVFILLFMFANMITRWMGDSNLAPMLKMASFSFILIGVLGVLRGFYQSKQVMTIPAISQVIEQVIRVSLIIVAIIMFSMKHWSIYQAGALAILASSIGFLGSMLYLLLKKPLKLKLCYRFNNTSIQWKQLFISISIFALSQLIVILWQVVDSFTIIRLLQHSGIAFKEAIIQKGIYDRGASFIQMGLIVTTTFSFVLIPLLTQAIREHNQIHMNRYANASIKITVVISTAASIGLINLLPLMNVVFFKSNHLTLTLSIYMFTVICVSLIMMNISLLQVQTSIRPIIMGVIIGILSKIILNVILIPFWGIVGASVSTVLSLLLFVIILQVAVLKYYRFNRISLFIVKLILGMIIMSIVVQTVMLALPSKSRMLGLLELIVSSIIGIVIIMLYIVIFNVLGYKEIKHLPFGDKLYQMKRGRRS

SEQ ID NO: 3977 - protein, 456 aa, Staphylococcus epidermidis
DEKLNLERVINMKRPIIQKLNHLIEKKAISMHVPGHKNMTIGYLNRLDLAMDMTEITGLDDMHYPEGIILESMENFRKHKNYDAFLLVNGTTSGILSVIQAFSTRKGKYLISRNVHKSVFHGLDITQQQATITKTDVSKKTNQYVNPKINQDKNQYYKLAICTYPNYYGETFDISQYIKQLHHRGIPILVDEAHGAHFGLDGFPESSMNFNADYVVQSYHKTLPALTMGSVIYIHKDAPLRQQVIDYLTYFQTSSPSYLIMSSLELANKFYKEYDSTLFDQRRKMLIDLLVNMGFTVIEPEDPLKLVVSFEGVEGYDVQKWFEDKEIYVELADMYQVLLVLPLWHEGDKFPFKLLIEKIREINVPKKCTRDIKPLNFMTGFSEYKTVHFQNTKEVSIKRAEGKVLAQHIVPYPPGIPVMFKGEVVTSHMIDLLNKYDKQNIKVEGLNHKKILVKDE

SEQ ID NO: 3978 - protein, 41 aa, Staphylococcus epidermidis
SATSCAKGSFPLSEKIFIDEFLYSLFNIYSPPIIYLDIYII

SEQ ID NO: 3979 - protein, 59 aa, Staphylococcus epidermidis
SCCSIPPVLLIFLPRRLLSVSPPHFLYFAIHSPSDTLFLLLNYIVTGSNHLHNTPIHFS

SEQ ID NO: 3980 - protein, 50 aa, Staphylococcus epidermidis
SLAFFHLIIKKMVRHIAINQFKNFINLDKLLSPKKNQLLILERYPNYDFP

SEQ ID NO: 3981 - protein, 122 aa, Staphylococcus epidermidis
IKEFSIMKNKKGLGIGLITIMIIVCIVLVIMMFVGGKKESYYGIMKDSTTIDKMINTKNEKIEKNVELPKDANVSVKKEDFVMLFKDEKTGKITKVKKVNHDDVPHGLMSKIHDMGNMKHGM

SEQ ID NO: 3982 - protein, 703 aa, Staphylococcus epidermidis
YTMTCFLNIYKEYHSPPERNINRIILMFSLTNDLKITINGETKDLGNHIAIINQSDIYFINSASNLVLLSIPVIYFYSKDNKFFKCYFDRHLLQSSSFVKTIILQAIQHLIKGENQDEQSISKIIQTLLKEAVIRYKKKYIPQIAVNHSVFTEGLTFIHSKVSQSLSLREVAQHCNISESYCSNLFARYLNMNFKDYFTSLKVIDSIKRLLSSEDSINAISEQSGFSSHTNFTNQFKNYLGCSPKQYRTIISKLDSLPSISFSDTDFSQYIDLINQFEFSDHLATETTERDINEFYPQDQTKNSKAFIRFQNFNELFQFVFNEYYNIDFTSLPQAVIFINDITDISTREVNFNLLNRCFEKLFEKNIGLAMRLTSTNEFESIKEIILLFLNSHQDYKMNKKMVKFMLVFETKNMSVNDIHLCHLKIKNKNKAIRYSITVEGLLHQNSSIDRTYDMMKRLNFDYYFIDIENLETKNSLITKRKSYLHSSTHFENYKQFILDSGIPSTKFVYNNLSLKCFKYTNNGTYPLQLSDLVCHLVALMRYGGGVSYQLIEDESPFIALFNRYGSPLPLMHLYKLIEPFLNEPLEIANNFLMSRKDGNYHFLLFNKINDRYLSDSQQRYVFKNTLSTNSLIIIKTLNHEHGAIQNLLPQTKQQFYIERSILDELDKSNQPKTELAIQHDHHLPFQVTLKHDEVKYICFKPS

SEQ ID NO: 3983 - protein, 49 aa, Staphylococcus epidermidis
VLNNDTSNMLSLVMVDISFIVLSINVEMSSVHLVTVTSFYNSFELLLNL

SEQ ID NO: 3984 - protein, 46 aa, Staphylococcus epidermidis
NNIKIYRIIIILDYDAVIYCLFIVIHIIKLYFINFIFFILQYIIAK

SEQ ID NO: 3985 - protein, 155 aa, Staphylococcus epidermidis
IMCDKDIYNNKEMIILNKQQVTKAIEKVLNSSKIGVLSTAHHNKPNSRYMVFYNDDLNLYTKTNINSLKVEEIENNPDAHILLGYNETTNNSFVEIDATIEVVKNQKVIDWLWETQDKTFFNSKEDPELCVLKVIPRSIKLMNDDELDTPATIEL

SEQ ID NO: 3986 - protein, 43 aa, Staphylococcus epidermidis
DLCLILFYFSLLKTPLSILIHLYIILSHFAIIYCSIKKIKFIK

SEQ ID NO: 3987 - protein, 431 aa, Staphylococcus epidermidis
RGVCIMALFKKKISLPTQVIIALVLGVIAGLLLYGQDDVANYIKPFGDVFLNLIKMIIIPIVFCSLALSISNLGDSKKVGSYGWKAILYFEIITTIAIGLGLIIGNLFKPGSGLDPDKLPKGDITKYQSSAHSAEQATTYGNHFIDTLVHIVPTNLFESMAKGELLPIIFFAVFFGLGLAAIGEKAEPVKGFLNGTLEAVFWMINKILKLAPIGVFAFICTTVMTFGASALIPLFKLLVVVVFAMVFFVIVVLGIVARMVGISIFSIMKILKSELLLAFSTSSSEAVLPIMMKKMERFGSPKDVTSFVIPIGYSFNLDGSALYQSIAALFVAQMYDIHLSLTEQLVLMATLMIASKGMAGVPGVSIVVLLTTLTSMNITAQGLALIIGIDRLLDMVRTCVNVIGNALSTVVIAKWENVYDKEKGQNYLNSI

SEQ ID NO: 3988 - protein, 48 aa, Staphylococcus epidermidis
WLLCIFEKMQTEAKQSMIVSGSYAFLKNVNRSKTIYDSKWLLCIFEKM

SEQ ID NO: 3989 - protein, 125 aa, Staphylococcus epidermidis
LKERGKIEKLWREEKYRVLFHDQNAYHSIRTLLKSPTTLGEVKEHITHALTITPTKGSVINAFEHMWGYFKKQCTQYEKQHSRELKALYIENQIDYFELLSFLKNLADKYAVEYLQQSTILNITK

SEQ ID NO: 3990 - protein, 104 aa, Staphylococcus epidermidis
SGRLTPALRGAQGARHESGAWALNFTSQMLGRTGSQRLTEWDRTPNPGLLGRRGGDRRPGGYKTVLLIKRDIREQAIDAEGPPGDEDGSELGLHSQPGVGAKRV

SEQ ID NO: 3991 - protein, 42 aa, Staphylococcus epidermidis
VEKSQTSYSTKKGLYYKEVVFKDEPNVTYVIQPISTSKRNIH

SEQ ID NO: 3992 - protein, 50 aa, Staphylococcus epidermidis
QINMLSSTYNKVPYSILQNEVTKSFNNYISSGKHEYVKQIFIYMSILVLK

SEQ ID NO: 3993 - protein, 45 aa, Staphylococcus epidermidis
IGRVGAQFYITDVGANWVPTAHRMGPHTQPGAIGAEGRGQETGGV

SEQ ID NO: 3994 - protein, 43 aa, Staphylococcus epidermidis
HTIFFFTPQFFYFSAFFQLNPLQSDIDLTADVKASLIFFKKNE

SEQ ID NO: 3995 - protein, 329 aa, Staphylococcus epidermidis
KVSSMLKLNPYKIGFRTVKTAVGMTLGVIICKLLGLDNYASSAILVVLCIKHTKMHSVQAILSRLVSCLLILFLGSAIFSLLGQHAFVLGLIVLLFIPLTVVLNVQEGVITSCVILLHVFNAKAINGHLILNEIMLLIVGLGIAFLMNLMMPSLDKKLNHFKQDIENQITEIFNIFSQACSMHNDHLNIKFDSLLLNIKKAKSLAFRDVKNHFVRNENSFYHYFDMREEQVELLKRMTSLLERINTDDPILEKISQLMYEIGSNVNSNDYTALRLHSLYEIRLSLDDLPLPTTHKTLNSRAHIIQILNELEEYLNIKSQFGSLKLHSEI

SEQ ID NO: 3996 - protein, 411 aa, Staphylococcus epidermidis
QFYSFIRCYNYVVYKEAYKMTEEFNESMINDIKEGDKVTGEVQQVEDKQVVVHINGGKFNGIIPISQLSTHHIENPSEVVKVGDEVEAYVTKIEFDEENDTGAYILSKRQLETEKSYEYLQEKLDNDEVIEAEVTEVVKGGLVVDVGQRGFVPASLISTDFIEDFSVFDGQTIRIKVEELDPENNRVILSRKAVEQLENDAKKASILDSLNEGDVIDGKVARLTNFGAFIDIGGVDGLVHVSELSHEHVQTPEEVVSVGEAVKVKVKSVEKDSERISLSIKDTLPTPFENIKGKFHEDDVIEGTVVRLANFGAFVEIAPSVQGLVHISEIDHKHIGSPNEVLEPGQQVNVKILGIDEDNERISLSIKATLPKENVIESDASTTQSYLEDDNDEDKPTLGDVFGDKFKDLKF

SEQ ID NO: 3997 - protein, 63 aa, Staphylococcus epidermidis
IVHSVYQLDILDKLPFINQMISVNISIPFSNCFLVMVNGGNNLITFLPAVKMINPIRLASRTT

SEQ ID NO: 3998 - protein, 53 aa, Staphylococcus epidermidis
IQISSWLNIRKVTAQRAENHQKNYKKDNSYIISIEIVFIYLSWTFLFQPLVNF

SEQ ID NO: 3999 - protein, 40 aa, Staphylococcus epidermidis
GKSSWLPYFFEFIANYHKINCTILLKFKQGIIFHSIIKTR

SEQ ID NO: 4000 - protein, 61 aa, Staphylococcus epidermidis
SNPSTSIIINKDSSHYSKMLTRIAISCHTNERTSSSQRFSYYRIDELNLIDGDSNYTGARL

SEQ ID NO: 4001 - protein, 109 aa, Staphylococcus epidermidis
GVTSMKTLKLLKKTRAFTLIEMLLVLLIISLLLILIIPNIAKQTSHIQSTGCDAQVKMVNSQIEAYALKHNRNPSNIDDLVSDGFIKEGQKTCKSGQTISIANGEAVAN

SEQ ID NO: 4002 - protein, 297 aa, Staphylococcus epidermidis
KEGLKMPQRVLLVDGMALLFRHFYATSLHNQFMYNSKGIPTNGIQGFVRHIFSAIKEIEPTHVAVCWDMGQETFRNEMYDGYKQNRPAPPDELIPQFDYVKEISHQFGFVNVGKRNYEADDIIGSLAETYSQEHEVYIITGDRDLLQCINHNVEVWLIKKGFTIYQRYTLDRFIDEYGLNPQQLIDVKAFMGDTADGYSGVKGIGEKTAIKLIQNHGTVENVVNNLSSLTPAQQKKITNNLNHLHLSKSLAEIYTKVPIETDKLFKEMTYAHTLNEILSICNEHELYVSSKYIATHL

SEQ ID NO: 4003 - protein, 43 aa, Staphylococcus epidermidis
IHLSLYHRLTLLSDSKVNLVKKISILMVITSFWCLFTVFCQMS

SEQ ID NO: 4004 - protein, 531 aa, Staphylococcus epidermidis
LIMSKIYCIKVIKTLLYQRYIEVTGYKDESEKDKMDKQERYNRRENIRNFSIIAHIDHGKSTLADRILENTKSVETREMQDQLLDSMDLERERGITIKLNAVRLKYEAKDGETYTFHLIDTPGHVDFTYEVSRSLAACEGAILVVDAAQGIEAQTLANVYLALDNDLELLPVVNKIDLPAAEPDRVKQELEDVIGIDQEDVVLASAKSNIGIEEILEKIVDVVPAPDGDPEAPLKALIFDSEYDPYRGVISSIRIIDGVVKAGDRIKMMATGKEFEVTEVGINTPKQLPVEELTVGDVGYIIASIKNVDDSRVGDTITLAERPADKPLQGYKKMNPMVFCGLFPIDNKDYNDLREALEKLQLNDASLEFEPESSQALGFGYRTGFLGMLHMEIIQERIEREFGIELIATAPSVIYQCILKDGSEVSVDNPAQMPERDKIEHIYEPFVKATMMVPNDYVGAVMELCQRKRGQFINMDYLDDIRVNIVHEIPLSEVSFSISLINLNLTQKGMLLLIMNLLRIKKVILLKWTYY

SEQ ID NO: 4005 - protein, 248 aa, Staphylococcus epidermidis
RIRSGSILVMNQYEDMSLVYDKLTQDQPYHSWFNIVEHFLPSDSHDLLDIGCGTGNLTQLLTSLGEVTGMDISVDMLSIARQKTNQVKWIEGNMTHFNLNKKFNMITIFCDSLNYLETLNDVKMTFERVYQHLNKNGVFIFDVHTVHKMKTLFNNKSYIDESDNVFVGWDAICGDEPLSVYHEMTFFVSQQNGLYQRFDESHYQRTYEEQIYRNLLKDVGYHSVKTFTDFNIHSHEEDAHRLFFVAKK

SEQ ID NO: 4006 - protein, 43 aa, Staphylococcus epidermidis
DSRSLTSRNYIERESLILLNFQLSYHLKLLSKCLRQSMLSQAF

SEQ ID NO: 4007 - protein, 57 aa, Staphylococcus epidermidis
ELYPRLIELKIYIYYYPEPSLESTSMIFKFDFPHLVNYLISTILTFISPPLGSGTRT

SEQ ID NO: 4008 - protein, 40 aa, Staphylococcus epidermidis
KTFPPHTSCSFGLVIFNYPLLYARKRLTLRNDVSIKAVDL

SEQ ID NO: 4009 - protein, 226 aa, Staphylococcus epidermidis
FFVFNINRRYIDFFMKWKLYILIILIMLTTFFFYLLNDNNNDLIQNSQERQSKISDQQIKNSKKLNKKEVSIQKDNTKETKIFIDIKGAVKHPNVYEMSSSNRVIDALNKAEVLKDADLSQLNLSEKLVDQKLIYVPKKGENSMKINSQQSTLNSSDVKINTNQPLNLNSATEEQLKNIPGIGPSKAKEILNYREQNHGFNSIDDLMKIKGFGKKTFEKLKEHFTI

SEQ ID NO: 4010 - protein, 46 aa, Staphylococcus epidermidis
VKVLEHLWKETKKQNKECNITFYERMLKNFVINRIKPTFLLHKSLR

SEQ ID NO: 4011 - protein, 155 aa, Staphylococcus epidermidis
FEVLIVPKKSVRHIKIREIISNEQIETQDELVKRLNEYDLNVTQATVSRDIKELQLIKVPAPTGQYVYSLPNDRRYHPLEKLGRYLMDSFVNIEGTGNLLVLKTLPGNAQSIGAILDQIDWDEVLGTICGDDTCLLICRDEEASEEIKTRIFNLL

SEQ ID NO: 4012 - protein, 314 aa, Staphylococcus epidermidis
IRQLKCIERRLDMQKNILKSGIEISELGLGCMSLGTDYKKAQPIIESAIDNGITYFDTADIYDQGVNEEIVGKALKKYQNRDDIVIGTKVGNRLTDDGHMTWDPSKKHIKESVKGSLKRLGLNHLDLYQLHGGTIDDPLDETISAFDELKQEGYIRAYGISSIRPNVIDYYLKNSQIETLMSQFNLIDNRPESLINDVHDKQVKILARGPVFKGLLTSKSVDVIDEKFKNGVLDYTQDELGSTIASIKELESNLTALSFKYLTSHDAMGSIIVGASSVEQLEENVRNYYKEISLDQIKSARNRVKDIEYTQHLK

SEQ ID NO: 4013 - protein, 47 aa, Staphylococcus epidermidis
LFKFENIGIKIIVIVLTIKKASNASIIKDPLNLYFDKSQTPLFNMED

SEQ ID NO: 4014 - protein, 467 aa, Staphylococcus epidermidis
GEAFMVKNMDTIVQLAKHRGFVFPGSDIYGGLSNTWDYGPLGVELKNNIKKAWWQKFITQSPYNVGIDAAILMNPKTWEASGHLGNFNDPMIDNKDSKIRYRADKLIEDYMQNEKGDENFIADGLSFDEMKKIIDDEGIVCPVSKTANWTDIRQFNLMFKTFQGVTEDSTNELFLRPETAQGIFVNYKNVQRSMRKKLPFGIGQIGKSFRNEITPGNFIFRTREFEQMELEFFCKPGEEIEWQNYWKTFASEWLTDLNISEDNMRLRDHDEDELSHYSNATTDIEYKFPFGWGELWGIASRTDYDLRQHSEHSGEDFKYHDPETNEKYIPYCIEPSLGADRVTLAFLCDAYAEEGVEGSKDARTVMHFHPALAPYKAAVLPLSKKLSSEAIKIFEQLSSSFAIDFDESQSIGKRYRRQDEIGTPYCITFDFDSLEDNQVTVRDRDSMEQVRMPISELETFLAEKVKF

SEQ ID NO: 4015 - protein, 42 aa, Staphylococcus epidermidis
SGFTSFCSATATAAGRANPAAQPHVELITTNVVSSLSIFCIY

SEQ ID NO: 4016 - protein, 81 aa, Staphylococcus epidermidis
FVHTCSYVGFSTCPPLYPETTDFIPGYEVKGLTMHQKQPPASVAYAMLYSLLKLSVCLNLRYIVGNLKYLTQNHSCDFVTT

SEQ ID NO: 4017 - protein, 495 aa, Staphylococcus epidermidis
GCDTMNDHQKNHATSQDDNTKSTPSKNSKHIKIKLWHFILVILGIILLTSIITVVSTILISHQKSGLNKEQRANLKKIEYVYQTLNKDYYKKQSSDKLTQSAIDGMVKELKDPYSEYMTAEETKQFNEGVSGDFVGIGAEMQKKNEQISVTSPMKDSPAEKAGIQPKDIVTQVNHHSVVGKPLDQVVKMVRGKKGTYVTLTIKRGSQEKDIKIKRDTIHVKSVEYEKKGNVGVLTINKFQSNTSGELKSAIIKAHKQGIRHIILDLRNNPGGLLDEAVKMANIFIDKGNTVVQLEKGKDKEELKTSNQALKQAKDMKVSILVNEGSASASEVFTGAMKDYHKAKVYGSKTFGKGIVQTTREFSDGSLIKYTEMKWLTPDGHYIHGKGIRPDVSISTPKYQSLNVIPDNKTYHQGEKDKNVKTMKIGLKALGYPIDNETNIFDEQLESAIKTFQQDNNLKVNGNFDKKTNDKFTEKLVEKANKKDTVLNDLLNKLK

SEQ ID NO: 4018 - protein, 203 aa, Staphylococcus epidermidis
HLITNITTGLKDVVEVTFNQITVDGDTSTNDMVLVMSNGCTNNNEIKKDSEDYYKFKQMLLYIMTDLAKSIARDGEGASKLIEVTVKGAKESSAARMIAKSVVGSSLVKTAIFGEDPNWGRIIAAAGYAKTYFDINQVDIFIGRIPVLIRSSPVKYDKEEIQEIMSAEEISIQLDLHQGNCEGQAWGCDLSYDYVKINALYTT

SEQ ID NO: 4019 - protein, 355 aa, Staphylococcus epidermidis
PMNTLILLTKRGNNLNIEDFDYHLPESLIAQTPLKNRDQSRLLVLSKDTGELTHLHFRDVIHYFEPGDTLVLNDTRVMPARLFGLKEETGAKVEMLMLTQIEGNDWEVLLKPAKRIKKGHRLNFGDGKIVAECIEELEQGGRIMRLHYEGILQERLDELGEMPLPPYIKERLDDPDRYQTVYAKESGSAAAPTAGLHFTDDLLNKIKQKGVHIAFITLHVGLGTFRPVSVENIDDHEMHSEYYQMTQETADLLNKTKESGKRVISVGTTSTRTLETIRRDHPQFVATSGWTDIFIYPGFEFKAIDGLITNFHLPKSTLVMLVSAFSNKKYILNAYHKAVEMEYRFFSFGDAMLII

SEQ ID NO: 4020 - protein, 58 aa, Staphylococcus epidermidis
TKLTRCLMYKDYNMTQHTLLMETSVLIPTNDISRHVNDIAETIPDTEFDEFRYHRGLI

SEQ ID NO: 4021 - protein, 49 aa, Staphylococcus epidermidis
MKVTHQFVVEWMSPTFEIDVRQVESSHGYNHLIVGAMSSNHLVIIQEFD

SEQ ID NO: 4022 - protein, 91 aa, Staphylococcus epidermidis
RGVTKMELTSLIIPILLLVVMYFLLIRPQQKRAKEHRAMINRVEAGQKITTIGGIKGTIKAVDETSVIITVNSNGTEMTFEKPAIKQVDPS

SEQ ID NO: 4023 - protein, 330 aa, Staphylococcus epidermidis
KVMTDIILAADIGGTTCKLGIFDKDLEQLHKWSIDTDTSDHTGELLLKNIYNSFTEKIAEYKYDFNNVVGVGIGVPGPVDFDTGVVYGAVNLHWPDSVNVREIFKQYVNCPVYVDNDANVAALGEKHKGAGEGADDVVAITLGTGLGGGIISNGEIVHGHNGSGAEIGHLRADFDQRFQCNCGKSGCIETVASATGVVNLVNFYYPKLTFKSSILQLIKDNQVTAKAVFDAAKAGDQFCIFITEKVANYIGYLCSIISVTSNPKYIVLGGGMSTAGLILIENIKTEYRNLTFTPAQNNTEIVQAKLGNDAGITGAAGLIKTYIIDKEGAK

SEQ ID NO: 4024 - protein, 51 aa, Staphylococcus epidermidis
YIKTLRFSKRLMSLILFFQAHKNLYFIIFIHHMKSNSSHHNLLFYQFHSNI

SEQ ID NO: 4025 - protein, 380 aa, Staphylococcus epidermidis
HMPAVTYEHIKTCKQSGARLGIVHTPHGSFETPMFMPVGTKATVKTMSPEELRNIEAKIILGNTYHLWLQPGNDIIKHAGGLHKFMNWDGPILTDSGGFQVFSLSNLRKISEEGVEFRHHTNGSKLFLSPEKSMQIQNDLGSDIMMAFDECPPMPAEYDYVKDSIERTTRWAARCLKAHQRPGDQALFGIIQGGEYKDLREQSAKELVSLDFPGYAIGGLSVGEPKPVMYDMVEHTEQFMPKDKPRYLMGVGSPDALIECSIRGMDMFDCVLPTRIARNGTCMTSNGRLVVKNAKYADDLRPLDEQCDCYTCQHYTRAYIRHLVKAEETFGIRLTTIHNLHFLLKLMEDIRQAIREDRLLDFKDEFFEQYGLNVENPKNF

SEQ ID NO: 4026 - protein, 44 aa, Staphylococcus epidermidis
YCNAFLKCVLKQGSFMLSCFLKIINWGYTYDNRFEKNTFISKLR

SEQ ID NO: 4027 - protein, 214 aa, Staphylococcus epidermidis
ESEADSIVWMGENGGFLLFKFPPFLSKMNGRRKLYMQQNKRLITISMLSAVAFVLTFIKFPLPFIPPYLTLDFSDVPTLLATFLLSPIAGIIVALIKNILNFLFNIGDPVGPVANFLAGVSFLLSSYYVYRKRKNNRSLIYGLITGTIVMTIVLSILNYFVLLPLYGMIFNLGDVLNNVKIVIVSGVIPFNLIKGIIISIIFVLLFRRLRHIIK

SEQ ID NO: 4028 - protein, 201 aa, Staphylococcus epidermidis
LFMAFELPNLPYAYDALEPHIDKQTMEIHHDKHHNTYVTKLNSAVEGTDLEAKSIEEIVANLDSVPSNIQTAVRNNGGGHLNHSLFWELLSPNSEEKGEVVDKIKEQWGSLDEFKKEFADKAAARFGSGWAWLVVNNGQLEIVTTPNQDNPITEGKTPILGLDVWEHAYYLKYQNKRPDYINAFWNVVNWEKVNELYNATK

SEQ ID NO: 4029 - protein, 112 aa, Staphylococcus epidermidis
ANAAHYGASKAGFSAVLNALRLEQPELKVLNVQPGPIDTPFQKNADPTLKYFKNYRHMMIQPQQLAKQIVEGIILNKIEINQPSWMQIMLKFYQLCPRTLEKLCPNLFKNKV

SEQ ID NO: 4030 - protein, 154 aa, Staphylococcus epidermidis
RSEASVEERLNRVKQQLQQSSYKLTPQREATVRVLIENEKDHLSAEDVYLKVKDKAPEIGLATVYRTLELLAEIKVLDKINFGDGVARFDLRKEGAKHFHHHLVCMECGKVEEIEEDLLPEVENRVENEFNFKILDHRLTFHGVCFECQAKNKQ

SEQ ID NO: 4031 - protein, 323 aa, Staphylococcus epidermidis
GFNLYNILSYAMSHAFNYKTNKSIYNILTGKKSHQTFFDASSQQLLSLYHSLPNLKYSTFEQFILQKDDFKKSIQVKIHPQYTYDSLTQTFSCIQLLIQTLSHTRKESNTFIPIVQNTYIQQRVKQLYHQVIESNQVSNTIDEIYLLFENLNNKYNHTFLHYYLQGYEESMYTRQQISLIEGIPQSELFEREMNELIDILNQLKDSTKYPILSQAIILSPLLTNTYLSYQKLKSGLNLKEIAQLQNVKLNTIEDHILEMYIKGYLIDYTLFINKKDILEFINYYQKHRGERLKFYKEHFTDWTYFQIKLVIVGIERGDLIAER

SEQ ID NO: 4032 - protein, 253 aa, Staphylococcus epidermidis
VDNLQRYFMNQSADENQCFFIENKEDYHHIVNVMRYKEGQNIIVTFSDENVFKCKIISINDQSIEIKLVEKQQINTELPQNITICSGLIKADKYEWMIQKATEMGANEFIAVAMERSVVKLTDSKVEKKLSRWQKIIKEAAEQSYRLTIPNIKFKSNLKEIYGMISQYDYVLIAYEEQAKHGELSQFKQTIKQFKTQDRVLIIFGPEGGLSDSEISLFGDVSTIVGLGPRILRAETAPLYALSAVSYEKELLG

SEQ ID NO: 4033 - protein, 739 aa, Staphylococcus epidermidis
PMFYIALAFLVGVLWIKFKVISISLILTLLLLIMIKRLNIIILLLMFISAISFFFLISSYNQTEIKNINSLYNEPFIDDFVTFKSFTPKSTYYTGILNYKNKDYRYFYKILKSNFKQDLTHKSCRVKGEFKFEKELSLLNISTVQFKSCQENNIFTPIYHHQNYITKIIHISGVTHPERILALITGDTSLIDEYYKSNIKDIGIYHLLAISGTHVGTIIVLVYQLLVRLNIPLVLIKGVTILLLLIYAVYTGFVPSAMRAISIAIIILMLPIHFRKSSIHVLSFIFVLMILLNPQFINHIGFQFSFLISLFIILAKPYISALKPLKCLFIISFLAQLGSIVINTYHFNQFQWIGLLSNFIFVPFYSFILFPSVIIYFILIHFFQHSFLLNTYINMLFKIHDWLVQLFLNLNHLKWYIPKLNQYSLLILIILTLIFLYILVYRGFVTSVLSFLIVLIIFTHLIRPHYAELTLFDVGQGDSILFKTKSNKSVLIDTGGKKNENVSFKHNNIAKYKILPIIKKKGITTINYLVITHPHADHMGELIYFLNNINVNNLVLNIESFPLKLLKEVTTKCKEKKINILDVNQVKKIDIDNSKISFLNSFIPLIDDKNEHSIVTLIEYNGINILLMGDATVNNEDILMKRYNLPKIDILKVGHHGSRTSSSKLFIKDIEPKISLISSGKNNKYHLPNLDVIQRLKYYGSKVFDTQDNGELTINLDEEVYIVYRDNLNQKSLARESVS

SEQ ID NO: 4034 - protein, 170 aa, Staphylococcus epidermidis
ECIYMFKKLFGKAKEVDKNIKIYAPLTGEYVKIEDIPDPVFAQKMMGEGFGINPTEGEVVSPIEGKVDNVFPTKHAVGLKAENGLELLVHIGLDTVQLDGKGFEVLVESGDDIKIGDPLIRFDLEYINNNAKSIISPIIITNSDQTESIHIEDVQAVVKGETQVIDVTVS

SEQ ID NO: 4035 - protein, 154 aa, Staphylococcus epidermidis
KSIYRITLGRLKMIKKNKEELNDMEYLVTQENGTEPPFQNEYWNHFEKGIYVDKLSGKPLFTSEDKFESNCGWPSFSKALNDDEIVELVDKSFGMIRTEVRSEKANSHLGHVFNDGPKEKGGLRYCINSAAIQFIPYDKLEELGYGDLIKHFKK

SEQ ID NO: 4036 - protein, 44 aa, Staphylococcus epidermidis
SSFLTDSLGLFSSTHLFYLSKRFNSSMFIKHQNVGIYLNILEID

SEQ ID NO: 4037 - protein, 238 aa, Staphylococcus epidermidis
EESYMYNEIFGIASFIVTFALMVLMYRCFGKQGLIAWVAIGTIIANIQVIKAVHIFGITATLGNVMFASIYLATDILNDIYGRKVAKRAVWLGFSSTLVMIIVMQMSLHFIPAPVDNAQNSLKMIFDLVPRIAIGSIIAYIIGQHIDVFIFSMIKKIFSSDKTFFIRAYGSTILSSIIDTGLFVSIAFIGTMPGTAVFEIFITTYLLKLVSTIFNVPFGYIAKSLYRKGKIEQLDNGY

SEQ ID NO: 4038 - protein, 243 aa, Staphylococcus epidermidis
ILSYSFLIHIRSLKMINLNQRLSIVCSFIKRGTLADIGSDHAYLPIYAIQNDLCTKAIAGEVIQGPYKAAKRNIANYELNQQVDVRLGDGLSVINSEDQIDNITVCGMGGPLIAKILNDGKDKLVNHPRLILQSNIQTQALRQTLNKLSYEIVDERIIEEKGHIYEIVVAEFNNNLVKLNILQEKFGPFLLRECNNIFQKKWQRELEALRDIKSQLNSTSHHERLKEIEDEINLIQEVLINEN

SEQ ID NO: 4039 - protein, 352 aa, Staphylococcus epidermidis
RNTYSYYSKKKKLKTKGNSIMRKITVFGMGSFGTALANVLAQNGHDVLMWGKNVENVDELNTHHMNKNYLKDAKLDSSIKATVDLNKAVQFSDIYLMALPTKAIREVSKDIDQLLTSKKTFIHVAKGIENDTFKRVSEMIEDSISSEHNGGIGVLSGPSHAEEVVIKQPTTVAASSKDNNVSKLIQDLFMNDYLRVYTNNDLVGVELGGALKNIIAIASGIVAGMGYGDNAKAALMTRGLAEISRLGEKLGADPMTFLGLGGIGDLIVTCTSTHSRNYTLGFKLGQGKTAEEALKEMKMVVEGIYTTKSVYHLAQQEGVEMPITNALYEVLFEDVPVSKSVRTLMERDKKAE

SEQ ID NO: 4040 - protein, 45 aa, Staphylococcus epidermidis
SKAYNPRIFIHNAAPFYLIMQHSIFYHNKEILVYIKFQKIKTLYN

SEQ ID NO: 4041 - protein, 59 aa, Staphylococcus epidermidis
LPSLKDLLTCLNSNMFMIPFYPIALSGFIFIIDNTENRLPNKEIMIRTIPYINIVNKLK

SEQ ID NO: 4042 - protein, 190 aa, Staphylococcus epidermidis
KYQYDLNLLLPLVKILKKRCFSKMIRLATKNDLLSITQLVKEAKQIMEEFNNNQWDDEYPAKEHFEEDIENKTLYVLDVDHTIYGLIVIDQNQSEWYDDIDWPVNPNGAYVIHRLPGSKQYKGAATELFQFAIDLANEHDIHVILTDTFALNKPAQGLFEKFGFTKVDEIEIDYHPFDRGAPFYAYYKNI

SEQ ID NO: 4043 - protein, 40 aa, Staphylococcus epidermidis
KIKYVMLLVLKEHLFILFQEKEIKNKGEFNNEKNYSFWYG

SEQ ID NO: 4044 - protein, 438 aa, Staphylococcus epidermidis
KEKYRSLVMKTTIKQAKKHLNQEVTIGAWLTNKRSSGKIAFLQLRDGTGFMQGVVVKSEVDEETFQLAKDITQESSLYITGTITEDNRSDLGYEMQVKSIEIVHEAHDYPITPKNHGTEFLMDHRHLWLRSKKQHAVMKIRNEIIRATYEFFNENGFTKIDPPILTASAPEGTSELFHTKYFDEDAFLSQSGQLYMEAAAMAHGRVFSFGPTFRAEKSKTRRHLIEFWMIEPEMAFTNHAESLEIQEQYVSHIVQSVLNHCQLELKALDRDTTKLEKVATPFPRISYDDAIEFLKKEGFDDIEWGEDFGAPHETAIANHYDLPVFITNYPTKIKPFYMQPNPDNEDTVLCADLIAPEGYGEIIGGSERINDLELLEQRINEHELDEESYSYYLDLRRYGSVPHSGFGLGLERTVAWISGVEHVRETSPFPRLLNRLYP

SEQ ID NO: 4045 - protein, 104 aa, Staphylococcus epidermidis
YNEYHYKTSGGEFIMNKTDLINAVAEQADLTKKEAGSAVDAVFESIQNSLAKGEKVQLIGFGNFEVRERAARKGRNPQTGKEIDIPASKVPAFKAGKALKDAVK

SEQ ID NO: 4046 - protein, 209 aa, Staphylococcus epidermidis
HLRYNISRIFGVLVGIPVAFIVWLITVFALDLSFIIDMLISFGSFIASYFPTQRLTSRKYLNEIGLSRRDYRYVQSQLHHAHTKIRNILKSFINIRSIKDFRQVNDIYRISRSIHTSIKQRPAMFFKVESFFYSHLDNALNLVDSYTRLARMPRKSQDEKLKLEQTRITLDEIKRTLIADLKRLNEEDYERLDVEIELNKLEQQRRHNN

SEQ ID NO: 4047 - protein, 574 aa, Staphylococcus epidermidis
ETGYITILRRMYMFRKSMLILMIAVILFVTACSKDKTQDEAKRKADAKGKPDTWIADRKLKGLVFQSDNDASPKMNKEVAQELKKKTGITLELQTVSNEDSTEALTSGLASGDLPDFIVYYLDDSGRPEMKVLNKAAKQGRLTDLTKMLKNTKIYSKYFKKGYLPKDTKDNIMFNKEQDGTYLVHMGINRHPGQEERRTVGGPYVRKDIMDKLHIDPTSIKTSKDVEKLAEKMKEHHFKDDNGKEITPIGPTAWGGDDRTKFYNDLVWTGQSDEKFLNKGKKIIHESQTEYPLKRVHYVKDLMKKGLMTKEFYTMEENKAKEGLVNGSWGIVSDLHNYVTENQSMKYVPLGPLNTVKGKFRVEKPYKSGANGWAVPSTTEHPEDVVKLADFLASRRGKLLGQYGIKGRDYTLDKKGNPHVKPEVLKEVENNPDEAKKRGFRGAGSYWADHLGYTDIDNKADFGETEYGDNTKTKKTTPEKIADMWHYDQRQKHAKIVNGLTVKSFLSKYEYGEDLEVALDDYSDAIKRAYYSQSDKETKQIIDSAKQRLEEAGLNQFERYVENQRDKKGTQIIY

SEQ ID NO: 4048 - protein, 257 aa, Staphylococcus epidermidis
IIMYKRNERLNLIRKRVDQYGQVAVKDLAIFLQVTPETVRKDLETLENDKLITRTHGGAIQYNHINKEKSYANKWQKQSQVKERIAKKAALQIKSGEIIVIDGGTTTGRIPQYLNDITQTTIVTNSLKIADELNRAIEEQRIQAEVIMLAGKTNTEQDVVRGHMTNELLQRFKFDKAFISCGSFDTSDCYEFDLEEAHASHIMIQKSQLSYLLADSSKRDAHASYRIDGFSEIDYMISDYAKPQNIEYFNQKHWLQI

SEQ ID NO: 4049 - protein, 90 aa, Staphylococcus epidermidis
GVSYMENFDKTMKFSYEEIPKEDVKSVLQNVHRTLEERGYNAVNQIVGYLLSGDPAYIPRQNEARNQIRHIDRDVIMEELVSNYLKESKN

SEQ ID NO: 4050 - protein, 56 aa, Staphylococcus epidermidis
DYQYYMNRVSNFNSIDLLNFRMKFFELCSPKFSWDKLNINEFFKLIKLWTTNTTNV

SEQ ID NO: 4051 - protein, 425 aa, Staphylococcus epidermidis
NKNLLVCLTDLCCVIEYDNILNILQFNVLKNRKGRAIMRYLTSGESHGPQLTVIIEGVPANLEIKAEDINKEMFKRQGGYGRGRRMKIEKDTIEIVSGVRNGFTLGSPITLVVTNDDFTHWRKIMGVAPISDEERENMKRTITKPRPGHADLIGGMKYNHRDLRNVLERSSARETAARVAVGAVSKILLEQLDIHLYSRVVEIGGIKDKGLYDVDMFKNNVDKNDVRVIDENIAQQMRDKIDEAKKDGDSIGGVVQVMAENMPIGVGSYVHYDRKLDGRIAQGVVSINAFKGVSFGEGFKAAEKPGSEIQDEIHYNQDSGYFRATNHLGGFEGGMSNGMPIIVNGVMKPIPTLYKPLNSVDINTKEDFKATIERSDSCAVPAASVVCEHVVAFELAKAVLEEFQSNHMDQLVAQIKERRQLNIEF

SEQ ID NO: 4052 - protein, 371 aa, Staphylococcus epidermidis
LNLQRSKDMIQIKDLNKVYDNGSYAVKDFNLDIEDNEFVVFVGPSGCGKSTTLRMIAGLEDVSKGTISINDKVINDLQPKDRKIAMVFQNYALYPHMTVYKNLAFGLKMRGIKKKIYDEKIQHAAQILEIENLLDRKPKALSGGQRQRVALGRAIVREAQIFLMDEPLSNLDAKLRSNMRSEIIKIHKQMKATTIYVTHDQTEAMTMASRIVILKQGEIQQIGTPEEIYRHPVNEFVATFIGSPSMNMVPMTYNMDAWYFDGQKVADATLLQLASHAQYRLGIRPEDLHLVNDNEISNYPIQLSQFTVDLVELTGSYKLLHCHHNEHKIIAAVDSNLDFELGQTVSFGIKTEDAHFFDSDSGERVQEEVLS

SEQ ID NO: 4053 - protein, 45 aa, Staphylococcus epidermidis
KKIHCKKISIIMKDLKINLSIKSSYLLLLKLKIGALFVFKIFTYN

SEQ ID NO: 4054 - protein, 43 aa, Staphylococcus epidermidis
IVVQNAIVINEEQTEIKRSEHLLFFIEQMYELFIVKIINIKNV

SEQ ID NO: 4055 - protein, 203 aa, Staphylococcus epidermidis
KVVHTKMYQWLWETSLYQKWLISFILICNIFGTIYGYHWYSSQLANTPNYFKLFVPDSPTATLFLCLSLLFILFNKRYALIDALAFITLFKYGSWAVIMNILMFIKMNDIAINGLMLLISHAIMILEAIYFYPRFKISKLAGLMSFIWVTINDVIDYIYGQYPYYDFIAKHLIEVGVLAYSLTIISYILFLKLQKWLKVKTFD

SEQ ID NO: 4056 - protein, 334 aa, Staphylococcus epidermidis
NLSHVDETLNLRNLKRSAFMPGIIQIDDINQSQALIGNNDENLKAIEAHFNVVIHARGQEIAVKGEKIEHVEKAELVLKNLLKVIELGNTITLKDVEAAIKMADNNTIHHLLDLYDEEITKDAYGKTIRAKTMGQRIYINAMKRNDLVFGIGPAGTGKTFLAVVYAAKQLRKGSVKRIVLTRPAVEAGESLGFLPGDLKEKVDPYLRPLYDGLNTVLGREQTQRLIERGVIEIAPLAYMRGRTLDDAFVILDEAQNTTHAQMKMFLTRLGFGSKMVVTGDQTQIDLPKGVKSGLKEAVKKLSGVSGISIMKMDQSDVVRHPLVSKIINRYEGVE

SEQ ID NO: 4057 - protein, 46 aa, Staphylococcus epidermidis
LITHYIPPLNISNIYGKKTINPIHIETIETMTTLNAAISLAYFAYS

SEQ ID NO: 4058 - protein, 91 aa, Staphylococcus epidermidis
HFYQRRRINMAKYTIVDMDTCIACGACGAAAPDIYDYDDEGIAYVILDDNQGTTEVPEELYEDMEDALEGCPTDSIKIEDEPFDGDALKFE

SEQ ID NO: 4059 - protein, 295 aa, Staphylococcus epidermidis
LRHQRTLSVRKTFVLRIFMYIIIKKHRYNELESKELKMKHQFSRNELAIGQEGLNLLKNKTVAVLGVGGVGSFAAEALARTNIGHIILIDKDDVDITNVNRQIHALTSTIGQSKVTLMEERIKLINPDCKVTSLHMFYTEETYKDIFNNYDIDYFIDASDTIIYKVHLMKECLERGIELISSMGAANKTDPTRFEIADISKTHTDPMAKVIRNRLKRLGIRKGVKVVFSDESPIVIREDVKETVGDKNAINRKGQMPPSSNAFVPSVVGLICASYVVNDILKDIPVRRIKDKGQN

SEQ ID NO: 4060 - protein, 65 aa, Staphylococcus epidermidis
RSNQGGMSMSNLWIIFAVTVLIAVYSAIEVFTNLNHKQQPRFKYFTIAFVVFIILAIIEVIFLAQ

SEQ ID NO: 4061 - protein, 79 aa, Staphylococcus epidermidis
KLNQKQTEPKITYILQVLLTNRALMSKFSPFIKIYLTLVVGPIIENFARKFYGQTKLNFEASSAHGTLIRFCITIFLIQ

SEQ ID NO: 4062 - protein, 443 aa, Staphylococcus epidermidis
GGCQLDIKMPKLGESVHEGTIEQWLVSVGDHVDEYEPLCEVITDKVTAEVPSTISGTITELVVEEGQTVNINTVICKIDSENGQNQTESANEFKEEQNQHSQSNINVSQFENNPKTHESEVHTASSRANNNGRFSPVVFKLASEHDIDLTQVKGTGFEGRVTKKDIQNIINNPNDQEKEKEFKQTDKKDHSTNHGDFLHQSSTKNEHSPSSNERVVPVKGIRKAIAQNMVTSVSEIPHGWMMVEADATNLVQTRNYHKAQFKQNEGYNLTFFAFFVKAVAEALKVNPLLNSTWQGDEIVIHKDINISIAVADDDKLYVPVIKNADEKSIKGIAREINDLATKARLGKLAQSDMQNGTFTVNNTGSFGSVSSMGIINHPQAAILQVESVVKKPVVIDDMIAIRNMVNLCISIDHRILDGVQTGKFMNLVKKKIEQYSIENTSIY

SEQ ID NO: 4063 - protein, 231 aa, Staphylococcus epidermidis
KISHILKMYHILIRKGLLNMKTVLIVGANGRVSIEATKIFLENSRFNVDLFLRNAHRIPDYASNRIKVYEGDAKNIEDLESALNNVDVVFASLSGSLDKQAETIVKAMDNKNVKRLIFVAAPGIYDELPEPFNQWNKEQFGEKLNRYRKASDIIENSDLDYTIIRPGWLTDKNENVYEITAKNETFKGTEVSRKSVASLAVQIAKNPELHSKENIGVNKPNTEGNKPAWFN

SEQ ID NO: 4064 - protein, 449 aa, Staphylococcus epidermidis
ILSHRYIPLTEQDKNEMLNSIGAKSISELFDDIPTDILLKRNLNIAESEAETILLRRLNRLAAKNTTKETHATFLGAGVYDHYTPAVVDAMISRSEFYTAYTPYQPEISQGELQAIFEFQTLICELTDMDVANSSMYDGMTSFAEACILALSHTKKNKIVVSSGLHYQALQILHTYAKTRDEFEIIEVDLKGTITDLEKLEQLIDDNTAAVAVQYPNFYGSIEDLEQINNYIKDKKALFIVYANPLSLGLLTPPGTFGADIVVGDTQPFGIPTQFGGPHCGYFATTKKLMRKVPGRLVGQTQDDEGNRGFVLTLQAREQHIRRDKATSNICSNQALNALASSIAMSALGKQGIYEIAVQNLKNANYAKNKFEEHGFEVLKAQSFNEFVVKFNQPIKNINLKLAEYGYIGGFDLGEVSDDFKNHMLVAVTELRSKDEIDDFVTKAGELND

SEQ ID NO: 4065 - protein, 471 aa, Staphylococcus epidermidis
RKIHRNSTWRRVCDSMIKRQKLKYKWMLITTLITFTTILLFCLIIIFFLKDTLRSSEIDEAERSSNDIANLFHSKSLSDISALDLNASLENFQEILIYDDKGRKLIQTSNDNTLAYDNKIDFKHPERIHIQRSHGINYLVITEPIRSKDFSGYSVLVHSLQNYDNLVKSLYIVALAFGLIATIITAGVSYIFSSQITKPIVTMSNKMNQIRRDGFQNKLELTTNYEETDNLIDTFNEMMYQIEESFNQQRQFVEDASHELRTPLQIIQGHLNLIQRWGKKDPAVLEESLNISIEEVNRITKLVEELLLLTKDRVNHNVLECENVDVNSEIQSRVKSLQHLHPDYTFETHLATKPIQLKINRHQFEQLLLIFIDNAMKYDTEHKHIKIVTQLKNKMIMIDITDHGMGIPKADLEFIFDRFYRVDKSRARSQGGNGLGLSIAEKIVQLNGGMIQVESELQKYTTFKISFPVLN

SEQ ID NO: 4066 - protein, 364 aa, Staphylococcus epidermidis
TKCLKKVLYVKKLSINTFKYKRNKYLTEIQSIDLLQRLQQLLSHGFTLYQSFKFLNSYFKYKERTINKKIIQHLQNGATCYDILKIIGYPELVLLQIKFAENYGNIEEALVDTVQYMKRNLKAKKRLIKTLQYPVALISIFLFILTILNITVIPQFQQLYETMNVKLSTFQNLLTLIITRLPKLTFIFIFISGIAFFITYKFYYYLPIEKKLKSILKIPMINTYYKIYRTYQLSNQLSLFYRNGTSLQQIVRIYRNEQDNDFLKFLGDYLFKEANKGLPLPVILMNLKCFQNDLIKFIEQGEKNGKLDIELKLYSQMLLQQFEEKVLKQTKFIQPIIFFILGIFIVSLYLVIMLPMFELMQTIK

SEQ ID NO: 4067 - protein, 243 aa, Staphylococcus epidermidis
NMSQMMFDNFLSSSRAKWGERSGLTLFLPHVFEGQGPEHSSARLERFLQLAAENNSTVVNLSSASNYFHLLRAQAASLDTLEMRPLIVMSPKSLLRNKTVAKPIDEFTSGGFKPIITEDIDEQKVKKVILASGKMYIDLKEYLAKNPNDSILLIAVERLYPFPEEEIKEVLKSLPHLENVSWVQEEPKNQGAWLFVYPYLKALVANKYDLTYHGRIQRAAPAEGDGEIHKLVQTKIIESSINN

SEQ ID NO: 4068 - protein, 49 aa, Staphylococcus epidermidis
TFYHNSKIFIRGNYTNMSPSIIISRVNLNNSNIKMPGTALIVSGILKVI

SEQ ID NO: 4069 - protein, 593 aa, Staphylococcus epidermidis
KGSLKMNKRTTYCGLVTEEFLNEKVTLKGWVHNRRDLGGLIFVDLRDREGIVQIVFNPDFSEEALQVAETVRSEYVVEVEGVVTKRDAETINPKIKTGQVEVQVSNIEIINKSETPPFSINEENVNVDENIRLKYRYLDLRRQELAQTFKMRHQTTRSIRQYLDNNGFFDIETPVLTKSTPEGARDYLVPSRVHEGEFYALPQSPQLFKQLLMISGFDKYYQIVKCFRDEDLRADRQPEFTQVDIEMSFVDQEDIIAMGEDMLRKVVKDVKGIDVSGPFPRMTYAEAMDRFGSDKPDTRFGMELINVSQLGKEMNFKVFKDTVDNNGEIKAIVAKDAANKYTRKDMDALTEFVNIYGAKGLAWVKVVDDGLSGPIARFFEDVNVETLKQLTEAKPGDLVMFVADKPNVVAQSLGALRIKLAKELGLIDESKLNFLWVTDWPLLEYDEDAKRYVAAHHPFTSPKREDIEKLDTEPENVQANAYDIVLNGYELGGGSIRIHDGELQQKMFEVLGFTNEQAQEQFGFLLDAFKYGAPPHGGIALGLDRLVMLLTNRTNLRDTIAFPKTASATCLLTDAPGEVSDKQLQELSLRIRH

SEQ ID NO: 4070 - protein, 45 aa, Staphylococcus epidermidis
KLKHLIKDKFDSKMKIKESEFNVFNINDYIFRNINGHSNVGSTQS

SEQ ID NO: 4071 - protein, 49 aa, Staphylococcus epidermidis
EDLQNEKQGTHLYIAGRMIKLFITTASTDSIGTQDFCLAYFYVYNYKEA

SEQ ID NO: 4072 - protein, 48 aa, Staphylococcus epidermidis
SKLFSNLSFRKSKFFVCNFSKNKRLKTFIRQHFKSFINKNENKEINIR

SEQ ID NO: 4073 - protein, 188 aa, Staphylococcus epidermidis
RKFKQTDNLRREYNMAYATLAGGCFWCMVKPFTSYPGIKSVVSGYSGGHVENPTYEQVCTNQTGHVEAVQIEYDPNITTFENILDVYFKTFDPTDDGGQFFDRGESYQPVIFYHDENQLKAAELKKQQIDEEGIFKKPVITPIKPYKNFYPAEEYHQDYYKKNPTHYEQYQRGSGRKAFIESHWGGSK

SEQ ID NO: 4074 - protein, 47 aa, Staphylococcus epidermidis
NRFNPFKVTTYKSENFEGIFHLLFLSLNTNLMTLVTINVIMLSERNG

SEQ ID NO: 4075 - protein, 55 aa, Staphylococcus epidermidis
ELIKKKKLIAEININNSIIILSLFIIISNKRVNIKEIEITLNFIQSTPTKKARAM

SEQ ID NO: 4076 - protein, 486 aa, Staphylococcus epidermidis
MNINKLYWKALYYWIRYLNYNVIYRDKEDDEIWLSHKRKHSIVVFRKDVTSTQEIRFDKSKIMERPEEIQQFIGYIPESYEFYYFTDKELSKENLNEEKPIKLKFKIISNEQSLNSLPINFLLLKMLINNEDKRTYLHYKRKVLTQNLVDKHMQRFTPITYTLILINIVIWLCMILYLNRFSDVKLLEVGGLVHFNVVHGEWYRLISSMSLHFNFEHILMNMLSLFIFGKIVESIIGSWRMLIIYIISGLYGNFVSLSFNTTTISVGASGAIFGLIGSIFVIMYLSKNFNKKMIGQLLIALVVLIVFSLFMSNINIMAHLGGFISGVLITLIGYYFKTQRSLFWSFLIVFLLIFIILQIRIFTISEDNIYDKLIRDEMIKGNYSEAKNVVKQTLNNNYADDETYYLSGLITATKSSQAEAVSEWERGLRKFPNSGVLNYELAIANRSLSDDKKALKYIKKAVAINPNNKKYVNLKKELSKSNDTKN

SEQ ID NO: 4077 - protein, 146 aa, Staphylococcus epidermidis
MDIKKIEEVIKLVKANDVKKFKYKDSHNEIELDFTNGASQQHSQQSSQDIQQENIKSLDEKQESISNDQQEIKSPMVGTFFLQDSKELTEPKIKVGDTVTEGDIIGYIEAMKVMNEVTTDVTGEVTEILVEHGDNVEYDQLLVRVK

SEQ ID NO: 4078 - protein, 122 aa, Staphylococcus epidermidis
LEINMKRFKYAYEGFCAILKKDQNFLLHILAAIIIIILGFVLNIDRIDWILIIVAIGLVLSFEAINTSIEFVVDLITTDYHEYAKYAKDIAAFSVVIVSIVSICIGLIVFLPYILEIFKGGM

SEQ ID NO: 4079 - protein, 185 aa, Staphylococcus epidermidis
NHYKGKGEKIVGIIKKLFMPNAYVKSIFEIDIEKLADSGVKGIITDLDNTLVGWDVKEPTKGVKSWFAKAKDLGITVTIVSNNNKSRVSSFSSNLGVDYIFKARKPMGKAFKMAIKKMKIQPRETVVVGDQMLTDVFGGNCNGLYTIMVVPVKRTDGLITKFNRLIERRLLNHFRKKGYIKWEEN

SEQ ID NO: 4080 - protein, 55 aa, Staphylococcus epidermidis
IVYNYIITSRFISNKEYAFKKVLIIKLFSRLTRQLNKIVNVNLVNIFLNLLIDIL

SEQ ID NO: 4081 - protein, 45 aa, Staphylococcus epidermidis
SQHNLRILPCLDTPCQIINVPIIAPLFVYFYFSVLPMKKFMSFKF

SEQ ID NO: 4082 - protein, 560 aa, Staphylococcus epidermidis
FFNNIGGDIMKRNWWKEAVAYQVYPRSFNDSNGDGIGDLPGLIEKLDYLENLGIDVIWLSPMYPSPNDDNGYDISDYKGIMSEFGTMNDFDQLLSSIHQRGMKLILDLVVNHTSDEHPWFIESKSSKTNAKRDWYIWADPKPDGSEPNNWESIFNGSTWEFDESTKQYYFHLFSKKQPDLNWENPDVRQAVFEMMNWWFEKGIDGFRVDAITHIKKNFEAGDLPVPDGKKFAPAFDVDMNQPGIQEWLQEMKDKSLSRYDIMTVGEANGVTPNDAEEWVGEENGKFNMIFQFEHLGLWSTGDTKFDVKSYKQVLNRWQKQLENVGWNALFIENHDQPRRVSTWGDDKNYWYESATSHATAYFLQQGTPFIYQGQEIGMTNYPFESIESFNDVAVKTEYQIVKKEGGDVNQLLDKYKMENRDNARTPMQWNNSINAGFTTGKPWFHVNPNYTEINVKQQLNDKFSILSYYKALIQLKKSDLIYTYGKFNMVDAENKQVFAYTRTFKNNTVLIVANLTNEVSELNLPFELDISSVDIKLHNYHLNDINLDHIKPYESFVVEI

SEQ ID NO: 4083 - protein, 43 aa, Staphylococcus epidermidis
AHNNMRNKNEKDISKLVINIVLLLYRGDLVKNKFIYIVLNGQK

SEQ ID NO: 4084 - protein, 351 aa, Staphylococcus epidermidis
LHNNTIRSVYMHISIVGITGYTGLELLRLALNHPHVTVSSIHATKEVGVQISDIFPHLKGIFDKEIQVFDSEFIMTHSDLVFFATPSGVAKDLSKNFVKNNFPVIDLSGDHRLSPDVYLKWYKKSPCTVDIQKRFTYGLSEVMNISHRNRFIANPGCYATATELALYPLISNHLIRVDSIIVDAKSGLTGAGKKLNQSSHYVNVNNNYVTYKLNKHQHIPEIVQTLQFFNKSLQNIQFSTSLIPVNRGIVATIYTRLENGVKINQIESTYKDVYKNKPFIRIKDGLPQLNEVIGTNYTDIGFVYNETTGVLTISSVIDNLIKGAAGQAIQNMNLMFNFDETDGLILAPLYI

SEQ ID NO: 4085 - protein, 231 aa, Staphylococcus epidermidis
RGDKMNIGIIIFIISVIITGVSALRDKSHEDRQNQRPNQKTSNEQHQEGGFFEKLEKTFQEISDELNDEPEKKQSKPFETSLPPLNEDWNENEKKKTSHHKEKQNTSQSKRQTTSTHEHQNIPQPDKTTSRDDNYEKLKQELEQDVTKNLIDVRKEIDKEKEKQLVMIERKAQDIINDKYLSERTKRYRIKQLLNSRNVEKNMSRSAFQYDSDEVINGIIWSEILNKPKQL

SEQ ID NO: 4086 - protein, 502 aa, Staphylococcus epidermidis
MISKSSPLIFERSKKDRYAYSLPQNDIENISIASLLDDKYIRKHKAEFPEVSELDLVRHYTELSNKNFGVDTGFYPLGSCTMKYNPKINEKVARISGFSESHPLQEEEHVQGSLEIIYSLQEELKEITGMDEVTLQPAAGAHGEWTALMIFKAYHEKNGQSHRDEVIVPDSAHGTNPASASFAGFKSVTVKSNQRGEVDIEDLKRVVNDNTAAIMLTNPNTLGIFEQNIIEIGKIVHEAGGLLYYDGANLNAILDKVRPGDMGFDAVHLNLHKTFTGPHGGGGPGSGPVGVVEKLASYLPKPMVIKDNDRYKYDNDIPNSIGRVKPFYGNFGIYLRAYTYIRSMGANGLKEVSEAAVLNANYIKSRLKNHFEIPFNQYCKHEFVLSGTLQKQYGVRTLDMAKRLLDFGVHPPTIYFPLNVEEGMMIEPTETESKETLDYFIDAMIQIADETKNDPDKVLEAPHTTIIDRLDETTAARKPILKFEELKDEKYKEHTNIDSEDN

SEQ ID NO: 4087 - protein, 79 aa, Staphylococcus epidermidis
CDSKLMVKNYSFYQFIMTVRGRKDDKGVFAEQIFEDLAFPKHEDDFNTLSEYIETHSEFTLPMSVFDDLYDDYTEWLKF

SEQ ID NO: 4088 - protein, 423 aa, Staphylococcus epidermidis
YSILIGGQKMGENTKQDFNQKGQNFKFTKKHRRLLYGSVFLMATSAIGPAFLTQTAVFTAQFYASFAFAILISIIIDIGAQINIWRILVVTGLRGQEISNKVLPGLGTIISILIAFGGLAFNIGNIAGAGLGLNAMFGLDVKWGAAITAIFAILIFVSRSGQKIMDVISMILGIVMILVVAYVMVVSNPPYGDALVHTFAPEHPFKLILPIITLVGGTVGGYITFAGAHRILDSGIKGKSYLPFVNRSAVAGILTTGVMRTLLFLAVLGVVVTGVTLSSENPPASVFQHALGPIGKNIFGVVIFAAAMSSVIGSAYTSATFLKTLHKSLLNKNNLIVITFIVISTFVFLFIGKPVSLLIIAGAINGWILPITLGAILIASRKKSIVGNYQHPTWMLVFGIIAVIVTIMTGIFSLQDLASLWKG

SEQ ID NO: 4089 - protein, 282 aa, Staphylococcus epidermidis
IEFKIEGVELNMKLVFYGAGNMAQAIFTGIINSNNLNANDIYLTNKSNEQALKSFAEKLGVNYSYDDEALLKDADYVFLGTKPHDFENLANRIREHITNDNRFISIMAGLSIDYIRQQLNTNNPLARIMPNTNAQVGHSVTGISFSNNFDPKSKNEVDELINAFGSVIEVSEEHLHQVTAITGSGSAFLYHVFEQYVKAGTELGLERNQVEESIRNLIIGTSKMIERSDLSMSQLRKNITSKGGTTQAGLDALSQYDIVSMFEDCLGAAVNRSMELSHKEDE

SEQ ID NO: 4090 - protein, 897 aa, Staphylococcus epidermidis
IILNYDYLTAITKTYEGEFLFMKKMKASEIRQKYLNFFVEKGHMIEPSAPLVPIDDDSLLWINSGVATLKKYFDGRETPKKPRIVNSQKAIRTNDIENVGFTARHHTFFEMLGNFSIGDYFKHEAIEFAWEFLTSDKWMGMEPEKLYVTIHPEDTEAFRIWHEDIGLEESRIIRIEGNFWDIGEGPSGPNTEIFYDRGSAYGKDDPAEEMYPGGENERYLEVWNLVFSEFNHNKDNTYTPLPNKNIDTGMGLERMTSISQNVRTNYETDLFMPIIKEVEHVSGKKYLIDDAQDVAFKVIADHIRTISFAIADGALPANEGRGYVLRRLLRRAVRFSQSLGINEPFMYKLVDIVADIMEPYYPNVKDKSNFIKRVIKSEEERFHETLEEGLTILNELIKEAKNSDQVIKGHDAFKLYDTYGFPIELTEELATQENLSVDMPTFEQEMQQQRDRARQARQNSQSMQVQSEVLKNIQDESQFVGYETTDYQSLITHIIYNGEEVKHVEAGETIYFILRETPFYAVSGGQVADKGTVGNESFEINVTDVTKAPNGQNLHKGIVQFGEATQNAKVEARVNKEDRRLIQKNHSATHLLHAALKEVLGDHVNQAGSLVEPERLRFDFSHFGPMTQEEINLVERRVNEEIWRAIDVRIQEMSIEEAKSIGAMALFGEKYGDIVRVVNMAPFSIELCGGIHVNNTAEIGLFKIVSESGTGAGVRRIEALTGKGAFLHLEEIETQFNNIKNHLKVKSDNQVVEKVKQLQEEEKGLLKQLEQRNKEITSLKMGNIEEQVELINNLKVLATEVEIPNPKAIRSTMDDFKSKLQDTIIVLVGQVDGKVSVIATVPKSLTNQVKAGDLIKNMTPIIGGKGGGRPDMAQGGGTQPEKITEALRFIKDYIKNL

SEQ ID NO: 4091 - protein, 121 aa, Staphylococcus epidermidis
RMVNVADYSQSNLGKIEIAPEVLSVIASIATSEVEGITGHFAELKKTNLEKISRKNLNRDLKIEAKEDGIYIDVFCSLKHGVNISKTANQIQSAIFNSITTMTAIEPQQINIHIRSIVAEK

SEQ ID NO: 4092 - protein, 45 aa, Staphylococcus epidermidis
ILSKVPLPKKQEQCKTLVILESDIEQHIQVKTEFFYIQFLIASII

SEQ ID NO: 4093 - protein, 64 aa, Staphylococcus epidermidis
HKAKICAEVYRSLCKFFLVLSHLTPSTKMMKRLHGYHSIISYIVKVHLPIIIQNRSKTEFTPNS

SEQ ID NO: 4094 - protein, 165 aa, Staphylococcus epidermidis
KKDKKHVNPVRQLVLQMEKQLPIKNIKAFSLVEMIFTLFIISCLLITTLWSRSLFDIQLIDEEYEIKQLITKFNYYKSKAISNNESITLLFFNNSNRVQVIEENGDKYSFKLNKGKVINIAKIQTLNFDKNGNINHFGSLILQYNSHAYRLIFHIEKGRLRFVKI

SEQ ID NO: 4095 - protein, 132 aa, Staphylococcus epidermidis
GGCKMSISLYIAIGIIVIIIAYMIIQQILNKRAVNELDQNEFHKGLRKAQVIDVREKVDYDYGHINGARNIPITVFKQRYQGLRNDQPIYLCDANGIASYRAARILRKNGYKNIYMLKGGYKKWTGKIKSKK

SEQ ID NO: 4096 - protein, 318 aa, Staphylococcus epidermidis
WISNIYKRRMTMVELLVTPKSITHMETLIDKGADAFVIGEQKFGLRLPGEFNRDAMQEAVALAHKNNKKVYAAVNGIFHNYHLDALEDYINFLHDIQVDRIIFGDPAVVMYVKQHEHPIPLNWDAETLVTNYFQCNYWGKKGANRAVLARELSLDEIIHIKEHADVEIEVQVHGMTCMFQSKRMLLGNYYTFQERQMKIERQHDHGDLLLYDEERDNKYPVFEDYNGTHIMSPNDICLIEELEPFFEAGIDAFKIDGILQSEEYINVVTEQYREAIDLFNEDPDAYEDEKFMLVDPIEEIQPEHRPFDEGFLYKQTVY

SEQ ID NO: 4097 - protein, 344 aa, Staphylococcus epidermidis
WSSNSCIVGGKKMIDYKSAGLTEEDLKKIYKWMDLGRKTDERLWLLNRAGKIPFVVSGQGQEATQIGMAYAMQKGDISSPYYRDLAFVTYMGISPLDTMLSAFGKRDDINSGGKQMPSHFSHKEKGILSQSSPVATQIPHSVGAALALKMDNKPNIATATVGEGSSNQGDFHEGMNFAAVHKLPFVCVIINNKYAISVPDSLQYAAEKLSDRALGYGMHGIQVDGNDPIAVYKAMKEARERALAGEGPTLIEAVTSRMTPHSSDDDDTYRTKEERDLLKQEDCNIKFKTALLDQGIINENWLSQLEKEHKELINEATKSAEAAPYPSEEEALTYVYEEGGQRND

SEQ ID NO: 4098 - protein, 10203 aa, Staphylococcus epidermidis
MKSKPKLNGRNICSFLLSKCMSYSLSKLSTLKTYNFQITSNNKEKTSRIGVAIALNNRDKLQKFSIRKYAIGTFSTVIATLVFMGINTNHASADELNQNQKLIKQLNQTDDDDSNTHSQEIENNKQNSSGKTESLRSSTSQNQANARLSDQFKDTNETSQQLPTNVSDDSINQSHSEANMNNEPLKVDNSTMQAHSKIVSDSDGNASENKHHKLTENVLAESRASKNDKEKENLQEKDKSQQVHPPLDKNALQAFFDASYHNYRMIDRDRADATEYQKVKSTFDYVNDLLGNNQNIPSEQLVSAYQQLEKALELARTLPQQSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYAFYDGVNNFSDFARGGELYFDREGATQTNKYYGDENFALLNSEKPDQIRGLDTIYSFKGSGDVSYRISFKTQGAPTARLYYAAGARSGEYKQATNYNQLYVEPYKNYRNRVQSNVQVKNRTLHLKRTIRQFDPTLQRTTDVPILDSDGSGSIDSVYDPLSYVKNVTGTVLGIYPSYLPYNQERWQGANAMNAYQIEELFSQENLQNAARSGRPIQFLVGFDVEDSHHNPETLLPVNLYVKPELKHTIELYHDNEKQDRKEFSVSKRAGHGVFQVMSGTLHNTVGSGILPYQQEIRIKLTSNEPIKDSEWSITGYPNTLTLQNAVGRTNNATEKNLALVGHIDPGNYFITVKFGDKVEQFEIRSKPTPPRIITTANELRGNPNHKPEIRVTDIPNDTTAKIKLVMGGTDGDHDPEINPYTVPENYTVVAEAYHDNDPSKNGVLTFRSSDYLKDLPLSGELKAIVYYNQYVQSNFSNSVPFSSDTTPPTINEPAGLVHKYYRGDHVEITLPVTDNTGGSGLRDVNVNLPQGWTKTFTINPNNNTEGTLKLIGNIPSNEAYNTTYHFNITATDNSGNTTNPAKTFILNVGKLADDLNPVGLSRDQLQLVTDPSSLSNSEREEVKRKISEANANIRSYLLQNNPILAGVNGDVTFYYRDGSVDVIDAENVITYEPERKSIFSENGNTNKKEAVITIARGQNYTIGPNLRKYFSLSNGSDLPNRDFTSISAIGSLPSSSEISRLNVGNYNYRVNAKNAYHKTQQELNLKLKIVEVNAPTGNNRVYRVSTYNLTNDEINKIKQAFKAANSGLNLNDNDITVSNNFDHRNVSSVTVTIRKGDLIKEFSSNLNNMNFLRWVNIRDDYTISWTSSKIQGRNTDGGLEWSPDHKSLIYKYDATLGRQINTNDVLTLLQATAKNSNLRSNINSNEKQLAERGSNGYSKSIIRDDGEKSYLLNSNPIQVLDLVEPDNGYGGRQVSHSNVIYNEKNSSIVNGQVPEANGASAFNIDKVVKANAANNGIMGVIYKAQLYLAPYSPKGYIEKLGQNLSNTNNVINVYFVPSDKVNPSITVGNYDHHTVYSGETFKNTINVNDNYGLNTVASTSDSAITMTRNNNELVGQAPNVTNSINKIVKVKATDKSGNESIVSFTVNIKPLNEKYRITTSSSNQTPVRISNIQNNANLSIEDQNRVKSSLSMTKILGTRNYVNESNNDVRSQVVSKVNRSGNNATVNVTTTFSDGTTNTITVPVKHVLLEVVPTTRTTVRGQQFPTGKGTSPNDFFSLRTGGPVDARIVWVNNQGPDINSNQIGRDLTLHAEIFFDGETTPIRKDTTYKLSQSIPKQIYETTINGRFNSSGDAYPGNFVQAVNQYWPEHMDFRWAQGSGTPSSRNAGSFTKTVTVVYQNGQTENVNVLFKVKPNKPVIDSNSVISKGQLNGQQILVRNVPQNAQVTLYQSNGTVIPNTNTTIDSNGIATVTIQGTLPTGNITAKTSMTNNVTYTKQNSSGIASNTTEDISVFSENSDQVNVTAGMQAKNDGIKIIKGTNYNFNDFNSFISNIPAHSTLTWNEEPNSWKNNIGTTTKTVTVTLPNHQGTRTVDIPITIYPTVTAKNPVRDQKGRNLTNGTDVYNYIIFENNNRLGGTASWKDNRQPDKNIAGVQNLIALVNYPGISTPLEVPVKVWVYNFDFTQPIYKIQVGDTFPKGTWAGYYKHLENGEGLPIDGWKFYWNQQSTGTTSDQWQSLAYTRTPFVKTGTYDVVNPSNWGVWQTSQSAKFIVTNAKPNQPTITQSKTGDVTVTPGAVRNILISGTNDYIQASADKIVINKNGNKLTTFVKNNDGRWTVETGSPDINGIGPTNNGTAISLSRLAVRPGDSIEAIATEGSGETISTSATSEIYIVKAPQPEQVATHTYDNGTFDILPDNSRNSLNPTERVEINYTEKLNGNETQKSFTITKNNNGKWTINNKPNYVEFNQDNGKVVFSANTIKPNSQITITPKAGQGNTENTNPTVIQAPAQHTLTINEIVKEQGQNVTNDDINNAVQVPNKNRVAIKQGNALPTNLAGGSTSHIPVVIYYSDGSSEEATETVRTKVNKTELINARRRLDEEISKENKTPSSIRNFDQAMNRAQSQINTAKSDADQVIGTEFATPQQVNSALSKVQAAQNKINEAKALLQNKADNSQLVRAKEQLQQSIQPAASTDGMTQDSTRNYKNKRQAAEQAIQHANSVINNGDATSQQINDAKNTVEQAQRDYVEAKSNLRADKSQLQSAYDTLNRDVLTNDKKPASVRRYNEAISNIRKELDTAKADASSTLRNTNPSVEQVRDALNKINTVQPKVNQAIALLQPKENNSELVQAKKRLQDAVNDIPQTQGMTQQTINNYNDKQREAERALTSAQRVIDNGDATTQEITSEKSKVEQAMQALTNAKSNLRADKNELQTAYNKLIENVSTNGKKPASIRQYETAKARIQNQINDAKNEAERILGNDNPQVSQVTQALNKIKAIQPKLTEAINMLQNKENNTELVNAKNRLENAVNDTDPTHGMTQETINNYNAKKREAQNEIQKANMIINNGDATAQDISSEKSKVEQVLQALQNAKNDLRADKRELQTAYNKLIQNVNTNGKKPSSIQNYKSARRNIENQYNTAKNEAHNVLENTNPTVNAVEDALRKINAIQPEVTKAINILQDKEDNSELVRAKEKLDQAINSQPSLNGMTQESINNYTTKRREAQNIASSADTIINNGDASIEQITENKIRVEEATNALNEAKQHLTADTTSLKTEVRKLSRRGDTNNKKPSSVSAYNNTIHSLQSEITQTENRANTIINKPIRSVEEVNNALHEVNQLNQRLTDTINLLQPLANKESLKEARNRLESKINETVQTDGMTQQSVENYKQAKIKAQNESSIAQTLINNGDASDQEVSTEIEKLNQKLSELTNSINHLTVNKEPLETAKNQLQANIDQKPSTDGMTQQSVQSYERKLQEAKDKINSINNVLANNPDVNAIRTNKVETEQINNELTQAKQGLTVDKQPLINAKTALQQSLDNQPSTTGMTEATIQNYNAKRQKAEQVIQNANKIIENAQPSVQQVSDEKSKVEQALSELNNAKSALRADKQELQQAYNQLIQPTDLNNKKPASITAYNQRYQQFSNELNSTKTNTDRILKEQNPSVADVNNALNKVREVQQKLNEARALLQNKEDNSALVRAKEQLQQAVDQVPSTEGMTQQTKDDYNSKQQAAQQEISKAQQVIDNGDATTQQISNAKTNVERALEALNNAKTGLRADKEELQNAYNQLTQNIDTSGKTPASIRKYNEAKSRIQTQIDSAKNEANSILTNDNPQVSQVTAALNKIKAVQPELDKAIAMLKNKENNNALVQAKQQLQQIVNEVDPTQGMTTDTANNYKSKKREAEDEIQKAQQIINNGDATEQQITNETNRVNQAINAINKAKNDLRADKSQLENAYNQLIQNVDTNGKKPASIQQYQAARQAIETQYNNAKSEAHQILENSNPSVNEVAQALQKVEAVQLKVNDAIHILQNKENNSALVTAKNQLQQSVNDQPLTTGMTQDSINNYEAKRNEAQSAIRNAEAVINNGDATAKQISDEKSKVEQALAHLNDAKQQLTADTTELQTAVQQLNRRGDTNNKKPRSINAYNKAIQSLETQITSAKDNANAVIQKPIRTVQEVNNALQQVNQLNQQLTEAINQLQPLSNNDALKAARLNLENKINQTVQTDGMTQQSIEAYQNAKRVAQNESNTALALINNGDADEQQITTETDRVNQQTTNLTQAINGLTVNKEPLETAKTALQNNIDQVPSTDGMTQQSVANYNQKLQIAKNEINTINNVLANNPDVNAIKTNKAEAERISNDLTQAKNNLQVDTQPLEKIKRQLQDEIDQGTNTDGMTQDSVDNYNDSLSAAIIEKGKVNKLLKRNPTVEQVKESVANAQQVIQDLQNARTSLVPDKTQLQEAKNRLENSINQQTDTDGMTQDSLNNYNDKLAKARQNLEKISKVLGGQPTVAEIRQNTDEANAHKQALDTARSQLTLNREPYINHINNESHLNNAQKDNFKAQVNSAPNHNTLETIKNKADTLNQSMTALSESIADYENQKQQENYLDASNNKRQDYDNAVNAAKGILNQTQSPTMSADVIDQKAEDVKRTKTALDGNQRLEVAKQQALNHLNTLNDLNDAQRQTLTDTINHSPNINSVNQAKEKANTVNTAMTQLKQTIANYDDELHDGNYINADKDKKDAYNNAVNNAKQLINQSDANQAQLDPAEINKVTQRVNTTKNDLNGNDKLAEAKRDANTTIDGLTYLNEAQRNKAKENVGKASTKTNITSQLQDYNQLNIAMQALRNSVNDVNNVKANSNYINEDNGPKEAYNQAVTHAQTLINAQSNPEMSRDVVNQKTQAVNTAHQNLHGQQKLEQAQSSANTEIGNLPNLTNTQKAKEKELVNSKQTRTEVQEQLNQAKSLDSSMGTLKSLVAKQPTVQKTSVYINEDQPEQSAYNDSITMGQTIINKTADPVLDKTLVDNAISNISTKENALHGEQKLTTAKTEAINALNTLADLNTPQKEAIKTAINTAHTRTDVTAEQSKANQINSAMHTLRQNISDNESVTNESNYINAEPEKQHAFTEALNNAKEIVNEQQATLDANSINQKAQAILTTKNALDGEEQLRRAKENADQEINTLNQLTDAQRNSEKGLINSSQTRTEVASQLAKAKELNKVMEQLNHLINGKNQMINSSKFINEDANQQQAYSNAIASAEALKNKSQNPELDKVTIEQAINNINSAINNLNGEAKLTKAKEDAVASINNLSGLTNEQKTKENQAVNGAQTRDQVANKLRDAEALDQSMQTLRDLVNNQNAIHSTSNYFNEDSTQKNTYDNAIDNGSTYITGQHNPELNKSTIDQTISRINTAKNDLHGVEKLQRDKGTANQEIGQLGYLNDPQKSGEESLVNGSNTRSEVEEHLNEAKSLNNAMKQLRDKVAEKTNVKQSSDYINDSTEHQRGYDQALQEAENIINEIGNPTLNKSEIEQKLQQLTDAQNALQGSHLLEEAKNNAITGINKLTALNDAQRQKAIENVQAQQTIPAVNQQLTLDREINTAMQALRDKVGQQNNVHQQSNYFNEDEQPKHNYDNSVQAGQTIIDKLQDPIMNKNEIEQAINQINTTQTALSGENKLHTDQESTNRQIEGLSSLNTAQINAEKDLVNQAKTRTDVAQKLAAAKEINSAMSNLRDGIQNKEDIKRSSAYINADPTKVTAYDQALQNAENIINATPNVELNKATIEQALSRVQQAQQDLDGVQQLANAKQQATQTVNGLNSLNDGQKRELNLLINSANTRTKVQEELNKATELNHAMEALRNSVQNVDQVKQSSNYVNEDQPEQHNYDNAVNEAQATINNNAQPVLDKLAIERLTQTVNTTKDALHGAQKLTQDQQAAETGIRGLTSLNEPQKNAEVAKVTAATTRDEVRNIRQEATTLDTAMLGLRKSIKDKNDTKNSSKYINEDHDQQQAYDNAVNNAQQVIDETQATLSSDTINQLANAVTQAKSNLHGDTKLQHDKDSAKQTIAQLQNLNSAQKHMEDSLIDNESTRTQVQHDLTEAQALDGLMGALKESIKDYTNIVSNGNYINAEPSKKQAYDAAVQNAQNIINGTNQPTINKGNVTTATQTVKNTKDALDGDHRLEEAKNNANQTIRNLSNLNNAQKDAEKNLVNSASTLEQVQQNLQTAQQLDNAMGELRQSIAKKDQVKADSKYLNEDPQIKQNYDDAVQRVETIINETQNPELLKANIDQATQSVQNAEQALHGAEKLNQDKQTSSTELDGLTDLTDAQREKLREQINTSNSRDDIKQKIEQAKALNDAMKKLKEQVAQKDGVHANSDYTNEDSAQKDAYNNALKQAEDIINNSSNPNLNAQDITNALNNIKQAQDNLHGAQKLQQDKNTTNQAIGNLNHLNQPQKDALIQAINGATSRDQVAEKLKEAEALDEAMKQLEDQVNQDDQISNSSPFINEDSDKQKTYNDKIQAAKEIINQTSNPTLDKQKIADTLQNIKDAVNNLHGDQKLAQSKQDANNQLNHLDDLTEEQKNHFKPLINNADTRDEVNKQLEIAKQLNGDMSTLHKVINDKDQIQHLSNYINADNDKKQNYDNAIKEAEDLIHNHPDTLDHKALQDLLNKIDQAHNELNGESRFKQALDNALNDIDSLNSLNVPQRQTVKDNINHVTTLESLAQELQKAKELNDAMKAMRDSIMNQEQIRKNSNYTNEDLAQQNAYNHAVDKINHIIGEDNATMDPQIIKQATQDINTAINGLNGDQKLQDAKTDAKQQITNFTGLTEPQKQALENIINQQTSRANVAKQLSHAKFLNGKMEELKVAVAKASLVRQNSNYINEDVSEKEAYEQAIAKGQEIINSENNPTISSTDINRTIQEINDAEQNLHGDNKLRQAQEIAKNEIQNLDGLNSAQITKLIQDIGRTTTKPAVTQKLEEAKAINQAMQQLKQSIADKDATLNSSNYLNEDSEKKLAYDNAVSQAEQLINQLNDPTMDISNIQAITQKVIQAKDSLHGANKLAQNQADSNLIINQSTNLNDKQKQALNDLINHAQTKQQVAEIIAQANKLNNEMGTLKTLVEEQSNVHQQSKYINEDPQVQNIYNDSIQKGREILNGTTDDVLNNNKIADAIQNIHLTKNDLHGDQKLQKAQQDATNELNYLTNLNNSQRQSEHDEINSAPSRTEVSNDLNHAKALNEAMRQLENEVALENSVKKLSDFINEDEAAQNEYSNALQKAKDIINGVPSSTLDKATIEDALLELQNARESLHGEQKLQEAKNQAVAEIDNLQALNPGQVLAEKTLVNQASTKPEVQEALQKAKELNEAMKALKTEINKKEQIKADSRYVNADSGLQANYNSALNYGSQIIATTQPPELNKDVINRATQTIKTAENNLNGQSKLAEAKSDGNQSIEHLQGLTQSQKDKQHDLINQAQTKQQVDDIVNNSKQLDNSMNQLQQIVNNDNTVKQNSDFINEDSSQQDAYNHAIQAAKDLITAHPTIMDKNQIDQAIENIKQALNDLHGSNKLSEDKKEASEQLQNLNSLTNGQKDTILNHIFSAPTRSQVGEKIASAKQLNNTMKALRDSIADNNEILQSSKYFNEDSEQQNAYNQAVNKAKNIINDQPTPVMANDEIQSVLNEVKQTKDNLHGDQKLANDKTDAQATLNALNYLNQAQRGNLETKVQNSNSRPEVQKVVQLANQLNDAMKKLDDALTGNDAIKQTSNYINEDTSQQVNFDEYTDRGKNIVAEQTNPNMSPTNINTIADKITEAKNDLHGVQKLKQAQQQSINTINQMTGLNQAQKEQLNQEIQQTQTRSEVHQVINKAQALNDSMNTLRQSITDEHEVKQTSNYINETVGNQTAYNNAVDRVKQIINQTSNPTMNPLEVERATSNVKISKDALHGERELNDNKNSKTFAVNHLDNLNQAQKEALTHEIEQATIVSQVNNIYNKAKALNNDMKKLKDIVAQQDNVRQSNNYINEDSTPQNMYNDTINHAQSIIDQVANPTMSHDEIENAINNIKHAINALDGEHKLQQAKENANLLINSLNDLNAPQRDAINRLVNEAQTREKVAEQLQSAQALNDAMKHLRNSIQNQSSVRQESKYINASDAKKEQYNHAVREVENIINEQHPTLDKEIIKQLTDGVNQANNDLNGVELLDADKQNAHQSIPTLMHLNQAQQNALNEKINNAVTRTEVAAIIGQAKLLDHAMENLEESIKDKEQVKQSSNYINEDSDVQETYDNAVDHVTEILNQTVNPTLSIEDIEHAINEVNQAKKQLRGKQKLYQTIDLADKELSKLDDLTSQQSSSISNQIYTAKTRTEVAQAIEKAKSLNHAMKALNKVYKNADKVLDSSRFINEDQPEKKAYQQAINHVDSIIHRQTNPEMDPTVINSITHELETAQNNLHGDQKLAHAQQDAANVINGLIHLNVAQREVMINTNTNATTREKVAKNLDNAQALDKAMETLQQVVAHKNNILNDSKYLNEDSKYQQQYDRVIADAEQLLNQTTNPTLEPYKVDIVKDNVLANEKILFGAEKLSYDKSNANDEIKHMNYLNNAQKQSIKDMISHAALRTEVKQLLQQAKILDEAMKSLEDKTQVVITDTTLPNYTEASEDKKEKVDQTVSHAQAIIDKINGSNVSLDQVRQALEQLTQASENLDGDQRVEEAKVHANQTIDQLTHLNSLQQQTAKESVKNATKLEEIATVSNNAQALNKVMGKLEQFINHADSVENSDNYRQADDDKIIAYDEALEHGQDIQKTNATQNETKQALQQLIYAETSLNGFERLNHARPRALEYIKSLEKINNAQKSALEDKVTQSHDLLELEHIVNEGTNLNDIMGELANAIVNNYAPTKASINYINADNLRKDNFTQAINNARDALNKTQGQNLDFNAIDTFKDDIFKTKDALNGIERLTAAKSKAEKLIDSLKFINKAQFTHANDEIMNTNSIAQLSRIVNQAFDLNDAMKSLRDELNNQAFPVQASSNYINSDEDLKQQFDHALSNARKVLAKENGKNLDEKQIQGLKQVIEDTKDALNGIQRLSKAKAKAIQYVQSLSYINDAQRHIAENNIHNSDDLSSLANTLSKASDLDNAMKDLRDTIESNSTSVPNSVNYINADKNLQIEFDEALQQASATSSKTSENPATIEEVLGLSQAIYDTKNALNGEQRLATEKSKDLKLIKGLKDLNKAQLEDVTNKVNSANTLTELSQLTQSTLELNDKMKLLRDKLKTLVNPVKASLNYRNADYNLKRQFNKALKEAKGVLNKNSGTNVNINDIQHLLTQIDNAKDQLNGERRLKEHQQKSEVFIIKELDILNNAQKAAIINQIRASKDIKIINQIVDNAIELNDAMQGLKEHVAQLTATTKDNIEYLNADEDHKLQYDYAINLANNVLDKENGTNKDANIIIGMIQNMDDARALLNGIERLKDAQTKAHNDIKDTLKRQLDEIEHANATSNSKAQAKQMVNEEARKALSNINDATSNDLVNQAKDEGQSAIEHIHADELPKAKLDANQMIDQKVEDINHLISQNPNLSNEEKNKLISQINKLVNGIKNEIQQAINKQQIENATTKLDEVIETTKKLIIAKAEAKQMIKELSQKKRDAINNNTDLTPSQKAHALADIDKTEKDALQHIENSNSIDDINNNKEHAFNTLAHIIIWDTDQQPLVFEVPELSLQNALVTSEVVVHRDETISLESIKKKMTLTDELKVNIVSLPNTDKVADHLTAKVKVILADGSYVTVNVPVKVVEKELQIAKKDAIKTIDVLVKQKIKDIDSNNELTSTQREDAKAEIERLKKQAIDKVNHSKSIKDIETVKRTDFEEIDQFDPKRFTLNKAKKDIITDVNTQIQNGFKEIETIKGLTSNEKTQFDKQLTALQKEFLEKVEHAHNLVELNQLQQEFNNRYKHILNQAHLLGEKHIAEHKLGYVVVNKTQQILNNQSASYFIKQWALDRIKQIQLETMNSIRGAHTVQDVHKALLQGIEQILKVNVSIINQSFNDSLHNFNYLHSKFDARLREKDVANHIVQTETFKEVLKGTGVEPGKINKETQQPKLHKNDNDSLFKHLVDNFGKTVGVITLTGLLSSFWLVLAKRRKKEEEEKQSIKNHHKDIRLSDTDKIDPIVITKRKIDKEEQIQNDDKHSIPVAKHKKSKEKQLSEEDIHSIPVVKRKQNSDNKDTKQKKVTSKKKKTPQSTKKVVKTKKRSKK

SEQ ID NO: 4099 - protein, 57 aa, Staphylococcus epidermidis
IRGNNYLYIIHVLTTYSLNNETNNLVIVVLEMRPITSNLSFSLGLTIGNESISLSII

SEQ ID NO: 4100 - protein, 216 aa, Staphylococcus epidermidis
FLLNIKEVKSMLEFRNVYKSFKKKEVLCDVNYKLSAGEKVGLIGSNGSGKSTLMKLIAKTQLPSKGNVYFNNIDIHKSHNMIKDFSFMIGQIYYPELNARQNIENYLKINNKISYISEIQKMLNIVGLEDIEKKVKNYSYGMKQRLCLAICLITKPKVAVLDEPFLGLDPLGVRELNNITEKYSKEKNTLFLISSHQLKELEDLCDRFLLLENPSN

SEQ ID NO: 4101 - protein, 189 aa, Staphylococcus epidermidis
NQLKGTCLNMRLNEKTIDRTVIYNGSIIDLEVHDVELPDGSTSKRELVFHHGAVAVCAITPENEVLLVKQFRKPADQPLLEIPAGKLEKGEDRKEAAIRELQEETGYIASDLQFVTNMYGSPGFSSEKLSIYFTDQLTVGETNLDDDEFVELHKVPLSQIDSLLKDNKIEDAKTIIALQHLLLNYNHSK

SEQ ID NO: 4102 - protein, 51 aa, Staphylococcus epidermidis
YELKLYSYQMKSINIFDYAIELLLILRNKSIVTKIMFNHKEYHLLLYLFKN

SEQ ID NO: 4103 - protein, 45 aa, Staphylococcus epidermidis
MMLNFNHTFKFTFKLSVPIKNLKHIFLLNIVLKLCPIKNRDEILS

SEQ ID NO: 4104 - protein, 389 aa, Staphylococcus epidermidis
CQLKYIYTSKKGVPYMINQKRLLDCFLELVQIDSETGHEETIQPYLKDTFEKMGLHVIEDEASKNNRLGANNLICTLKSNISHQNVPKIYFTSHMDTVVPGKNIQPVVKEDGYVYSDGTTILGADDKAGLAAIIEAIKQIKESNLPHGQIQIIITVGEESGLVGAKAIDTRLLDADFGYAVDASKDVGTTVIGAPTQVKIYTTIKGKTAHASTPKKGISAINIASKAISRMKLGQVDALTTANIGKFHGGSATNIIADEVTLEAEARSHDDQSINKQVKHMKETFETTANELGGQAEVLVEKSYPGFEVSEADKVTQYAISSALALGLKGDTCIAGGGSDGNIMNQYGIPSVILGVGYENIHTTSERIAIKDMYMLTRQIIKIIELVAE

SEQ ID NO: 4105 - protein, 461 aa, Staphylococcus epidermidis
SELNRRNSMMYRCLIANRGEIAVRIIRACRELNIETVAIYAKGDENSLHVSLADQAICIGEANPLDSYLNIDRIISAAKVTESNVIHPGYGFLSESTNFAKAVEDNHIHFIGPSKTTMEMMGDKITARQTVKQAGVPVIPGSNDAVQSVDEIKLLSKEIGFPVVLKAASGGGGKGIRIVKEASHLDQALKEAKSEGQKYFNDDRVYVEAFIPVAKHVEVQIIGDGKNNYVHLGERDCSVQRKNQKLIEEAPCAALTEERRTRICGDAVKVAQASRYRSAGTIEFLVTEDAHYFIEMNARIQVEHTVTEMRADRDLLQAQLYLLTHGELPFTQKDILFNGHVIEARINAENPEKNFLPTPGKVNKLHLPQGFNIRVDSLLYTGYQVSPYYDSLVAKVIVKDSNRQTAINKLKVALDEMVIEGFTTTADFLYAVLNYPIYAKGDASKVDIKFLEKHQIIKEVK

SEQ ID NO: 4106 - protein, 53 aa, Staphylococcus epidermidis
AQIKSKLTNTTDDYLMKISYHNLKREVNFKDLSFNSNVYYFLVYSKLVTKIII

SEQ ID NO: 4107 - protein, 115 aa, Staphylococcus epidermidis
QSIKSTHNRMITVDITVNDEGKVTDVVMDGHANHGEYGHDIVCAGASAVLFGSVNAIMGLTSEKPDINYEDDGGYFHIRSVDTNNKEAQLILQAMLVSLQTIEEEYNENIKLNYK

SEQ ID NO: 4108 - protein, 633 aa, Staphylococcus epidermidis
RGIKMSDRFIKFNDEQLDAKQVMMLQDLARLLLKNEQTQVKIQKFPYYNPYSNTLIASWFWSHRPKHIEQAGLKTDVLLATYGYLNMDLSIINQVLHNNDFEHPKFFHQLFKLLEDVRIFEHIRQQRPSTTKMIDLRIETRLSFTESQINFYKTKTVYTDLLFLYLEHAFLSQNFFNIPSIHPAFDDILVHMYQYLPNIFQNQTSEDNMYLAERIMYQVDDLLKEDMLNEYYYLPQKLYEDIYADSFEDLKRTDASNTDGKDNQQTDEDVETAEAETKAADSESKGGAYLEMELHEGENSEVMADNDTAREGDSTDDMTDMMTKKGKGSENTLDHDEGGFIGQNQAFALKGINKDVSIEWNIPDITPQNVIDYQYSKNDVQFEIKDLIQIIKKTIDREHEDERHNLTKGRLQKDLINWFIDDQFKLFYKKQDLSKTFDATFTLLIDASASMHDKMDETIKGVVLFHETLKSLNIKHEILAFNEDAFEADQRQQPNIIDEIINYNYSIFEKEGPRIMTLEPQDDNRDGVAIRIASERLLQRSHEQRFLIVFSDGEPSAFNYSQDGILDTYEAVERARKFGIEVFNVFLSQEPITEDIEQTIHNIYGQFALFVEGVEHLPSHLSPLLKKLLLKSL

SEQ ID NO: 4109 - protein, 59 aa, Staphylococcus epidermidis
ITVKINNAKFPLLCAIGVTVISNEVEAVRGIANNGPIVRYMIIKKINENRGDILLKDPI

SEQ ID NO: 4110 - protein, 136 aa, Staphylococcus epidermidis
RGVKVMAKIYFDAATKGNPGRSACAIIIKENSQRYTFTHDLGKMDNHSAEWAAMLHALEHARELKVSNALLYTDSKLIEDSMMQGKVKNAKFKVYFENIEILEQSFDLMFVRWIPRKRNKEANQLAQQTLYQLTSQ

SEQ ID NO: 4111 - protein, 62 aa, Staphylococcus epidermidis
ITVKPFLNHTHSAWFSLYNKEASNEFIKNSFTGYFARNYIPDSLNSKFIYITIRNRVWKVLQ

SEQ ID NO: 4112 - protein, 98 aa, Staphylococcus epidermidis
DLSKYKFKGSLIIDALLAFFIVSTITMILIPMFSNLNNQYLINLNNIKIKQIMITSLQHYKKKELYQGVVIENYEIQLFNNKICGEDKAFNTRTCISI

SEQ ID NO: 4113 - protein, 252 aa, Staphylococcus epidermidis
LTKKESQMSKEQERLQKRIANSGYTSRRKAEVLITEGRVKVNGQTVTELGSKVMPSDLVEVDGIKIEQEDKIYILFYKPTQVITSVSDDRGRRVVTDYFDDLESRIYPVGRLDYDTSGVLLLTNDGEFTNLMTHPRYHIKKKYVAKLKGYLMREEIKQLEKGIELEDGYTQPAQVKIKKQDKEKNTTLVEITISEGRNRQVRRMFEYFGHQVNKLTRIQFGPIDLKGLNAGEGRVLTPHEVKILRHLAENGK

SEQ ID NO: 4114 - protein, 339 aa, Staphylococcus epidermidis
RNRKIKRSDLMFSIGFIIIAVIIVVALLILFSFVPVGLWISALAAGVHVGIGTLVGMRLRRVSPRKVIAPLIKAHKAGLNLTTNQLESHYLAGGNVDRVVDANIAAQRADIDLPFERGAAIDLAGRDVLEAVQMSVNPKVIETPFIAGVAMNGIEVKAKARITVRANIARLVGGAGEETIIARVGEGIVSTIGSSEHHTEVLENPDNISKTVLSKGLDSGTAFEILSIDIADVDISKNIGADLQTEQALADKNIAQAKAEERRAMAVASEQEMKARVQEMRAKVVEAESEVPLAMAEALRSGNIGVKDYYNLKNIEADTGMRNAINKRTDQNDDESPQQ

SEQ ID NO: 4115 - protein, 329 aa, Staphylococcus epidermidis
FRRKSTRGGFIMSKNKKQSLQSAHQKPLLKRMWEHKVLYLMILPCLLFFLIFNYIPMTSLVLAFKDFRFDTGIIGGDWKGLYYFKRFFSDPRCIQIIMNTLIISGMKLILALPFPIILAIMFNEIKDSKLGKIRGLFQGVLYIPHFLSWVVVISIFKKLLAPDDGLMNQLIHQFGGDGSTYFMMNPEYFHTIMFSSYIWKNVGWDSIIYFAAIMSINPEIYESAAIDGANRFKQIIHITLPMLTPTIVILFIISLGDILKAGFDQIYLLKTPGNANVSEILDTFVIRTGIEQGDFSYAIAISLLQGVIGLIAVVIINKFADKKLDTSLY

SEQ ID NO: 4116 - protein, 230 aa, Staphylococcus epidermidis
SCRNEGEKMHEQSKIYQNIKDGKLDTALKDLFENIEENPAIVENYINAGIVLSDVGEIEKAERFFQKALTIEPENGAVYYNLANIYYNEERYNEAIKLYQTALQYEVAKKDCNYMIGMSFNQLGAFKEALPFLMTAAEMDDDRDLEVQFQYGLVLCQLEMFDEAIKQLNKVLSIDSQHVDGIYNLGLATYMKNENLDEAIAYFEQAISIDEKHLLSQHALKTFKTMKEEE

SEQ ID NO: 4117 - protein, 41 aa, Staphylococcus epidermidis
KNRKKLKSISFCDTVCIDIKNTLLLGKVLVKVNDYNLFIIV

SEQ ID NO: 4118 - protein, 81 aa, Staphylococcus epidermidis
LGGKISMAEVKVPELAESITEGTIAEWLKNVGDNVDKGEAILELETDKVNVEVVSEEAGVLSEQLAEEGDTVEVCQAVAVV

SEQ ID NO: 4119 - protein, 172 aa, Staphylococcus epidermidis
INLKSIQVPIILVGFMGTGKTTVGKYLSDLYNLSYVDLDNFIEVNECKSIPNIFNDIGEKGFRSLETRYLKSCLNTFDIISTGGGIIEDTNSLKLLKNQKHVVWLDCDIEIIFKRVKNDSHRPNAKSKNLNQLDALYSSRLSRYNEIAFMKVDSAQSVSEICTLIKTKLLSD

SEQ ID NO: 4120 - protein, 79 aa, Staphylococcus epidermidis
CILKEFSLGGFRIMKQGTVKWFNAEKGFGFIEVEGENDVFVHFSAINQEGYKSLEEGQSVEFEVVEGDRGPQAANVVKL

SEQ ID NO: 4121 - protein, 42 aa, Staphylococcus epidermidis
IKLNAITLIKLVIKIYIKEERRDRQTLYYNWSNEWVRFCNNQ

SEQ ID NO: 4122 - protein, 165 aa, Staphylococcus epidermidis
KIMKYNYSIIKYVGRIKHLIREHVFQFNIKAFTYIEALFALFVTTLILALLPTILKLTSFYLNTAQNNEDIQFEFFRRDLLKEKMTTQNNYEIENAYTIKLKKDKDVIRYIYKNRKIYKNINQKGNITLLNHVLSTRILKTNDNIVKLLITTGETNDEHKEILFI

SEQ ID NO: 4123 - protein, 41 aa, Staphylococcus epidermidis
KIMKNFKWKYFIKPKLIKLSEQKAKTIYSQRKFGLEAFLDL

SEQ ID NO: 4124 - protein, 138 aa, Staphylococcus epidermidis
RLMNSLTSSTTCSGLKIKVSNEVEKKMSDVSLKLSAKDIYEKDFEKTMARGYRREEVDAFLDDIITDYQKMADMNNEVVKLSEENHKLKKELEELRLRVATSRPQDNKNFSSNNSSSASNNVDILKRISNLEKAVFGK

SEQ ID NO: 4125 - protein, 210 aa, Staphylococcus epidermidis
IMMNYPNGKPYSKNKPLDGRKSSPFSSNIEYGGRGMTLEKDIEQSNTFYLKSGIAVIHKKPTPVQIVNVHYPKRSKAVINEAYFRTPSTTDYNGVYNGYYIDFEAKETKNKTSFPLNNIHAHQVEHMKNTYHQKGIVFLMIRFKSLDEVYLLPYSKFEKYWQRYINNIKKSITVEEIRKNGYHIPYQYQPRLNYLKAVDKLILDESEDRV

SEQ ID NO: 4126 - protein, 428 aa, Staphylococcus epidermidis
KGVKNVSTEPLASRMRPKNIDEIISQQHLVGPKGIIRRMVDTRRLSSMIFYGPPGIGKTSIAKAISGSTQFKFRQLNAVTNTKKDMQLIVEEAKMSGQVILLLDEIHRLDKAKQDFLLPHLENGKIVLIGATTSNPYHAINPAIRSRAQIFELYPLDQDDIRLALDRAINDKERGLSTYHPIVDEDAIEYFSTQSQGDVRSALNALELAVLSAHIGEENERHITLDDAKDCLQKGAFVSDKDGDMHYDVMSAFQKSIRGSDVNAALHYLARLIEAGDLPTIVRRLLVISYEDVGLASPNAGQRTLAAIQSAERLGFPEARIPLSQAVIELCLSPKSNSGITAIDKALGDIRNGHIGQIPDYLKDGHYSGAKKLGRAIGYKYPHNYENGHVVQQYLPEKLKNRVYYEPKTTSKSEQQFKTIYDNLRNKT

SEQ ID NO: 4127 - protein, 618 aa, Staphylococcus epidermidis
MTKNKKEFTEAPVNFGANLGLMLDLYDDYLQDPSSVPEDLQVLFSTIKTGEAHIEAKPTTDGGGSQAGDSTIKRVMRLIDNIRQYGHLKADIYPVNPPERQNVPKLEIEDFDLDKETLEKISSGIVSEHFKDIYDNAYDAIVRMERRYKGPIAFEYTHINNNKERVWLKRRIETPYKASLNDNQKKELFKKLAHVEGFEKYLHKNFVGAKRFSIEGVDTLVPMLQHTITLAGNEGIKNIQIGMAHRGRLNVLTHVLEKPYEMMISEFMHTDPMKFLPEDGSLELTSGWTSDVKYHLGGVKTTNSYGIEQRISLANNPSHLEIVAPVVAGKTRAAQDNTHQVGAPSTDFHKAMPIIIHGDAAYPGQGINFETMNLGSLKGYSTGGSLHIITNNRIGFTTEPIDGRSTTYSSDVAKGYDVPILHVNADDVEATIEAIEIAMEFRKEFHKDVVIDLVGYRRYGHNEMDEPSITNPVPYQNIRKHDSVEILYGKKLVDEGIISEDEMNEVIDGVQKEMRTAHDKIDKNDKMNNPDMEKPESLQLPLQSDTKDFSFDHLKEINDAMLDYPKDFHVLKKLNKVLEKRREPFEKEEGLVDWAQAEQLAFATILQDGTSIRLTGQE

SEQ ID NO: 4128 - protein, 76 aa, Staphylococcus epidermidis
QVKNSERGTFSHRHAVLHDEDNGNTFTPLHHVPQQQATFDIHNSPLSEAAVVGFEYVYNVENKGNFNIWEAQYGDF

SEQ ID NO: 4129 - protein, 302 aa, Staphylococcus epidermidis
CKKKLVIKEMKKLQMNKLINIINTSLNKSIQSSPLKTNLEESMKYSLNAGGKRIRPVILLLTLKMLNKDYQQGLNSALALEMIHTYSLIHDDLPAMDNDDYRRGKLTNHKVYGEWKAILAGDALLTKAFELVSNDTTIEDSVKVSIIKRLSKASGHLGMVGGQALDMESEGKSIRLETLESIHETKTGALLNFSVMAAVDIAQVEQNIAKNLDEFSHHLGMMFQIKDDLLDVYGDESKLGKKVGSDIVNHKSTYVSLLGKEGAEEKLNNHQYLAMNCLNQISDQYDTSELSDIVDLFYNRDH

SEQ ID NO: 4130 - protein, 69 aa, Staphylococcus epidermidis
QQEKRTMNTKKSCLYSRKAFISLYLIVIFSIYLSIISFYISQYSLKLKTIHNLDVYYNKVIVNKLKEVD

SEQ ID NO: 4131 - protein, 40 aa, Staphylococcus epidermidis
KRRKFEQQKTSIFSHPDYTVGFRLSLNQDKAKINTLSSQA

SEQ ID NO: 4132 - protein, 815 aa, Staphylococcus epidermidis
KRRNNMSDPTLFDYSMIKGTVDAILFQNTDNFYTVLKVDTIESNEKFDSMPTVVGFLPNVVEGDVYTFKGQVVQHPRYGKQLKAETFEKELPQTKEAIISYLSSDLFKGIGKKTAQNIVNTLGENAINDILTRPEILESVPSLPKKKQKQIADQINANQESEKIMIRLHDLGFGPKLSMAIYQFYMGDTLNVLDKNPYQLVYDIKGIGFNKADQLARNVGIEPHSPERLKAALLFTLEEECIKQGHTYLPRTIVIETTQNLLNEDIEKPIETEQLLEIIDVLSEEKKLISEADQVSIPSLYYSELKSVQNLYRIKTNTSKLKEIEQSDLQIHIGDIESQNEVNYSASQKEALETAINSKIMLLTGGPGTGKTTVIKGIVELYAEIHGLSLDYDDYNEDDYPVVLAAPTGRASKRLHESTGLEAMTIHRLIGWNQDTQPQDILENEINARLIIIDEMSMVDTWLFHQFLSAVPLEAQIVFVGDEDQLPSVGPGQVFKDLIDSEIIPRVNLTEVYRQQDGSSIIDLAHRMKLNEPIDITKRYHDRSFIRCGTNQIPDVVDKVVKSAVAKGYDMSDIQVLAPMYKGNAGIKRLNQVLQSILNPKQQDDREIEFGEAVFRKGDKVLQLVNRPNDNIFNGDIGIIVGIFWAKENALNKDVLVVDFEGNEITFTKQDLMELTHAYCTSIHKSQGSEFPIVIMPIVRQYYRMLQRPILYTGLTRAKQSLVLLGEQEAFDIGLKTNGQIRLTQLNDLLKSYFGQNKDNLTTNKQTINEQKENNNHLDLKNEKENDIQLNESTIFQIDPMINMGEMTPYDFVER

SEQ ID NO: 4133 - protein, 89 aa, Staphylococcus epidermidis
EKNLVTITEVLFINYRPLVVFIKIYAFLCLIFTNLRYIYSISISRFRKILTRFTLTILFNCRVSRENNLIIKTFLKAYSLLLINLLVMI

SEQ ID NO: 4134 - protein, 69 aa, Staphylococcus epidermidis
LNIEERKVGIIIKLIIRERIIDKNSQYSDNLRYDIIPMLIFSTIVVIITILSDMNKLFSFNFSILKFTI

SEQ ID NO: 4135 - protein, 75 aa, Staphylococcus epidermidis
VIIEKLSLNLYLITYKIILEGNLINRLDSNDSLRCKIKANSKEPIEIEVNKLKLFSKMLNTTSLNKISSPKAIKK

SEQ ID NO: 4136 - protein, 204 aa, Staphylococcus epidermidis
RSTDMYAYIKGTLSQLFPTHVVVETCGIGYEIQTPNSYRFQKYLEKEVQIYTSLIVREDAQLLYGFINEEEKEMFLSLIKVTGIGPKSALAILASSTPHEVKLAIENENDAYLTQFPGIGKKTARQIVLDLKGKVTITEENSDDLLQTQVNGNEQNQIISEALLALQALGYSKRELTKVEKSLNKHNVNSVDEAVKIGLQTLVS

SEQ ID NO: 4137 - protein, 216 aa, Staphylococcus epidermidis
QHDEKGNWLMNQTTIIGIAGGSGSGKTTVTNAIMKNLEGHSVALLAQDYYYKDQSHLTFEERLETNYDHPFAFDNDLLIHNLKDLRNGKPVEVPTYDYSQHTRSKETIAFDPKDVIIVEGIFALENNTLRDMMDVKIYVDTDADLRILRRLTRDTKERGRTMESVINQYLNVVRPMHEQFIEPTKKHADIIIPEGGSNKVAIDIMTTKIQSLVSKK

SEQ ID NO: 4138 - protein, 563 aa, Staphylococcus epidermidis
GCDEFMLQTLSIKQFAIIDELDINFSDGLTVMSGETGSGKSIIIDAIGQLIGMRASSDYVRHGEKKAIIEGIFDIDESKDAINILESLAIDVDEDFLLVKREIFSSGKSICRINNQIVTLQDLRKVMQELLDIHGQHETQSLLKQKYHLQLLDDYADNQYSDLLNQYQLSYNQYKNKRKELEELESADQALLQRLDLMKFQLEELTEASLKEGEVDQLESDIKRIQNSEKLNLALNNAHQVLTDESAIPDRLYELSNYLQTINDIVPEKFVRLKEDINQFYYLLEDAKHEIYDEMANTEFDEQVLNEYESRMNLLNNLKRKYGKDITELIAYQSKLANEIDKIENYEQSTSQLREEIKTLYNEVIDIGKKLSQERRRVARELRDHIVSEIQNLQMKDANLEISFKPLDEPTIEGIEFVEFLISPNRGEPLKSLNKIASGGELSRIMLALKSIFVKSRGQTAILFDEVDSGVSGQAAQKMAEKMRDIAQYIQVICISHLPQVASMSDHHLLISKASNADRTTTQVKELKDENKIDEIARMISGASVTELTRENAKEMIKQNHNI

SEQ ID NO: 4139 - protein, 115 aa, Staphylococcus epidermidis
RRRDDMIEKQDFNHIEDQLDQLASNKQLKTPEARELLDSYFDLIINYFKQINNIDEIHFNQLDTYPVVPMNFDERYHYMVARKHHFMGYRQMKTLKSELIKMNASYLIRKQRQQK

SEQ ID NO: 4140 - protein, 259 aa, Staphylococcus epidermidis
KVGDQLMLMKQKGIIIKSVDYGESDKIITILNEYGAKIPLMARRAKKVKSGLQANTQLFVYGLFIYNKWRGMGTLNSVDVINQHYELQLDLFESSYASLCAETIDRSMEENEVSKYNYDLLQFVLSKINEGTPAQLMSVIVLLKNMSKFGFTASFDHCAITGIQDQSKLIAYSFKFDGAISESALYQDQHAFHLSNRTLYLLNILQQLPISKMNHLNIQQDILNEMSELLIMLYREYAGMFFKSQKLINQLNRLEKDSL

SEQ ID NO: 4141 - protein, 241 aa, Staphylococcus epidermidis
GRGEKMDNLHLIHMLFMAKPLNGMNWVENLAQFITQPFVSLIFTCIIFIGFLYQLYSKRINLMGIIALLALLLLFLAFLINGDVNVMSVLLFTIGLILLIVELFVIGAVIGIIGIILITLSIIILGDNILLMLGNVIVALILSIVEWVILVKIFNRKIPFLDKVILKDSTNSEAGYRSHDDRSHLVGKTAHTVTDLRPAGIITCDNDRIDAVSDGSFILRNRQVKILEVEGTRVVVREIEK

SEQ ID NO: 4142 - protein, 70 aa, Staphylococcus epidermidis
RRSDVIGKHFIITGATSGLGFAITNELLQRGAHVTILARNIDKFNRIKENYFKPEHINVIKCDLMQRKEY

SEQ ID NO: 4143 - protein, 209 aa, Staphylococcus epidermidis
RPIELSQRQEQIIEIVKSEGPITGEHIAEKINLTRATLRPDLAILTMSGFIEARPRVGYFYSGKSKNKIINEKLRKYVVKDYMSHPVVIKENMTVYDAICTIFLEDVSTLFITNENNDFVGVCSRKDLLRASMIGEDIHTMPISVNMTRMPHVSYLKEQELVIYAANQMIDKEIDSLPIVRPKENDKFEVIGRISKTTITKLFVSLFKE

SEQ ID NO: 4144 - protein, 355 aa, Staphylococcus epidermidis
LLIDYQYLLKSGGLFMSDNQVKIKKQTIDPTLTLEDVKKQLIDKGKKEGHLSHEEIAEKLQNFEMDSDQMDDFFDQLNDNDITLVNEKDSSDTDDKINPNDLSAPPGVKINDPVRMYLKEIGRVNLLSAQEEIELAKRIEQGDEIAKSRLAEANLRLVVSIAKRYVGRGMLFLDLIQEGNMGLIKAVEKFDFSKGFKFSTYATWWIRQAITRAIADQARTIRIPVHMVETINKLIRVQRQLLQDLGRDPAPEEIGEEMDLPPEKVREILKIAQEPVSLETPIGEEDDSHLGDFIEDQEAQSPSDHAAYELLKEQLEDVLDTLTDREENVLRLRFGLDDGRTRTLEEVGKVFGVTT

SEQ ID NO: 4145 - protein, 283 aa, Staphylococcus epidermidis
LLIDALLNFDFIRYSLISGLLIGFIAPLIGAFIVVRRLSLIADALSHVTLGGISFGMFLLTIIPVFSVINPMWFGILFAVIGALLIEKLRTSFSNYQEIAIPIIMSAGIALSAIFISLADGFNQEIVGLLFGSISAVNISDLTTIIIITIIVLIFIVLFYKELFILSFDEEYSKVIGIPKWIQFLFIVIVAMVISASMRVVGILLVSALITLPIAISMRITKGFKQLIALSVILGELSVILGLIIAFYMNISPGGVIVVLLVLMLILTMIIQKLKIKFKKGVV

SEQ ID NO: 4146 - protein, 246 aa, Staphylococcus epidermidis
EVVESMTNEILIVDDEDRIRRLLKLYLERESFEIHEARDGKEAYELALENNYACILLDLMLPEMDGIEVASKLREHKDTPIIMLTAKGEETNRVEGFESGADDYIVKPFSPREVVLRVKALLRRTQTANTEQSEPHARDIIEFSHLVIDNDAHRVLADDQQVNLTPKEYELLIYLAKTPNKVFDREQLLKEVWHYEFYGDLRTVDTHVKRLREKLNRVSSDAAQMIQTVWGVGYKFEVKPSDEPTK

SEQ ID NO: 4147 - protein, 117 aa, Staphylococcus epidermidis
MNSEELLNIAVEAAENKKAEDIISLNMNEISDMTDYFVVCHGNNERQVQSIARSVKEVAHKHDIDVKRMEGYQEARWILIDLANVVVHVFHKDERSYYNLEKLYQDAPIKEYGQAVF

SEQ ID NO: 4148 - protein, 474 aa, Staphylococcus epidermidis
TMSEKQYDLVVLGGGTAGYVAAIRASQLGKKVAIVEKSLLGGTCLHKGCIPTKALLKSAEVNHTIKNAHTFGIDVNHFKINFPKILERKDAIVKQLHEGVNQLMKHHHIDIYNGIGRIMGTSIFSPQSGTISVEYEDGESDILPNKNVLIATGSSPQSLPFIKFDHKQILSSDDILRLNTLPQRLAIIGGGVIGLEFASLMNDLGADVVVIEANDRVLPTESTQVASLLKEELTNRGVTFYENIQLTKDHFNQTDKGVTINISDEPVQFDKVLVAIGRKPNTNDIGLNNTQIKTSDAGHIITNAYQQTEDKHIYAAGDCIGQLQLAHVGSKEAIVAVEHMFDCSPIPINYDLIPKCVYTNPEIASIGKNLEQAKKAGIKAKSIKVPFKAIGKAIIEDVTQSKGFCEMVVNKDDDEIIGLNMIGPHVTELINEISLLQFMNGSSLELGLTTHAHPSLSEVVMELGLKANGQAIHV

SEQ ID NO: 4149 - protein, 303 aa, Staphylococcus epidermidis
EVAETMKVSQDKSALVIRIISLIIIIGLVITIILPMINIFALAFNSGVDAQKGGITFYPRKFSLDNFKEIFKQGTLLNALFISIAKTVIGTILSVILTAMAAYVLTIKSLPFRRIISFFLVFTMLFSVGVVPLYILLNQLHLTDTFWVYILPSLYSVYNILIMRTFFNQLPSSVIEAARVDGCNDFQIFWKIVLPMSKPVVASITLFNAVSQWNDWFTGAFFVRNPNLKPLATVLQDMLTKQAAIADALKQKSGSYAMLDKLTITGDSMQMAMIVLLTIPVLFLFPFVQKHFVKGITIGSTKE

SEQ ID NO: 4150 - protein, 459 aa, Staphylococcus epidermidis
LLKDNLKRWFGFDEFKEGQEEIIDSVLHGRHTLGILPTGSGKSLCYQLPTYILEKPTLIISPLISLMDDQVMQMKLKGETHVACVHSGMDEVEKRDNIKRLSKSRFIYLSPEYILQPHNFKYIAHINFGLIVLDEAHCLSEWGYDFRPHYALVGKIIHHFNSATVLALTATAPPQLETDLSHILSLKLNVVQKSMNRENISLQHYNFNDDEGKIEWLLPFLSNSGPTIIYVSSKKRCLELAQMIYDSGYLTGIYHGDLSYQERQTVQQQFFNNDIPVIVATSAFGMGINKKDIRTVIHFHLSSSPSNYLQEIGRAGRDGKQSQAISLFQPDDSFILETLLFTDIITDDDITMFETGNHLPDEKEKILSTLNIQFTFSQLKDIFHQSYQRKRLGYMRMMGYTNLDQCRRKYLLEFFGEHPQSPKQCCDQDSRLEPIQILNRKKVKRKLSFNEKLYNLFET

SEQ ID NO: 4151 - protein, 415 aa, Staphylococcus epidermidis
TMEDIYKLIDDINLQKIENLDSRVNEALSSNNDDALFILGETLYNFGLTPQGLEVFRTLYHKYPDESELLIYFIEGLMSENQTDEALEYLAQVEPSTEKLMLEADLYQQINMLEVAIDKLQEALDLEPNDPIIHFALAELLYYDGQYLRATREYETVLETGEYEVNGVNIFSRMADCSLQSGNYSDAISLFDEINEEEMNSEDYFKKSIAYEKNDLTQEAIKIMQTLLSKDPDFIQGYFYLQSLFENEKNYPDAIETGKEGLRLSQFYKELMVSTGSLEIEHGDANEGVELLKQALEVDNAYHEPLLILSDLYRNEEDYESIIQLLTYVDEEDLDPIFMWHLAYAYGQEERDKEAQHFFELAYPTLQTQVEFLSDYYFYLLEIGQKEKAILILNQLLEIDPSNENWHDESMRLQI

SEQ ID NO: 4152 - protein, 147 aa, Staphylococcus epidermidis
QIMDLNFDLYMNDVVEQARNEIEHAGYQQLTSAEDVDQVLQQKGTSLVMVNSVCGCAGGIARPAATHALHYDKLPQRLVTVFAGQDKEATQQAREYFEGYAPSSPSFALIKDGKITEMIERHQIEGHDVMDVINQLQALFDKYCEER

SEQ ID NO: 4153 - protein, 176 aa, Staphylococcus epidermidis
NLMDQSLMDYYYQFHKHQHYFLCHDILEDAWKSQNTFSKHDAVVSLILFATANYHYRRGNLKGALKSFEKALLTINHAKDDTQLHLNINEFKQLIVKMIEAVKLQKQFTPLQLPIEPEFQTLIKRKYPDYLFTSQIIKEPYIVDHHIKRDRTEVIKNRERALFHRQYRNKSNKKDQ

SEQ ID NO: 4154 - protein, 56 aa, Staphylococcus epidermidis
KGKEEKLMRVNVTLACTECGDRNYISTKNKRNNPERVEMKKYCSRDNKHTLHRETK

SEQ ID NO: 4155 - protein, 223 aa, Staphylococcus epidermidis
NNKEGYQIMSSINIALDGPAAAGKSTIAKRVASRLSMIYVDTGAMYRAITYKYLQNGKPENFDYLINNTKLELTYDEVKGQRILLDNQDVTDYLRENDVTHHVSYVASKEPVRSFAVKIQKELAAKKGIVMDGRDIGTVVLPDAELKVYMIASVAERAERRQKENEQRGIESNLEQLKDEIEARDHYDMNREISPLQKAEDAITLDTTGKSIEEVTNEILSLL

SEQ ID NO: 4156 - protein, 387 aa, Staphylococcus epidermidis
FDKECPNMEVYADYAATTPVKPEVIDAMMEIYQSHFGNPSSIHSIGRDARKYLDQSRRTVAQLLGANPNEVIFTSGATESNNTAIKGLVKANEQLGNHIITTKIEHHSVLHVYEQLEKEGYDVTYLDVDDTGAVDLDQLKETINDRTILVSIMFVNNEIGTVQNIYDIEDIIGDTHALFHVDAVQAIGHLDLDFHNFKIDTMSISAHKFGGPKGVGLLLVKEHTPIAYNQLGGEQETKRRAGTENLPQIVGLTKALELAITNQDVNNVHLMNLKELFLVQLQERAIPFELNGSMTDSTGHILNIYFPFIDVETMLTLLDLAHVYVSSGSACTAGSTTPSHVLAAMFEDEERAKHSVRFSFNEQTTTQEIKYIVAEIHKIYHKFKEES

SEQ ID NO: 4157 - protein, 331 aa, Staphylococcus epidermidis
YIEEGVRMSNNIFTVYGEVPELVEKKTKEIVNDYLGQEIDDFNYVKYNLYESDLTPIIEETLTMPFFSNKKAIVVKNSYVFTGEKFSKDLNHNSDELIKFLEKYDGENLIIFEVYQPKLDERKKLTKTLKKNAQLKKIEQMSEKELKHWIKNTLNNNYKDIKQDALELFIELTGVNYNIVSQELEKLILFIGERPIINKEDIDLIINRSLEQNVFLLTEYIQKGNKNKAIQLVNDLIIMKEEPIKLLALITSNYRLYYQCKILSQKGYSGQQIAKTVNAHPYRVKLALNQSRHYKLESLFNIINACAETDYKLKSSYMDKQLILELFILSL

SEQ ID NO: 4158 - protein, 443 aa, Staphylococcus epidermidis
KREEVYPMTKPIVAIVGKPNVGKSTIFNRVVGERVSIVEDTPGVTRDRIYSSGEWLTHEFNIIDTGGIEIGDAPFQTQIRAQAEIAIEEADVIIFMVNVREGLTQSDEMVAQMLYKSKKPVVLAVNKVDNLEMRNDIYDFYSLGFGDPYPISGSHGLGLGDLLDAVVENFNKESEDPYDEDTIRLSIIGRPNVGKSSLVNAILGEERVIVSNVAGTTRDAIDTEYSYDGQDYVLIDTAGMRKKGKVYESTEKYSVLRALKAIERSEVVLVVIDAEQGIIEQDKRVAGYAHEEGKAIVIVVNKWDTIEKDSKTMKKFTDDVRNEFQFLDYAQIAFVSAKEGLRLKTLFPYINQASENHKKRVQSSTLNEVVTDAISMNPTPTDKGRRLNVFYTTQVAIEPPTFVVFVNDVELMHFSYRRYLENQIRNAFGFEGTPIHIIPRKRN

SEQ ID NO: 4159 - protein, 60 aa, Staphylococcus epidermidis
DLLLHHVLKKYFVISKHLLKYHDIGSNVDAYEIDNNNPLMIDPLDFTHNLKVVCIHAIII

SEQ ID NO: 4160 - protein, 52 aa, Staphylococcus epidermidis
VLCSNSLSVIPNLSRLLFNTSPIVFTQSPPRHYSKKPNPPPNGSPKSKLFLL

SEQ ID NO: 4161 - protein, 211 aa, Staphylococcus epidermidis
RRISMIVKFCGFKTESDIKKIKKLEVDAVGFIHYPDSKRHVSLKQLKYLAKIVPDHIEKVVVVVNPQMSTIKRIINQTDINTIQLHGNESIQLIRNIKKLNSKIRIIKAIPATRNLNNNIQKYKDEIDMFIIDTPSITYGGTGQSFDWKLLKKIKGVDFLIAGGLDFEKIKRLEIYSFGQCGYDISTGIESYNEKDFNKMTRILKFLKGDE

SEQ ID NO: 4162 - protein, 64 aa, Staphylococcus epidermidis
RSLSKTRPPTTESYLYNILYLLYKHFKQNTSLLRIFVRIYCVIADTKTNKRTYIFCKNLKYTIY

SEQ ID NO: 4163 - protein, 706 aa, Staphylococcus epidermidis
ERRFIMSQEKKVFKTEWAGRSLTIETGQLAKQANGAVLVRYGDTVVLSTATASKEPRDGDFFPLTVNYEEKMYAAGKIPGGFKKREGRPGDEATLTARLIDRPIRPLFPKGYRHDVQIMNIVLSADPDCSPEMAAMIGSSMALSVSDIPFQGPIAGVNVGYIDGKYVINPSVADKEISRLDLEVAGHKDAVNMVEAGASEITESEMLEAIFFGHEEIKRLVAFQQEIIDHIQPIKQEFVPVERDEDLVEKVKSLTEDKGLKDTVLTFDKQQRDENLDALKEEVVGHFLDEEDPENETLVKEVYAILNDLIKEEVRRLIADEKIRPDGRKVDEIRPLESEVGLLPRAHGSGLFTRGQTQALSVLTLGALGDYQLIDGLGPEVEKRFMHHYNFPNFSVGETGPVRAPGRREIGHGALGERALRYIIPDTQDFPYTIRIVSEVLESNGSSSQASICGSTLALMDAGVPIKAPVAGIAMGLVTRDDSYTILTDIQGMEDALGDMDFKVAGTKDGITAIQMDIKIDGLTREVIEEALEQARQGRLAIMDHMLHTIEQPREELSAYAPKVVTMSINPDKIRDVIGPGGKKINEIIDETGVKLDIEQDGTIFIGAVDQAMINRAKEIIEDITREAEVGQVYHAKVKRIEKYGAFVELFPGKDALLHISQISQERINKVEDVLKIGDTIEVKITEIDKQGRVNASHKVLEQSKN

SEQ ID NO: 4164 - protein, 315 aa, Staphylococcus epidermidis
LDTSKGQSSMEEVLKLKIPASTANLGVGFDSIGMALDKYLHMSIRKIERANWEFLYYSSELEGLPKDENNYIYQTALNVARKYNVTLPSLQIEMRSDIPLARGLGSSASALVGALFIANYFGNIQLSKYELLQLATEIEGHPDNVAPTIYGGLIAGFYNPITKITDVARIEVPHVDIILTIPPYELRTEDSRRVLPDTFSHKGAVQNSAISNTMICALIQHKYKLAGKMMEQDGFHEPYRQHLIPEFNQVRKLSRQHDAYATVISGAGPTILTLCPKEKSGKLVRTLREKINNCASELVTINEIGVKDEVVYLKS

SEQ ID NO: 4165 - protein, 62 aa, Staphylococcus epidermidis
IQTSSWLNIRKVTAQRAENNQKNYKKDNFYIFSIEIVFFTYLEPFCPSLFRDSFFNYLQRNF

SEQ ID NO: 4166 - protein, 301 aa, Staphylococcus epidermidis
WRGLILDKIQETFLYMLKVERNFSEYTLKSYHDDLVQFNNFLEREHLQLETFEYKDARNYLAFLYSNQLKRTTVSRKISTLRTFYEFWMTQDNSIINPFVQLVHPKKEKYLPQFFYEEEMEALFQTVEHDNKKGIRDKVIIELLYATGIRVSELINIKLKDIDMNLPGVKVLGKGNKERFIPFGEFCRQSIERYLEEFQPKQLANHDYLIVNMKGDPITERGVRYVLNDVVKRTAGVNDIHPHKLRHTFATHLLNQGADLRTVQSLLGHVNLSTTGRYTHVSNQQLRKVYLNAHPRAKKGE

SEQ ID NO: 4167 - protein, 292 aa, Staphylococcus epidermidis
VVMSLTIILSIIIIILIMAMVLNQKFMKDRVETEEYARNQLISKNSILSEENLSLKNQMLSTNNDVGQHAFKNAKRELRKILNRFKEEGRLRSYTIVPTSNLAVKHPLFEYARSFDFIIITDVGLINVDVKNWNQKTFYHFDVPDQHLEEGQPQYNTEKVVGHYISNRYHSQFKTTRSGVYTFIEILQDNRVIYEFYDHDPYDKAANNAKALKDKIENDYNFKIQSIGVIYFSDGSVNIIEGSDESDKYVDTVSTPISLEKVIEEAIDLSKHPLTDKQIEEISENFKQHMNN

SEQ ID NO: 4168 - protein, 43 aa, Staphylococcus epidermidis
FELFLCLFFNIRSHFISPLIFIYIYMPLIKLYYYMFIKTTMYR

SEQ ID NO: 4169 - protein, 42 aa, Staphylococcus epidermidis
FRPPTNVRSLLKLYNSYSYINSPKLQVSFKLLSCLSNFIELN

SEQ ID NO: 4170 - protein, 148 aa, Staphylococcus epidermidis
KRLLKNLVAKKSISSNGMKIPKVFVRNALSPSQVLEVIVDEENQSTVVVVPDYQLSLAIGKRGQNARLAAKLTSWKIDIKSESDAREAGIYPVIESEEVADEIVNSGDEDVEFDNVNLEETNLTSTELAAENDEDKKDKTEEDNDTES

SEQ ID NO: 4171 - protein, 108 aa, Staphylococcus epidermidis
IAAPKPIGTATIVAITVIFNVPMMSAQIPNSGDEPVGFQVPDKKNLDNGTRVKNVIVSVKSVNKIAIVVNIDIAEIMAKIIGTILSLSPPFLALFLAIISLTFVCEAM

SEQ ID NO: 4172 - protein, 56 aa, Staphylococcus epidermidis
IDDPFEHVHRLIQQFLVYFLFYKSHAVSRYTSPFKSYSRHFIIECEQRLTTQIVLN

SEQ ID NO: 4173 - protein, 111 aa, Staphylococcus epidermidis
RRDPKIMTKMKIFNLLGLAMRAGKIKSGESVILNELKKNQIKLVILASDASSNTLKQMNNKCNSYQVPLKVFGTRNELGLAIGKSDRVNIGITDNGFAKKLLSMIDEYGKE

SEQ ID NO: 4174 - protein, 70 aa, Staphylococcus epidermidis
YMMLGVKEMDTSNENKITIIAVIVAIIVGVVLQIVFKLPLIVSLVGSVFLGMFVGFIVYLIQSFRRKKKN

SEQ ID NO: 4175 - protein, 63 aa, Staphylococcus epidermidis
TIKPTNIPKNTDPTKLTIKGSLKTICSTTPTIIATITAMIVILFSLDVSISFTPNIMYYIMLL

SEQ ID NO: 4176 - protein, 52 aa, Staphylococcus epidermidis
DSEPLNGPEWFTNWKIITSIPIIATTKSDDIFLDFNNVTLFHLISRFILKKI

SEQ ID NO: 4177 - protein, 1010 aa, Staphylococcus epidermidis
DLKPLHIVMENFGPFIKETIDFEQVETDQLFLISGKTGSGKTMIFDAIVYALYGMASTKTRKEGDLRSHFADGKSPMSVIYQFKVNNQTFKIHREAPFIKEGNITKTQAKLNIYELVDNQFELRESKVNQGNQFIVQLLGVNAEQFRQLFILPQGEFKKFLQSNSKDKQSILRTLFNSERFDEIRHLLVENVKQEKVQIENRYTQIENLWNDIDTFNNDELALYKELESSQTDKMIEKFPQFNDYGCKILKSFEEAKNKITKELDDLNHKYKVNVELSENTKKLKAEKIKFDDLKKEQNYIDKLKQELKMIQESKVLITYFTRLQSLKKDKDELVSLHEQSKLNETNYHNEIKGFQKQLEHLSTRENEITQFNQYLEKNQVFFNQLDKIISSYQQKPVIEEEIKRLYSEYNDLITKKEELTKEMNNKNKDFAIIEHYTEEIYKLKKIIDESERQKKDEKLFDKLQLDKSSYLSKLKEKKEQLNEIESSITNIDATLIDLNDKKDFVNEIKSAMSIGDTCPICGNEIHSLGEHIDFESIAQKNNKIKRLESKKVKIRDEIIKIETRIEELNHRENELNFEKQEKKDISELQKQLNHLNQLKDEQQSINKLVENFEKQEKEIVNKIHQFDLDLSRKNTQKEKLEIQINDFERHSQFSSVNDFETYYSHAKKQVETYEYENEKTKDKLNELNNKLKIEMNDQKHLTENLTQTSKEINNLELKMEKEMQQLGFESYDQVKSAADLSAQKDEIEREINIYNKNYQSYEIEINRLKELVKGKKLLNLEELRQSIEKTNLKLDETNSQIATISYKIDNNSNKFNKIKNIIQILDDELKVQKEIFLLSEILAGKNDYKLTLENYVLIYYLEKIIFQANQRLSFMSGNRYQLIRRETISLGLSGLEIDVFDFHSNKSRHISSLSGGETFQASLALALGLSEVVQQESGGITLDSMFIDEGFGTLDQETLETAIDTLINLKSSGRMVGIISHVSELKQRIPLILEVTSNQYESHTQFRKN

SEQ ID NO: 4178 - protein, 43 aa, Staphylococcus epidermidis
RKGPYRINDNIQLTKTISVKRLIGLFHIFLIMANPHLSFPYIL

SEQ ID NO: 4179 - protein, 89 aa, Staphylococcus epidermidis
ANKFMSKEGVNLTYLVFSIVFAFLMGAVVIVIRMKAQQFPVNEKKIILPPFSMLPCIDVLYPYFRLTGMDNVRIIDIRCFVFYCFNLDF

SEQ ID NO: 4180 - protein, 52 aa, Staphylococcus epidermidis
YLFTNSCLFCSFAILDFFAIYYNLFLQIVIITFYRITYISKYTSENSSKYKL

SEQ ID NO: 4181 - protein, 187 aa, Staphylococcus epidermidis
KIFTLVKLKHGKTVNSSWPDKKINAVSPNSSHGTYDFFEEEVMDKQDIKAEKNADTNAIVSSVTKNKEGIGYFGYNFYEQNKDKLKEVKIKDDNGKVTEPTKKTIQNGSYALSRPLFIYAKDKSLKDNKVMSEFMKFVLEDEGKAAEDAGYVASPKKTYKSQLDDLKDFLDKHQKSDKKDDKKSEDK

SEQ ID NO: 4182 - protein, 44 aa, Staphylococcus epidermidis
SSLTKTLYKNTCSISIFIRTFVLIHSSHFHAILKEPTLYSKGEC

SEQ ID NO: 4183 - protein, 102 aa, Staphylococcus epidermidis
LNHTLILNLLGIFLTDLFLICYVVIFSVKFNSGITIISMILCYVVIKITDNINKIKFSPSNFTNLDTDKSFIFNLSIMSSITIVYIFIIYLLAITIFRKIQF

SEQ ID NO: 4184 - protein, 340 aa, Staphylococcus epidermidis
RLDTYPLMYQAALFLARFKVLMSLIQSLYNSKKFQNRFLFNLGIKHYNFNNDIRKVIMMSKYVITKTLNNNVIICTKNHQEVVLIGKGIGFNKKVGMTVQENASIEKIYKLEQQEQQEHYKTLLELGEDHVVQAVIESVNIINESGLITDDKNLVVALTDHIIYAYKRLKQHQMITNPFVIETKHLYSNAYNVARKVIDKLNKTLDVHFPEDEIGFIALHIASNSEKLSIHDISVINKLINKSITIIETDLQHSIDKQTIQYQRFIRHIQFLIYRLTKGEYLEAQENFISMIKTMYPRSFNTAYKILKMIQREFSVYVYEAEIVYLTLHINHFEVQISSE

SEQ ID NO: 4185 - protein, 102 aa, Staphylococcus epidermidis
GDNTMNIKLTQKAVEWFKNELDLPISNKVLQFYVKYGGEFQLKQGFSPAFTVENKDAIDIGFEQTFYEINVVIAEKDLWYFQDEKLTVDAIDHEDEIIYKRN

SEQ ID NO: 4186 - protein, 44 aa, Staphylococcus epidermidis
LDLTYSMETSVLIPTNDISRHVNDIVETIPDTEFDEFRHHRGLI

SEQ ID NO: 4187 - protein, 60 aa, Staphylococcus epidermidis
EFLTTLERVFNVRVNITLACTECGDRNYITTKNKRNNPERIEMKKYCPRLNKYTLHRETK

SEQ ID NO: 4188 - protein, 313 aa, Staphylococcus epidermidis
ERGFYMASQTKVREMIAKNNAKKGGLSDKIVPIILAIISAISILTTIAILFTLLTETITFFTRVPLSKFFLSGTWNPTGSSPEFGIWALIIGTLKITVIATIVAVPIGLGAAIYLNEYASDRSRRIIKPILEILAGIPTIVFGFFALTFVTPILRNLIPNLGEFNSISPGIVVGIMIVPMITSMSEDAMSSVPDKIREGAFGLGATKFEVATKVVLPAATSGVVASIVLGISRAIGETMIVSLAAGSSPTSSLSLTSSIQTMTGYIVEIATGDAAFGSDIYYSIYAVGFTLFIFTLIMNLLSQWISKRFREEY

SEQ ID NO: 4189 - protein, 67 aa, Staphylococcus epidermidis
LLQTHIYVKVRFELTKLHSYNNKHNFHHNKLLACVYTPFSLLNYLYSHLGIINKPIFLNFNSFRITH

SEQ ID NO: 4190 - protein, 93 aa, Staphylococcus epidermidis
NNRTNLVKCIRIKKAGETMAIWVAIILIVIALIAGLIGGFLLARKYMKDYLKKNPPINEEMLHMMMMQMGQKPSQKKINQMMTMMNKNMNQKM

SEQ ID NO: 4191 - protein, 310 aa, Staphylococcus epidermidis
TLLTYNITSRSQYIKEFLIMANSQVAEKEKLDAQTNNQDSVATIVTTENNKKNTIPDSEKKIVYSTQNLDLWYGENHALQNINLDILENNVTAIIGPSGCGKSTYIKALNRMVELVPSVKTAGKILYRDQNIFDAKYSKEKLRTNVGMVFQQPNPFPKSIYDNITYGPKTHGIKNKKILDEIVEKSLRGAAIWDELKDRLHTNAYGLSGGQQQRVCIARCLAIEPDVILMDEPTSALDPISTLRVEELVQELKENYSIIMVTHNMQQAARVSDKTAFFLNGYVNEYDDTDKIFSNPADKQTEDYISGRFG

SEQ ID NO: 4192 - protein, 331 aa, Staphylococcus epidermidis
VNMTEQKDIKETEYRRQKGTTSTPFRRRNKKRMRKLPFIILVILIILISIIVYITHQYNSGMKYAKEHAKDVKVHKFNGNMKNDGKISVLVLGADKAQGGKSRTDSIMIVQYDYVHKKMKMMSVMRDIYADIPGYDKYKINAAYSLGGPELLRKTLNKNLGVNPEYYAVVDFTGFEKMIDELQPNGVPIDVEKDMSENIGVSLKKGHHKLNGKELLGYARFRHDPEGDFGRVRRQQQVMQTLKQELVNFNTVAKLPKVAGILRGYVNTNMPNSAIFQTGISFGIRGDKDVQSLTVPIKGSYQDINTNNDGSALQIDSEKNKQAIKNFFEDN

SEQ ID NO: 4193 - protein, 183 aa, Staphylococcus epidermidis
NKVTLLKSKKMSSLLVVAMIGILVIIFQFVNHSGPFSGSESQHQSDNSNLNGKDKVYVKRVVDGDTFVAQKNGEEIKVRLIGVDTPETVKPNTPVQPYGKQASNYTKKYLTHQNVYLEYDKEKTDRYGRTLAYVWLKNGDMFNESLVKKGLAREKYFSPNGKYRDTFVHAQEEAKKRKLNIWS

SEQ ID NO: 4194 - protein, 99 aa, Staphylococcus epidermidis
LVWTMLESLILGVLFSTVLIWTSRFEVKDDNIYMKRSKAFPIILISLLIIRTVIKIFISSEIDPGEIAGMFFLLAFCMIVPWRCAMLYKYKKLQKNLIK

SEQ ID NO: 4195 - protein, 243 aa, Staphylococcus epidermidis
KQAAKGGQHLIMIQFDHVDYSYHRKQPVLKDINISIQRGEKIGVLGESGAGKSTIGSLILGQLKPTKGKISIDSGKVLPIFQHATESFDRQFTIEQSLREPLLFYRQLIRQNIKNIILNYLIEFNLSTDLITKFPQEVSGGQLQRLNIIRSLLAQPDILVCDEITSNLDVMAEQNVINILLNEKNIQNKTLIVISHDLSVLQRLTNRIIVIKDGQIVDDFKSKDLFSHKRHPYTKLLIQTYEY

SEQ ID NO: 4196 - protein, 43 aa, Staphylococcus epidermidis
YVHATIALLNMIKILILKNIISIIKWYNSAIIVYIKVVLTYNK

SEQ ID NO: 4197 - protein, 80 aa, Staphylococcus epidermidis
VGNAENWSSNPLGVAKSIVGIPIITSGAVSPNARDKDKMKPVKIPGNAAGKTTLLIVCHLLAPRPYDASLTELGTALIAS

SEQ ID NO: 4198 - protein, 155 aa, Staphylococcus epidermidis
GIYFKIDGRRHMEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFFTLLFLIHIFFC

SEQ ID NO: 4199 - protein, 217 aa, Staphylococcus epidermidis
DAMAIIRQKYEGQLDGLIKDLRRLGLRVYFNINNALVSLGEEKKSFARQTIEKDKEINHLDHEINEKVIMLITRQQPIAKDLRMMMAALKISTDFERMGDNAASIAHIRLRVKINDNYVFTRLKTMGKLAMLMLEDLNNAIRNKDLPLIKEVIERDEDIDDLYVNIVNTSYLIDNDPFVAGQAHLAARHLERIGDHISNIAESVYYYLTGQHFETFD

SEQ ID NO: 4200 - protein, 40 aa, Staphylococcus epidermidis
HMWAIGEIDSLLSVKVSIRQRIKNHKKKKIQEKAKKKFLM

SEQ ID NO: 4201 - protein, 42 aa, Staphylococcus epidermidis
TFNFYHLNTYIVFNSLLEHIINILIIIKKERYSYSISFCNTR

SEQ ID NO: 4202 - protein, 43 aa, Staphylococcus epidermidis
PSNLVSNLLDFKIEFNNIFGFVMIIIGVLIVIIQECLEITERI

SEQ ID NO: 4203 - protein, 145 aa, Staphylococcus epidermidis
VLFYLSLHYCLSLLCFVTSADSATFVLGMQTTFGSLNPSSLVKVTWGVAQALIAFVLLLAGGGDGSKALNAIQSAAIISAFPFSFVVIMMMISFYKDANKERKFLGLTLTPNKHRLQEYVKYQQEDYETDILEKREVRRNKEKEE

SEQ ID NO: 4204 - protein, 423 aa, Staphylococcus epidermidis
EGNYLIMKFTELTVKEFENFVQNPSLESHYFQVKENIATRESDGFQVVLLGVKDDDNRVIAASLFSKIPTMGSYVYYSNRGPVMDYSDLGLVDFYLKELDKYLHQHQCLYVKLDPYWLYQVYDKDINPLTEKNDALVNLFKSHGYDHHGFTTQYDSSSQVRWMGVLDLEGKTPASLRKEFDSQRKRNINKAINYGVKVRFLSKDEFDLFLDLYRETEARTGFASKTDDYFYNFIEHYGDKVLVPLAYIDLNEYIQHLQESLNDKENRRDDMMAKENKTDKQLKKIAELDKQIDHDKKELLQASELRQTDGEILNLASGVYFANAYEVNYFSGGSSEKYNQYMGPYAMHWHMINYCFDNGYDRYNFYGLSGDFTENSEDYGVYRFKRGFNVRIEELIGDFYKPINKVKYWLFNTLDRIRNKLKK

SEQ ID NO: 4205 - protein, 526 aa, Staphylococcus epidermidis
NNDYGHIERIFKVNEEQRKAGTINILAERDRKAEKDYSKYFEQVYQPPSLKEAKKRGKQEVQYNRDFHIDEKYKGMGKGRTFLIKTYGCQMNAHDTEVMAGILNALGYSATSDINEADVILINTCAIRENAENKVFSEIGNLKHLKKERPDCLIGVCGCMSQEESVVNKILKSYQNVDMVFGTHNIHHLPEILEEAYLSKAMVVEVWSKEGDIIENLPKVRDGHIKAWVNIMYGCDKFCTYCIVPFTRGKERSRRPEDIIDEVRELAREGYQEITLLGQNVNSYGKDIEGLDYELGDLLEDISKIDIPRVRFTTSHPWDFTDRMIEVIAKGGNIVPHIHLPVQSGNNQVLKIMGRKYTRESYLDLVSRIKEAIPNVALTTDIIVGYPNETEEQFEETLSLYDDVQFEHAYTYLYSQRDGTPAAKMKDNVPLEVKKERLQRLNKKVGIYSQQAMSQYEGKIVTVLCEGSSKKDENVLAGYTDKNKLVNFKGPRESIGKLVDVKIDEAKQYSLNGTFIQEHQRSMVTQ

SEQ ID NO: 4206 - protein, 448 aa, Staphylococcus epidermidis
PLIYIFSTVQLFFSKAQTEVIYMKELNIALLGLRTVGSGVVKIIEENRQQIKDTINKDIVIKHILVRDKSKKRPLNISQYHLTEDINDILNDNSIDIVVEVMGGIEPTVDWLRTALKNKKHVITANKDLLAIHLKLLEDLAEENGVALKFEASVAGGIPIVNAINNGLNANNISKFMGIFNGTSNFILSKMTHEQTTFKDALEEAQRLGFAEADPTDDVEGVDAARKVVITSYLSFNQVIKLNDVKSVGISDITLADINAASALNYKIKSIGKGTYENGYVNASVEPTLIHKNHQLAAVENEYNAIYVIGDAVGDTMFYGKGAGSLATGSAVVSDLLNVALFFESNLHTLPPHFELKTEETKEMMDGAEPVVIQEKSNYYIVISNNNKSLEKVEYDIKKKLPFHKSLQLVERDQDTYAIIVTGIETSPEKVLNQSGFNIKKVYPVEGV

SEQ ID NO: 4207 - protein, 217 aa, Staphylococcus epidermidis
NRYYIVINIKYKSEGELAMSKQDGKLTGLFGAPVSDRENSMTAGQRGPLLMQDVYYLEQISHFDREVIPERRMHAKGSGAFGTFTVTNDITQYTNAKIFSEVGKQTEMFARFSTVSGERGAADLERDIRGFALKFYTEDGNWDLVGNNTPVFFFRDPKLFISLNRAVKRDPRTNMRSAQNNWDFWTGLPEALHQVTILMSDRGMPKRIPKYAWIRFS

SEQ ID NO: 4208 - protein, 68 aa, Staphylococcus epidermidis
VRHYKLRETLVICILLIRMYLSLLIKVLSFFHRTSEFEYRKINNLKCILFFMNKKEECTFKRIVKPFI

SEQ ID NO: 4209 - protein, 346 aa, Staphylococcus epidermidis
YFLYSLKVKGCQHMFKMIIYKLSQMIVVLFILTTITFILMKLSPGNPVDKILHLDISHVSNEQIETTENKLGLNNPIFIQWWDWLNQLFHFDLGTSYQTSEPVIREIANYLGPTLIITFGTLIVSLVISIPLGIIAAVYYHKIWDRIIRVMTSLSVSLPSFFIGLILLYIFSLKLNILPTSDEGRFVSYILPIITMSIGMCAYYIRFIRSTLLEQYQTPIVESSRLRGMPERYILFQDILKPTILPIIPLLGLSIGSLIGGTVVIENLFDIPGLGYFLVDSIKSRDYPVIQGCVLFIGFFVVIINTIADLLSLLIDPKQRYAITQKETSKFKWFNSHRKEGRNDEV

SEQ ID NO: 4210 - protein, 48 aa, Staphylococcus epidermidis
CIIYKLIIGFHLEHIFLSTQLFYVVIHYLIYAVQTQSHVLSLELLKFV

SEQ ID NO: 4211 - protein, 60 aa, Staphylococcus epidermidis
TEVYLMENNQSNITEETKHNDNLETTYEQTQQKEKTFSQEEVSQMIKDRLARKKRNLNNV

SEQ ID NO: 4212 - protein, 269 aa, Staphylococcus epidermidis
LLSYMLKIYICILKSSNITPRTFVCISNLSEHKFCVNNITNKCVLENVINDIIISNNNKECLFMRELTKRQSEIYDYIKKIVQTKGYPPSVREIGEAVGLASSSTVHGHLSRLEEKGYIRRDPTKPRAIEIVSEQLDEVNVEETIHVPVIGKVTAGVPITAVENIEEYFPLPEHLTSTHNSDIFILNVVGESMIEAGILDGDKVIVRSQTIAENGDIIVAMTEDEEATVKRFYKEKNRYRLQPENSTMEPIYLDNVIVVGKVIGLYREM

SEQ ID NO: 4213 - protein, 891 aa, Staphylococcus epidermidis
IYTYNINKDIRIRVVKIEMANITPMMQQYLKIKSEYDDCLLFFRLGDFYEMFFDDAKEASRVLEITLTKRDAKKENPIPMCGVPYHSADNYIETLINNGYKVAICEQMEDPKQTKGMVRREVVRIITPGTVMDQNGMDEKKNNYILSFIENEEFGLCYCDVSTGELKVTHFKDTATLLNEITTINPNEIVIKQALSEELKRQINMITETITVREDISDEDYDMNQLTHQLMHDTTQLLLDYIHHTQKRDLSHIEEVIEYAAVDYMKMDYYAKRNLELTESIRLKSKKGTLLWLMDETKTPMGARRLKQWIDRPLINKQQINDRLNIVEEFMDRFIERDTLRNHLNQVYDIERLVGRVSYGNVNARDLIQLKHSISEIPHIKALLNELGAQTTTQFKELEPLDDLLQILEESLVEEPPISIKDGGLFKNGFNAQLDEYLEASKNGKTWLAELQAKERERTGIKSLKISFNKVFGYFIEITRANLNNFQPEAFGYNRKQTLSNAERFITDELKEKEDIILGAEDKAVELEYELFVKLREHIKTYTERLQKQAKIISELDCLQSFAEIAQKYNYVKPTFSDDKVLHLENSRHPVVERVMDYNDYVPNDCHLDDETFIYLITGPNMSGKSTYMRQVAIISIMAQMGAYVPCDSATLPIFDQIFTRIGAADDLVSGKSTFMVEMLEAQKALTYATENSLIIFDEIGRGTSTYDGLALAQAMIEYVAQTSHAKTLFSTHYHELTSLDQMLKCLKNVHVAANEYQGELIFLHKVKDGAVDDSYGIQVAKLADLPNEVIDRAQVILNAFEQKPSYQLSHENTDDQQTVPSYNDFGRTEEEQSVIETHTSNHNYEQATFDLFDGYNQQSEVECQIRELNLSNMTPLEALIKLNELQSQLK

SEQ ID NO: 4214 - protein, 76 aa, Staphylococcus epidermidis
FNQYNERGMGFMQQIKFKTLTEETLESLEKSVNSFLKSQEGNGYKLLNITIKQIEERAFPHNDEDFNAILTLVTEA

SEQ ID NO: 4215 - protein, 342 aa, Staphylococcus epidermidis
FYKYSNERKLKMTLLEKIKQNKSLSKKDMQSFIVTLFDSNIETNVKVELLKAYTNKDMGQYELTYLVEYFIQTNYPNQPFYNKAMCVCGTGGDQSNSFNISTTVAFVVASAGVPVIKHGNKSITSHSGSTDVLHEMNIKTNKMNEVEQQLNLKGLAFISATDSYPMMKKLQSIRKSIATPTIFNLIGPLINPFKLTYQVMGVYEASQLENIAQTLKDLGRKRAILIHGANGMDEATLSGENIIYEVSSERALKKYSLKAEEVGLAYANNDTLIGGSPQTNKQIALNILSGTDHSSKRDVVLLNAGIALYVAEQVESIKHGVERAKYLIDTGMAMKQYLKMGG

SEQ ID NO: 4216 - protein, 585 aa, Staphylococcus epidermidis
NHKYHGKWAVSKGEGIESTGEIFATAMNRKGYFLYGYRHFSSRIKGGHTNNKIRVSKSPVHAISDDLDILIAFDQETIELNHHEMREDSIIIADAKAKPQKPENCVAQLIELPFTSTAKELGTALMKNMVAIGATSALMDLNTSTFETLIDNMFSKKGNKVVDMNIQALNMGYDLMKQQVTNVNGDFTLENGSGHPHLYMIGNDAIGLGAIAAGSRFMSAYPITPASEIMEYMIANLPKVDGTVVQTEDEIAAATMAIGANYAGVRGFTASAGPGLSLMMESIGLSGMTETPLVIINTQRGGPSTGLPTKQEQSDLMQMIYGTHGDIPKIVVAPTDAEDAFYLTMEAFNLAEEYQCPVILLSDLQLSLGKQTVKTLDYNKIDIRRGEIIQSDIERAEDDKAYFKRYALTASGVSPRPIPGVKGGIHHVTGVEHNEEGKPSEAPMNRQNQMEKRMRKTESLVINNPVLLNEHEDEADILYIGFISTKGAIGEGAERLERHGVKVNTMHIRQLHPFPKDIVQQAINKASKVIVAEHNYQGQLSSILKMNTQVNDKLVNQTKYDGKPFLPYEIEEKGLEIAKELKELV

SEQ ID NO: 4217 - protein, 443 aa, Staphylococcus epidermidis
MSDFRRGKMTQKVNVVGAGLAGSEAAYQLAQRGIKVNLIEMRPVKQTPAHHTDKFAELVCSNSLRGNALTNAVGVLKEEMRHLDSLIITSADKARVPAGGALAVDRHDFAGYITDTLRNHPNITVLNEEVNHIPEGYTIIATGPLTTEHLAQEIVDITGKDQLYFYDAAAPIIEKDSINMDKVYLKSRYDKGEAAYLNCPMTEEEFNRFYDAVLEAEVAPVNEFEKEKYFEGCMPFEVMAERGRKTLLFGPMKPVGLEDPKTGKRPYAVVQLRQDDAAGTLYNIVGFQTHLKWGAQKEVIRLIPGLENVDIVRYGVMHRNTFINSPDVLNEKYELKGHDNLYFAGQMTGVEGYVESAASGLVAGINLAHKILDKGEVIFPRETMIGSMAYYISHAKNEKNFQPMNANFGLLPSLEKRIKDKKERYETQAKRALEYLDNYKQTL

SEQ ID NO: 4218 - protein, 418 aa, Staphylococcus epidermidis
KEMYNVTQHATYKTKNKRETAVLIGVHAQTDRQFNFESTMEELDALSQTCQLNVKGQITQNREQFDHKYYVGKGKIDEIKSFIEFHDIDVVVTNDELTTAQSKTLNDNLGIKIIDRTQLILEIFALRARSREGKLQVELAQLDYLLPRLHGHGKSLSRLGGGIGTRGPGETKLEMDRRHIRTRMNEIKHQLKTVVDHRERYRNKREQNQVFQIALVGYTNAGKSSWFNVLANEETYEKNILFATLDPKTRQIQVNEGFNLIISDTVGFIQKLPTTLVAAFKSTLEEAKGADVLMHVVDASHSEYRTQIDTVNQIINDLDMDHIPQVVIFNKKDLCNEQMDVPVSKSAHVFVSSRDENDKQKVKNLVIQEIKNSLSPYEEIVDSADADRLYFLKQHTLVTELIFDETQASYRIKGFKKL

SEQ ID NO: 4219 - protein, 50 aa, Staphylococcus epidermidis
NPTYPRKFHQSCEEALNIRRTTKMDNKLNPVSIDTKIIKIYCTSFFVSLV

SEQ ID NO: 4220 - protein, 59 aa, Staphylococcus epidermidis
DFRYTTSSLTPISLIVTSSEAQLLIFSRSVLTNLPLFSFGQRVSIVGPAPLITVAYASC

SEQ ID NO: 4221 - protein, 317 aa, Staphylococcus epidermidis
IYYHNGSLNDSERSINMSTHSNTANKTLIDKDAVEKNISSRDRKNSVNKWLFLLCTLIGLIVLVALLIQTFVKGAGHLTPEFFTNFSSSTPADAGIKGALVGSIWLILSIIPISIILGIGTAIYLEEYARDNIFTQIVKVSISNLAGVPSIVFGLLGYTLFVGAAGLGNSVLAAALTMSLLILPVIIVASQEAIRAVPSSVREASYGLGANKWQTIRRVVLPAALPGILTGFILSLSRALGETAPLVMIGIPTILLATPSGLLDQFSALPTQIYTWAKMPQAEFQNVASAGIIVLLVILLLMNTVAILLRNKFSKKF

SEQ ID NO: 4222 - protein, 235 aa, Staphylococcus epidermidis
ECSQEDYAMQQERQSWYQKSWFIILTLLFIFPLGLFLMWRYAHWKNWLKLTVSSVYIISLVLTLLFQVSLLNENKTNQIEHASTMKEKSNINNVKTTKNKNMEKSTQTDKQNSVNLKQNTKDQNNNANDEAASPTSEQNAAIAQAKSYANTLPISKKSLYKQLTSEYGEKYPADIAQYAVDHISVDYKMNALRLAKSYVKNINISNQALYDQLVSENGEGFTPEEAQYAMNHLDR

SEQ ID NO: 4223 - protein, 139 aa, Staphylococcus epidermidis
YLIHYFDFYLNQPTWFLTKFSALRFSVTILFSYLYFQLKYLSKIKLFFYLSIQQMMIHLYGMEYLPTYVYTFASIILQFSTHIIDTRDFLYLISFPYITSLLYLGSKTMCYLQFHYVCAKLFVSDDIKKHLFVLNILVG

SEQ ID NO: 4224 - protein, 48 aa, Staphylococcus epidermidis
CKCLLCNVTNSNSFIKLSIPYITISLIFQCVSFYNKKAKLMINASYIN

SEQ ID NO: 4225 - protein, 49 aa, Staphylococcus epidermidis
YKIQNEVIKTVSLQAAKNVVRRTMLCNKNDNRGTKNLGLLFSHCYLFFH

SEQ ID NO: 4226 - protein, 798 aa, Staphylococcus epidermidis
VLPQAKKRTSTKRKGNKKTNKKKQNETPLRYIFSIIVVILIILGAFQLGIIGRMIDSFFNYLFGMSRYLTYILVLIATIFITYSKQIPRTRRSIGAIVLQLALLFIAQLYFHFSHNITSQREPVLSFVYKAYEQTHFPNFGGGLIGFYLLKLFIPLISIVGVIIITILLLASSFILLLNLRHRDVTKSLFDNLKSSSNHASESIKQKREQNKIKKEEKAQLKEAKIERKKQKKSRQNNNVIKDVSDFPEISQSDDIPIYGHNEQEDKRPNTANQRQKRVLDNEQFQQSLPSTKNQSINNNQPSTTAENNQQQSQAEGSISEAGEEANIEYTVPPLSLLKQPTKQKTTSKAEVQRKGQVLESTLKNFGVNAKVTQIKIGPAVTQYEIQPAQGVKVSKIVNLHNDIALALAAKDVRIEAPIPGRSAVGIEVPNDKISLVTLKEVLEDKFPSKYKLEVGIGRDISGDPISIQLNEMPHLLVAGSTGSGKSVCINGIITSILLNTKPHEVKLMLIDPKMVELNVYNGIPHLLIPVVTNPHKASQALEKIVSEMERRYDLFQHSSTRNIEGYNQYIRKQNEELDEKQPELPYIVVIVDELADLMMVAGKEVENAIQRITQMARAAGIHLIVATQRPSVDVITGIIKNNIPSRIAFAVSSQTDSRTIIGAGGAEKLLGKGDMLYVGNGESTTTRIQGAFLSDQEVQDVVNYVVEQQKANYVKEMEPDAPVDKSEMKSEDALYDEAYLFVIEKQKASTSLLQRQFRIGYNRASRLMDDLERNQVIGPQKGSKPRQILVDLENDEV

SEQ ID NO: 4227 - protein, 54 aa, Staphylococcus epidermidis
SIAHLQGTIIQNASKKNIPAISPGSISLLINILITVLIINNDIKIIGNALDRFI

SEQ ID NO: 4228 - protein, 290 aa, Staphylococcus epidermidis
LIQHTMLKLYWANFTTAQLHHLTSTYPDFLSENVFHQHDMIKRWLTERNSERLWNKYERFKELKLMDIIKEMKKANVSFTTYFDDNYPSLCKEMYDYPYVIFYKGNPQFFNHSHSLAVIGSRNATQYTSQSLNYLFPSFRQLNMAIVSGLARGADSVAHQTALKYLLPTIGVLGFGHCYHYPKATLNLRTKVERNGLVISEYPPFSPISKHKFPERNRLISGLSRGVLITEAEERSGSQITIDCALEQNRNVYVLPGSMFNKMTKGNLRRINEGAQVVIDESSILYDYLF

SEQ ID NO: 4229 - protein, 45 aa, Staphylococcus epidermidis
LIKQSSIILSYSFIPLNKQIKKLYQSLSWYSLDYEDIQCLTDVSF

SEQ ID NO: 4230 - protein, 269 aa, Staphylococcus epidermidis
EDEQRMRILFIGDIVGKVGRKMITTYLPKIKQTYHPTVSIVNAENAAHGKGLTEKIYKQLLREGVDFMTMGNHTYGQREIYDFIDDAHRMVRPANFPDEAPGTGMRIIKINDIKLAIINLQGRSFMQDIDDPFKKADQLIEEAQKSTPYIFVDFHAETTSEKNAMGWYLDGRVSAVVGTHTHIQTSDDRILPHGTGYITDVGMTGYYDGILGINRDEVIQRFITSLPQRHVVPDDGRGVLSGVIIDLDKEGKTTQIKRLLINEDHPFQI

SEQ ID NO: 4231 - protein, 417 aa, Staphylococcus epidermidis
KGRQIMQDFSNLVEEVENTLIPYFRKIEKRALFNQEKVLNAFHHVKASESDLQGSTGYGYDDFGRDHLEQIYAHTFKADDALVRPQIISGTHAITLALQSTLKNNDELLYITGSPYDTLLEVIGINGNGVESLKEYGVRYNEVELRDGRIDIPKVITAINDNTKVVAIQRSKGYDQRPSITINEIEQAITSIKEVYPNIIIFVDNCYGEFVEDKEPIEVGADLIAGSLIKNPGGGLAKIGGYIAGRQDLIERCGYRLTAPGIGKEAGASLNSLQEMYQGFFLAPHVVSQSLKGALFTSLLLEKINMKTSPKYNVYRTDLIQTVQFETKEQMISFCQSIQHASPINAHFSPEPSYMPGYEDDVIMAAGTFIQGSSIELSADGPIRPPYEAYVQGGLTYEHVKLAVTRAVQHMQENNLL

SEQ ID NO: 4232 - protein, 323 aa, Staphylococcus epidermidis
TQLQIYFHYLSILNNVMLLLRKKHQSLNGLIHIEKKVVTMKFKLSKKNTIFFIFTVYIICLIVLQFIINDEAAYQVHLSNSFEPMSMNHLLGTDDYGRDLFSRLVVGSRATLFVTLLTLLFTVVVGVPLGLLAGYKKGWIDTIIMRIIDIGLSIPEFVIMIALASFFHPSLWNLVIAITIIKWMNYTRVTRGIVNTEMNQSYIQMAQFFNVSTLNILFKHLLPKVLPSIFVIMIVDFGKIILYISSLSFLGLGAQPPSPEWGAMLQAGREFITSHPIMIIAPASLISGTILIFNLTGDAVRDRLLEQRGVKVETFNNKKSKHQ

SEQ ID NO: 4233 - protein, 531 aa, Staphylococcus epidermidis
YTKQTLDKGGVYVNLLSLLLILLGIILGVVVGYIVARNLLHQKQVQARQTADDIVSYANKEADNIKKEKLLEAKEENQILKEQAENELRERRGELQRQETRLLQKEENLDRKSDLLDKKDEILEQKESKLEERQQQVDAKESSVQTLIMKHELELERISGLTQEEAVKEQLQRVEEELSQDIAILVKEKEKEAKEKVDKTAKELLATTVQRLAAEHTTESTVSVVNLPNDEMKGRIIGREGRNIRTLETLTGIDLIIDDTPEAVILSGFDPIRREIARTALVNLVSDGRIHPGRIEDMVEKARKEVDDIIRDAGEQATFEINVHNMHPDLVKILGRLNYRTSYGQNVLKHSIEVAHLSGMLAAELGEDVTLAKRAGLLHDVGKAIDHEVEGSHVEIGVELAKKYNENNIIINAIHSHHGDVEPTSIISILVAAADALSAARPGARKETLENYIRRLERLETLSESYDGVEKAFAIQAGREIRVVVSPEEIDDLKSYRLARDIKNQIEEELQYPGHIKVTVVRETRAIEYAK

SEQ ID NO: 4234 - protein, 266 aa, Staphylococcus epidermidis
EEFKMAVISMKQLLEAGVHFGHQTRRWNPKMKKYIFTERNGIYIIDLQKTVKKVEEAYNFVKQISEEGGKVLFVGTKKQAQESVKAEAERAGQFYVNQRWLGGILTNYKTISKRIKRISEIEKMEEDGLFEVLPKKEVVELKKEYDRLIKFLGGIRDMKSMPQALFVVDPRKERNAIAEARKLNIPIVGIVDTNCDPDEIDYVIPANDDAIRAVKLLTGKMADAILEGQQGVSNEEVAAEQNINLDDKEESEQAETTEENTSVESN

SEQ ID NO: 4235 - protein, 138 aa, Staphylococcus epidermidis
LIIKSDISHLFVSKVKIKRGEMMNNIRAERVGEQMKQEIMDIVNNKVKDPRVGFLTITDVELTNDLSQAKVYLTVLGNDKEVDNTFKALHKATGFIKSELGSRMRLRIIPELTFEYDESIEYGNKIERMIQELHKNDK

SEQ ID NO: 4236 - protein, 421 aa, Staphylococcus epidermidis
MVVNYNDNGELTMGGTSLKTIAQSFGTPSIVYDEDQIRNQIRRYHKAFEASGLSYNISYASKAFTCIQMVKLIDEENLQLDVVSEGELYTALEAGFDSKRIHFHGNNKTKREIQYALDNQIGYFVVDTLEEIELIDKYADSNVDVVLRVNPGVEAHTHEFIQTGQEDSKFGLSIKHGLALNAVNKVKATKHLQLKGIHFHIGSQIEGTEPMIKTAKIVLNWLASERIEVSLLNIGGGFGIKYVEGDESFPIEQGISEITEAIKETAQALQYNIPEIGIEPGRSIVGEAGITLYEVGTIKDIPGVNKYVSVDGGMSDHIRTALYGAQYEALLVNRNEKANESVTIAGKLCESGDIIVRDAPLPSSVHRGDYLAILSTGAYHYSMASNYNQMQKPPVFFLKDGKAREVIKRQSLRQLIINDTK

SEQ ID NO: 4237 - protein, 84 aa, Staphylococcus epidermidis
YETNKNIGVVYSFMSINIDPEKFAELVVTSNPAKSDDAEDIAKESLILYINAYRLAEKYANIATNCYDTAEILKEINEVDLQLK

SEQ ID NO: 4238 - protein, 177 aa, Staphylococcus epidermidis
TKTNYTNCVKLDVYRKGDKMESIYDFVVQKNNGESYKLEQYKGDVMLIVNTASECGFTPQFEGLQKLYDEYKDQGFIILGFPCNQFGGQEPGSGEEAAQNCKINYGVTFPIHEKVDVKGDNQHPLFHFLTNAAKGMINEKIKWNFTKFLIDREGNVIKRFSPQKKPEQIKTEIEKLL

SEQ ID NO: 4239 - protein, 47 aa, Staphylococcus epidermidis
ITYNGICISYSSHVTYLLLNQNRVIVNFLLRMGFELMKRVLKFNLLT

SEQ ID NO: 4240 - protein, 85 aa, Staphylococcus epidermidis
AKNKTTSNTIIEVRVNNDLYLININNTMIKINATNIHFTDLSDSAINMKPYMNTGIATKVYSLIDISLKCCMNNAINTLVDNAKK

SEQ ID NO: 4241 - protein, 328 aa, Staphylococcus epidermidis
RRNNIMKVIEVTHPIQSNQFITENVAMAFGFFDGMHRGHDKVFQVLDEKAKEHQLKKAVMTFDPHPSVVLNPERKRTTYLTPLSDKLEMIAEHGIDYCIVINFSSRFANVTSDDFIKNYIINNHVKEVIAGFDFTFGKFGKGNMTVLQESKAFNTTIVGKQEMDSEKISTTAIRQALTDGHLQKANDELGYIYRIKGTVVQGEKRGRTIGFPTANVQPSDDYVLPKKGVYAVSMEIGPESKLHRGVANVGVKPTFHDPTRAELVIEVNIFDFNENIYGERVTVYWHHFLRPEVKFDGIDPLVKQMNEDKAQAKHLLSIDFDDDISYNI

SEQ ID NO: 4242 - protein, 181 aa, Staphylococcus epidermidis
FMDNSLHATTIYAVRHNGEAAMAGDGQVTLGQQVIMKQTARKVRRLYEGKVLAGFAGSVADAFTLFEKFETKLQQFSGNLERAAVELAQEWRGDKQLRQLEAMLIVMNKDAILIVSGTGEVIAPDDDLIAIGSGGNYALSAGRALKRHAAQLSASEMAYESLKVAADICVFTNDNIIVETL

SEQ ID NO: 4243 - protein, 388 aa, Staphylococcus epidermidis
GMDNFMNELEFVTLHRRHLHQYPELSLHEFETTSYITSFLEDLGVPYDRPLKTGVIAYLEGNSHHTIAFRADIDALPIYEENDIDFKSKNDNVMHACGHDGHTTALMLFVKRCKALYDKSELPHNVVFIFQPAEETGGGANRLIKAGAFDKYPIEAVFGFHVNPFEKEGKIVIRDEEITASATEYRFFLKGLSSHVADKEQGHSCGEGLQHVLSQIGQIQQFHLNGLKRNIIHMGHFEAGEAINTVPSHGYLEGTIRTYDTEDLAIVKHQMHKIAKSVQLLFNVECEVKFEEGYPPTMNHPQLRQAVENAIKGANLEIVEKKLPFLFGEDFSFYGQQLAPSYFVFVGTQNNEKGFVTGLHTAHLNFDEKILIDVVNYYEHLLRNYKEV

SEQ ID NO: 4244 - protein, 428 aa, Staphylococcus epidermidis
CFCKGGSVMYDYNLLEDRDVLCIDQKSFFASVSCMEKGLDPLTTKLAVVADTKRQGSVVLAATPKLKELGIKTGSRLFEIPHRNDIYIINPSMRKYLNVSVAISKIALRYVPPEDLHQYSIDEFFMDVTDSYHRFNSTVFAFCKRFQNEILEETGIHCTIGIGSNMLLSKVAMDIEAKHSENGIAEWRYQDVPEKLWPIQPLRDFWGINKRTEKKLNKRGIFTIGDLAKYPYHYLKRDFGVLGIDMHLHANGIDQSKVREKYKVTNPSICKSQILMRDYQFEESKVVMQELIEDVASRLRAEKKLARTIHFSFGYAEGGGIHKQYTLEDPTNLERDIFKVINYFANRLCDKKALYRTLSVSLTQFIKESDRQLNLFIDEYERKKDVKLAKTIDHLHLKYGKGIVSKATSYTEAGTKHGRLGLMAGHKM

SEQ ID NO: 4245 - protein, 333 aa, Staphylococcus epidermidis
FYCKGLKKMKIFDYEDIQLIPNKCIVESRSECNTSVKFGPRTFKLPVVPANMQTVMNEELAQWFAENDYFYIMHRFNEENRIPFIKKMHHAGLFASISVGVKENEFNFIEKLASSSLIPEYITIDIAHGHSNSVINMIKHIKKHLPNSFVIAGNVGTPEGVRELENAGADATKVGIGPGRVCITKIKTGFGTGGWQLSALNLCNKAARKPIIADGGLRTHGDIAKSIRFGATMVMIGSLFAAHEESPGETVELDGKKYKEYFGSASEYQKGEHKNVEGKKMFVEHKGSLKDTLTEMEQDLQSSISYAGGKDLKSLRTVDYVIVRNSIFNGDRD

SEQ ID NO: 4246 - protein, 151 aa, Staphylococcus epidermidis
RVGNIMFKFNFFYISKIRATWMLYLIGIYPLLIFLAELLNSNFLSLSATHKNSVSFLELFIAIYDTQQKVMLSLIIIGYLSSLLFYSEISTGRLLFYKDQSRYKIFNSKLTSIISSYFIFLFILLLSTLVVYVFYVNNHEYSSHSFMLNNS

SEQ ID NO: 4247 - protein, 171 aa, Staphylococcus epidermidis
MNINTAYFAGGCFWCMTKPFDTFDGIEKVTSGYMGGNLVNPSYEEVKTGSTGHYEVVKIEYDVALFSYHKLLEIFFSVIDPLDDGGQFQDRGSQYKTAIFYSNEHQRQLAEQYICELQDSFNADKAIATKILPASTFYEAEAYHQDFYKKNPERYEQEQQDRASYVKNNHM

SEQ ID NO: 4248 - protein, 125 aa, Staphylococcus epidermidis
IITKVEAHIIILIIKVYMSHSLNTRNPPFPTDGDGYEYNYRQDDDNYFEQPGKLFRLQSEDAKERIFTNTANAMDGVSKDVKVRHIRHCYKADPEYGKGVAKALGIDINQIDLETNQDETYENFK

SEQ ID NO: 4249 - protein, 42 aa, Staphylococcus epidermidis
KRYKKRNTINKTIELDPSLIYKLKIFVVIDDLLRNNLFLINF

SEQ ID NO: 4250 - protein, 134 aa, Staphylococcus epidermidis
INNKFKSRGEVQVMSNDSIRRNMAVFSMSVVSKLTDLSPRQIRYYETHELVMPERTDGNKRLFSMNDLERLLEIKSLIEKGFNIRGIKQIIFDEQGHLTTDEQETRKRMIVDATQKPRSETLPINRGDLSRFIK

SEQ ID NO: 4251 - protein, 309 aa, Staphylococcus epidermidis
RCDNMYNGILPVFKKRGLTSHDVVFKLRKILKMKKIGHTGTLDPEVNGVLPICLGDATKVSDYIMEMGKTYHAMITLGKSTTTEDQTGDILETRAVDKNDINEDTIDQVLQQFEGHIQQIPPMYSSVKVNGRKLYEYARNNETVERPKRQVFIKDIHRISEVTFQEQTCHFEVEVTCGKGTYIRTLATDIGLKLGFPAHMSRLTRIASGGFQLESSLTIDQIKELHEHDSLHNELFPIEYGLKGLKSFQVKDSNFKKKICNGQKFHKKVLSQNVKEPFIFVDSSTQKVLAIYIVHPDKPYEIKPKKVFN

SEQ ID NO: 4252 - protein, 149 aa, Staphylococcus epidermidis
VSRKKVHQFTENYDTLLIGIDMSRDTLYLRINKRVDIMLGHGLFNEVQHLVEQGFEASQSMQAIGYKELVPVIKGNISMENAVEKLKQHSRQYAKRQLTWFKNKMNVHWLNKERMSLQMMLDEITTQINKRSSNHDCKRKHPRPSTREL

SEQ ID NO: 4253 - protein, 52 aa, Staphylococcus epidermidis
NILNCNFTFQLIKLSIINNVVIYIFNFNVLIRFSSHSTHLYDNTYSNYFMNK

SEQ ID NO: 4254 - protein, 297 aa, Staphylococcus epidermidis
FLLNIKEVKSMLEFRNVYKSFKKKEVLCDVNYKLSAGEKVGLIGSNGSGKSTLMKLIAKTQLPSKGNVYFNNIDIHKSHNMIKDFSFMIGQIYYPELNARQNIENYLKINNKISYISEIQKMLNIVGLEDIEKKVKNYSYGMKQRLCLAICLITKPPVAVLDEPFLGLDPLGVRELNNITEKYSKEKNTLFLISSHQLKELEDLCDRFLLLENHQIREIDLHNRIFTQKLIFKNTLNNAPELKANFNFIKKIDSNSITIINKDEEVDLTNLLNLVGKNPLIKIESNDNLLSSYFYKE

SEQ ID NO: 4255 - protein, 105 aa, Staphylococcus epidermidis
VLLKLTEYLLIIMIAIIKFNALRKRFQMSKENLNIDRINELARKKKEHGLTNEEAKEQTKLRRQYLEEFRKGFKQQIENTKVIDPEGNDVTPEKLKKIQEEKHNK

SEQ ID NO: 4256 - protein, 914 aa, Staphylococcus epidermidis
RHINIYKYQGGYKMASNIKEQAKKQFELNGQSYTYYDLQTLEEKGLAKISKLPYSIRVLLESVLRQEDDFVITDDHIKALSKFGNAGNEGEVPFKPSRVILQDFTGVPAVVDLASLRKAMNDVGGDINKINPEVPVDLVIDHSVQVDSYANPEALERNMKLEFERNYERYQFLNWATKAFDNYNAVPPATGIVHQVNLEYLANVVHVRDVDGEKTAFPDTLVGTDSHTTMINGIGVLGWGVGGIEAEAGMLGQPSYFPIPEVIGVRLTHSLPQGSTATDLALRVTEELRKKGVVGKFVEFFGPGVQHLPLADRATIANMAPEYGATCGFFPVDEESLKYMKLTGRDEEHIELVKEYLQQNHMFFDVEKEDPEYTDVIDLDLSTVEASLSGPKRPQDLIFLSDMKKEFEKSVTAPAGNQGHGLDQSEFDKKAEINFNDGSKATMKTGDIAIAAITSCTNTSNPYVMLGAGLVAKKAVEKGLKVPEFVKTSLAPGSKVVTGYLRDSGLQQYLDDLGFNLVGYGCTTCIGNSGPLLIEIEKAVADEDLLVTSVLSGNRNFEGRIHPLVKANYLASPQLVVAYALAGTVDIDLQNEPIGKGKDGKDVYLQDIWPSIQEVSDTVDKVVTPELFLEEYKNVYHNNEMWNEIDVTDEPLYDFDPNSTYIQNPTFFQGLSKEPGKIEPLKSLRVMGKFGDSVTTDHISPAGAIGKDTPAGKYLLDHDVAIRNFNSYGSRRGNHEVMVRGTFANIRIKNQLAPGTEGGFTTYWPTGEIMPIYDAAMKYKEDGTGLVVLAGNDYGMGSSRDWAAKGTNLLGVKTVIAQSYERIHRSNLVMMGVLPLQFQQGESAEALGLDGKEEISVDINEDVQPHDLVNVTAKKENGEIINFKAIVRFDSLVELDYYRHGGILQMVLRNKLAQ

SEQ ID NO: 4257 - protein, 58 aa, Staphylococcus epidermidis
IAINTGNQFTIALTFFIIKGQLNLRNRRMEDEYPRVSRERNISFNGRCSSRGTSSIYC

SEQ ID NO: 4258 - protein, 241 aa, Staphylococcus epidermidis
RGVKMSEMSAIYRVKQYILNLIKDGELTNGSKLPSNLSIARALNVKTDDVYDGIDELITEQVVTDNFEEGTSVKVKPPFYYPLNKIISIGTMIKEAGYEAGTEYLNLDEQPATILDAEHLGIETKEPITIIERLRTANHKPVVYCLDKIAKTYLTCTDYQQSSGSMLEAIKASTNHQIMHAEMDLEAISYEPHISEVLNASPHEGLMLLKVVHYDEKHQPILYSLNYIKSSLVKFTITKSE

SEQ ID NO: 4259 - protein, 362 aa, Staphylococcus epidermidis
RGVKQLTAIWSLDTEAFYQNAVKVKNNEPIMAVVKNNAYHYGLEFAVKTFLKAEINTFSTTSLNEAIRVRKIAPEATIFLMNPVYDFDLVKRYDIHMTLPSLNYYYKYKQDLKGIHVHLEYENLLHRSGFRNIEEIREVLKDHDQNNQDKMIISGIWTHFGYADEFDVDEYKMERDAWLNLINTLLNENYHFDMIHSQNSASYFRENQMLLPHHTHARVGIALYGSRPYSLINEERITQSLTVKGNVIQVRDVNKGDYCGYSFAFEVKNDHTQLAVVDIGYGDGILKSRAKHEAIINGKRYPIRALMMSHMFIEVDDEVHAQDEVILYNKDIRIDEFTFKGVGANSEQLSAMNHDSLMKEYL

SEQ ID NO: 4260 - protein, 47 aa, Staphylococcus epidermidis
SLVNMKVNLNNLSCSCLFHLIKNTYKYIFKWDEYSKYSNDERLKKKV

SEQ ID NO: 4261 - protein, 364 aa, Staphylococcus epidermidis
LRANQHFSSNKLINIDLTLEGTLVISFENDYLEGAHEKVLNRLVETNRIQAAGYGFDDFSAQAADKIRQRIDCPDATIRFLVGGTQTNQVVINSMLDSYEGVISADTGHVAVHEGGAIEFSGHKVLTIPSQEGKITAQDVENYIETFESDFKKEHMVYPGMVYISHPTEYGTLYTKEELQSLSRVCRRHQIPLFMDGARLGYGLMSNQTNVTIEDVAKYCDVFYIGGTKIGALCGEAIVFTKQNEPKNFTTIIKHHGALLAKGRLTGVQFLELFTDDLYFDISRHAIKMAEKVKKGFIDKGYQVYFDSPTNQQFFILSNDKIEELKQKVKFAVWEKYDNQHRVVRFATSWATTEENVNQLLELI

SEQ ID NO: 4262 - protein, 42 aa, Staphylococcus epidermidis
ANKKETCEVSSSLLNFMTDYFICPLTSSAKFSSRFSIPSPTS

SEQ ID NO: 4263 - protein, 318 aa, Staphylococcus epidermidis
QIKKGIGADVVSQSHFKITVEDGTMLEVKIDKAKKSTIGIVHLFHGMAEHMDRYQELVEALNTQGYDVVRHNHRGHGKEIDENERGHFNSMNQIVDDAYEIIETLYLEELNVPYIIIGHSMGSIIARSFVEKYPDIAQGLILTGTGMFPKWKGVPIRLAMKLVTFIFGKRRRLKWVNQLLNKTFNKKITQPRTDSDWISTRQDEVDKFVEDEFCGFKVSNQLIYQTLKTMMKTVERQQLKRMDKELPILFISGKDDPFGEYGKGIKHLARLYKRAGIKHITVQLYKHKRHEILFEEDYLKTWQHMFEWMEKQILKKQK

SEQ ID NO: 4264 - protein, 131 aa, Staphylococcus epidermidis
KEKNTRKSKKEIPDVIRSGKIKLDINPEKQNRHSLNHSLYLKNKNFALKNNERLPSYTTLSINELNRLVQQYSTSGKILINKNGFNHKKVINFERIIGKAFIDGKYIETTFGKVHYSKTDSHIIPFISKEK

SEQ ID NO: 4265 - protein, 289 aa, Staphylococcus epidermidis
GGKNVSSNELLLATEYLEKEKKIPREVLIDAIEAALITAYKKNYDSARNVRVELNMDEGSFRVIARKEVVEEVFDDRDEVDLSTALVKNPAYEVGDIYEQDVTPKDFGRVGAQAAKQAVMQRLRDAEREILYDEFIDKEEDILTGVIDRVDHRYVYVNLGRIEAVLSEAERSPNEKYIPNERIKVYVNKVEQTTKGPQIYVSRSHPGLLKRLFEQEVPEIYDGTVIVKSVAREAGDRSKISVYSDNPDIDAVGACVGSKGARVEAVVEELGGEKIDIVQWDEDPESICS

SEQ ID NO: 4266 - protein, 51 aa, Staphylococcus epidermidis
AMKKECIHMPIIYYDGNCVYCYNYAIWLIQNGLSHKYEFATIKGQIGKQFF

SEQ ID NO: 4267 - protein, 44 aa, Staphylococcus epidermidis
NWKKRFANMMMKSHFVVINNNFSTLLPSYLKQSCFLFLFYLFSY

SEQ ID NO: 4268 - protein, 45 aa, Staphylococcus epidermidis
ISRNLTSIEVMHYECTLITTFYSSLFTSVASDDSLSTVKVLIACL

SEQ ID NO: 4269 - protein, 41 aa, Staphylococcus epidermidis
IIRKGFIFIKYFGETLEGTGQAEDYRLKLSPKKASQQYEVL

SEQ ID NO: 4270 - protein, 42 aa, Staphylococcus epidermidis
AIRNLSYIHLILGSSPLKILTILDLCRIINMIETIPLTASKI

SEQ ID NO: 4271 - protein, 866 aa, Staphylococcus epidermidis
MRRKACFIILLITLSLIGHSYIIFRFHHDGVLSTGPNDGMEQMIPIQMYLYHQWTQGNLFYSTHLGLGGDFFTDLSYYFSTNLIFILNVPIIKLCEIFFSLNTNQILLWMYNALIVSIIKSTIALFCTYLFSYYISKNKIISLLISFIFVMSPLYFRFTIYWPFFSDTFIWLPLLLLGIERLLRDFKAGLFILTVSLILINNFYFAYYFLIIGIGYTLIRIIYRHPKDSLTRWQASLTIICSALLALGNSMFVFFHGVQSFLNNRRQSFTGQVNWIEHLNKDTNIFFDNYLIVVIFLSIQALLTIKLYKHFYYKLFALLLLATIIFAFLPFVDQLFNGFSAPQKRWHFILAFNSSILIGLFVKYFKTIRPKTYIYTNLIAQSVIYISSISYNTFLPWLSLVPVVSVIGLLILLIKEKKVRYYLTYLYSISIAALSLMITFVFIKNQIFFQDHINRANKRYINSSFYNSAIQRSLVKEMNQTKNDDQRINWRVDEQDNTPMYQNFKGLSIYSSIFHHNILDFYYDALKINLAEESVSRYQSTNARQNIESLFSVKYLMMKDYQNFIPSYFKKVKSRGQYIIYKNQLPLPSVKVTQNIYNHKSLKKPIDREHAMINGAIVTSKGTAYHSKVKNLLDQTRVSTQNITRYSNNELTVNKESGIIKLHLPKNIRDKYKDFYLTMNIKRGDPDSNYTVSINQYHNHRLYNDSIYRTGISKVLYRSLPDKNGDITIQLSPKGKFNLELLELNGENYDTLKQAHHHANFNMRYKDIKNGVKVNLDHHSKGLAVINIPYRKGMRAYVDDRQSNIKKVNYMMTGVPVNKNDKTITIQYRPPFLKTMFSISIFSIVVSIVFIRLKNIRKRKMRIRHD

SEQ ID NO: 4272 - protein, 69 aa, Staphylococcus epidermidis
VRRNKMLIKDAYRKNVIVTLKNNEKFKGFVFDYENPLESDTGNYSLDLETDLGIYSIDESEIKSIKLIS

SEQ ID NO: 4273 - protein, 57 aa, Staphylococcus epidermidis
SITLLLKYISDYTTYKYFSKYYNYVNLIMLKTFVNLLKCIGKVKNFKIKFNFLILLP

SEQ ID NO: 4274 - protein, 235 aa, Staphylococcus epidermidis
NVLKKSCDEANKALKLYNLSMKVSREKLLKQQLDLIVKDSALDIHDEIENKLVDREVERQAHILGEHVKIDDTEVKAVVNSNFKGVNWSTRLCQDMAVVQKEVEKTTSNVLLRGRHPNEYVAKFKKQTNTTTYNASRLLVTESACVQAESQKLTYLKDLGEDGEYKYVAKIDKKTSKICHSLNGKVFKVKDMMPGVNAPPMHPWCRSTTVTHVGNWRDRFFTERKGKYQTENKES

SEQ ID NO: 4275 - protein, 423 aa, Staphylococcus epidermidis
LIMNSSSQEKKNKKFSSVFIYSSIIAAIVVIIGAVWPEKFDSVTNTAKMWITNNLGWYYLILTTVIVFFCVFLIFSPIGKLKLGKPNDKPEFNTISWFAMLFSAGMGIGLVFYGAAEPMAHFAAPPTADPETTKAYTESLRSTFFHWGFHAWAIYGVVALALAYSQFRKGEPGLISRTLRPLLGDKVEGPIGTLIDVLSVFATLVGVAVSLGMGALQINGGLHYLFGVPNNTFVQGIIIVVVTILFIASAWSGLSKGIQYLSNLNIGLGTILMIVTLIVGPTVLILNMMTSSTGSLLNSFLFNSFDTAALNGQKRDWMSTWTLYYWGWWLSWSPFVGVFIARVSKGRSIREFISGVLLVPALVSFIWFSVFGVLGIEAGKKDSGLFKMSPETQLFGVFNHIPLGIVLSIIALLLIASLLCYFS

SEQ ID NO: 4276 - protein, 256 aa, Staphylococcus epidermidis
LIMNFIFDIDGTICFDGCSIDSSIKQRLFKLRQANHNVIFASARPIRDLLPVIPEFADDTLIGGNGSIISKNGQIEIVSVINEHDISLIKKIIKKYQLSYIIDDKFNYASNLDSNNELYQRIDPDGKAQSLDMDEIRNPIKAILLNIDNKDFDMIAHQLVSQSHGIELIRHYSESYIDVTARGVDKYTTIQYILGTNSDYIAFGNDHNDVHMLEHASQGYFVTNQFIEHTSFFKNKNITVIDDTIYAICEVLDRYL

SEQ ID NO: 4277 - protein, 242 aa, Staphylococcus epidermidis
TIMNILLIGYGAMNQRVARLAEDKGHEIVGVIDRTSKASTPYSQYQHISECKEADVAIDFSNPELLFPLLEEQFNLPLVIATTGEKETLIQKLETLSQRTPVFFSANMSYGVHALTKILETAVPLLQDFDIELTEAHHNKKVDAPSGTLVKLYDVIKELRDNVSPVYDRHEKTEKRTHDEIGIHAVRGGTIVGEHDILFAGTDETITISHKAQSKDIFANGAIGAAEKLIHKNPGFYTFNNL

SEQ ID NO: 4278 - protein, 41 aa, Staphylococcus epidermidis
TFVNFYESPIICVANSDIVTFYENNFIENKINFTKCSHLFV

SEQ ID NO: 4279 - protein, 410 aa, Staphylococcus epidermidis
GVVNLMKNEKEINGKKSHFFSLSESRFMRFLGGNDLIYALIALVLLGIVIFIFDKISYVFQPFIIVFNTIAAPIIVSLVLFYLFNPIVNMMERYRIPRLLGITIIYVAIVGIITLIVNLLIPIIGSQIESFIKNTPNYLHKITRSLDKLNNNTILSGYMGQVNEWLESAQKKIPSMVSDYSDGFGSKLATFAEAVANIGIVIGTTPFVLFFMLKDGHKFKDYTTKIMPPKFRKDFHDLLEKMSVQVGSYIQGQIIVSFCIGLLLFIGYSIIGLKYALVLASIAAVTSVVPYLGPTIAISPAIVIAIITSPLMLLKLAVVWTLVQFFEGHFISPNVMGKTLKIHPLTIIFILLCAGNLMGIVGVIIGIPLYAVLKVLVSHIFMLFKRRYNRYYGNDAGEYIITEEEKGIKQ

SEQ ID NO: 4280 - protein, 90 aa, Staphylococcus epidermidis
YMAKKSKIAKEQKRQELVNKYYELRKELKAKGDYEALRKLPRDSSPTRLTRRCKVTGRPRGVLRKFEMSRIAFREHAHKGQIPGVKKSSW

SEQ ID NO: 4281 - protein, 175 aa, Staphylococcus epidermidis
LRQKSGHKPALFYLPKKEACMSKITEQVEALIQPVLNDLNFELVDIEYVKEGKDHFLRISIDKEGGVDLNDCTIASEKISEVMDENDPIPEMYYLDVASPGAERPIKKETDFYNAINQPIFVSLYAPIEGDKEWLGVLKSVNDESINMEVKEKAKTKEIEIPRNKIAKARHAVMI

SEQ ID NO: 4282 - protein, 303 aa, Staphylococcus epidermidis
IKENRMALDKDIVGSIEFLEVVGLQGSTYLLKGPNGESVKLNQSEVADEDNFELGEEYSFFVYPNRSGDLFATQNMPDITKDKYDFAKVIKTDRDGAHIDVGLPREVLVPWEDLPKLKELWPKAGDYLLVTLRIDSTNQMFGRLASETIVESMFTPVNDDSKQNEYISARAYRLLRVGSFLLSNEGYKIFVHESERKHEPRLGEAVEVRIIGHNEKGELNGSFLPLAHERLDDDGQVIFDLLVEYDGELPFWDKSSPDAIKEVFNMSKGSFKRAIGHLYKKKIINIETGKITLTKKGWSRVDD

SEQ ID NO: 4283 - protein, 463 aa, Staphylococcus epidermidis
KGRKIMKVAKFGGSSVSTAEQIKKVLTIVNEDPERKIIIVSAPGKRHNDDIKTTDLLIRLYEKVLNKLNYESKKQEIIQRYADIVEELGIGNDILITINDTLEEYIKHLSDKPNRLYDALLSCGENFNAQLIAQYNNSQGIPTRYISPKEAGLTVTDLPQQAQILDSAYNEIYKLRDYDEKLIIPGFFGVSKQNYIVTFPRGGSDITGAIIARGVRASLYENFTDVSGIYKANPNIINNPELIEEITYREMRELSYAGFGVFHDEALQPLYKDRIPVVIKNTNRPNDKGTYILHDREIDSKNVISGISCDKGFTVINIKKYLMNRLVGFTRKILGVLEEFNISFDHMPSGIDNISIIMRTNQIQGKESQVLNAIRKRCEVDELSIDHDLAVLMIVGEGMNQVVGTASKITHALSESNINLIMINQGASEISMMFGIHEADAEKAVLSTYEFCYNGVCLKNLCK

SEQ ID NO: 4284 - protein, 95 aa, Staphylococcus epidermidis
LRRKLIMAISQQRKDELIKEYRVHETDTGSPEVQIAVLTAEITALNEHLREHKKDHHSRRGLLKMVGRRRHLLNYLRSKDIQRYRELIKSLGIRR

SEQ ID NO: 4285 - protein, 573 aa, Staphylococcus epidermidis
IGRKKRMKQSKVFIPTMREVPAEAEALSHRLLLKAGLIKQSTSGIYSYLPLATRVLNNISKIIREEMESIDAVEILMPALQQAELWEESGRWSAYGPELMRLKDRNGREFALGPTHEEVVTSLVRDELKSYKQLPLTLFQIQSKYRDEKRPRFGLLRGREFLMKDAYSFHSDEASLDATYQDMYQAYSRIFKRVGINARPVVADSGAIGGSHTHEFMALSEIGEDTIVYSNESDYAANIEKAEVVYHPSHKHSALAELTKVETPNVKTAQEVAEYLKRPLDEIVKTMIFKIDGEFIMFLVRGHHELNEVKLKSYFGTEHVEMATPDEIVNLVDANPGSLGPIFDKDIKIYADNYLQDLNNFVVGANEDHYHYINVNIGRDFDVTEYGDFRFITQGEMLSDGSGVAQFAEGIEVGQVFKLGTKYSESMNATFLDNQGKAQPLIMGCYGIGVSRTLSAIVEQNNDENGIIWPKSVTPFDIHLITINPKKDDQRTLGDQLYQKLMDSYDVLYDDRKERAGVKFNDSDLIGLPVRVVVGKRAEEGIVEVKQRINGLSEEVQIDELEYYLQELFKNIK

SEQ ID NO: 4286 - protein, 326 aa, Staphylococcus epidermidis
TMGKIKELETSLANKIAAGEVVERPSSVVKELLENAIDAQATEINIEVEQSGVSSIRVVDNGTGIAQEDLGLVFHRHATSKIVADDDLFHIRTLGFRGEALASISSVAKVTLKTCTDNENGHEIYAEDGKIIHQKPAKAKKGTDIQVDSLFYNTPARLKYIKSLYTELGKITDIVNRMAMSHPEIRISLVSDGKKLLSTNGSGRTNEVMAEIYGMKVAKDLVHISGDTSDYHLEGFVAKPEHSRSNKHYISIFINGRYIKNFVLNKAILEGYHTLLTIGRFPICYINIQMDPILVDVNVHPTKLEVRLSKEDQLYDLIVTKIREGF

SEQ ID NO: 4287 - protein, 164 aa, Staphylococcus epidermidis
VKVERRIIPMIYSLTEIEARYQETDKMGVIYHGNYATWFEVARTDYIRKLGFSYASMEEQGVISPVVDLKVQYKKSIYYPEKVTVKTWVEKYSRLRSTYCYKVYNENGELATTGSTELICIKADTFKPIRLDRYFPEWHETYSKVNQLNKEGKDAEVTFGINHL

SEQ ID NO: 4288 - protein, 82 aa, Staphylococcus epidermidis
QRVEKEYSPSLMTSLFTESNPLTHKEQVVLREIGNGLSSKEIASKLYLSNGTVRNYTSTIIDKMNSDHRFEAWKKANEKGWI

SEQ ID NO: 4289 - protein, 43 aa, Staphylococcus epidermidis
CFNELYENAFILYSYIEPNLLYFDLNLLKIIVNCFLAYVAPHV

SEQ ID NO: 4290 - protein, 261 aa, Staphylococcus epidermidis
RVNDSMSLTIKEIKEKLSRIETLEELHKHEANNDSRKGVINAIKSREKNILKQQALEEHYLSMNQYENNIMSSNRDALICGIDEVGRGPLAGPVVACAVILEKNHHYIGLDDSKKVSPKNRARLNQNLKENVYQYAYGIASSVEIDELNIYRATQLAMLRAINQLDVTPTHLLIDAMTLDIDIPQTSIIKGDAKSVSIAAASIMAKEYRDQYMRQLSKQFPEYGFDKNAGYGTKQHLKAIDQVGIINEHRQSFEPIKSMMK

SEQ ID NO: 4291 - protein, 50 aa, Staphylococcus epidermidis
LLDDLRLSNKLFVTSLCLKLSNKMKLEASNRIVIIITPTIDMRGINSLSK

SEQ ID NO: 4292 - protein, 211 aa, Staphylococcus epidermidis
FDCESACYRGGNMFVKEEKPVNKIVEILRKTSSHLFKFHGEVAMHLFLNDDFILPSKIDICVERKKLLEIIRVIPEEFTIHYYDNQLYERLRESLSLSDVEHVKVFKNDTEVMTIFVYDVVNDEWLFRLDHHIRLPKNNIYFHSLSWNVDYIKPEIVLMYDLMSEQKYHQFSNYKAVIDSLSYYQFYILKLVVGEQRIKKAIVNSSTKKIS

SEQ ID NO: 4293 - protein, 164 aa, Staphylococcus epidermidis
NRSENMTQELKSKLLSFFKFIFATALFIFVIFTLYRELSHINFKETFIQFGKINRLWLVLLFAGGGLSLILLSLYDIILVKALKLKMPLIRVFRVSYIINALNSIIGFGGFIGAGVRAFVYKNYTNDTKKLVQYIFIILVSMLTGLSLLSILVVLRIFNASSHD

SEQ ID NO: 4294 - protein, 185 aa, Staphylococcus epidermidis
KMSDIIKDTKSRMQKSIDNLSRELANISAGRANSNLLNGVTVDYYGAPTPVQQLASINVPEARLLVISPYDKSSVADIEKAIIAANLGVNPTSDGEVIRISVPALTEERRKELVKEVKKIGEDAKVSIRNIRRDINDQLKKDEKNGDITEDDLRSQTDDVQKATDNSIKEIDQLVADKEKDIMSV

SEQ ID NO: 4295 - protein, 57 aa, Staphylococcus epidermidis
KKRLQLKKFDVELVDGFTKVILSFIRMSIRNIIKVKREIAFVLMLMNIKKVVAQQFK

SEQ ID NO: 4296 - protein, 804 aa, Staphylococcus epidermidis
GGNELSEIIQDLSLEDVIGDRFGRYSKYIIQERALPDVRDGLKPVQRRILFAMYSSGNTYDKNFRKSAKTVGDVIGQYHPHGDSSVYDAMVRLSQDWKLRHVLIEMHGNNGSIDNDPPAAMRYTEAKLSQLSEELLRDINKETVSFIPNYDDTTLEPMVLPARFPNLLINGSTGISSGYATDIPPHNLAEVIQGTLKYIDQPDITINQLMKYIKGPDFPTGGIIQGIEGIKKAYETGKGKVVVRSRVDEEPLRSGRKQLIVTEIPYEVNKSSLVKRIDELRADKKVDGIVEVRDETDRTGLRIAIELKKDANSESIKNYLYKNSDLQISYNFNMVAISEGRPKLMGLREIIESYLNHQIEVVTNRTRYDLEQAEKRMHIVEGLMKALSILDEVIALIRNSKNKKDAKDNLVAEYDFTEAQAEAIVMLQLYRLTNTDIEALKKEHEELEALIKELRNILDNHEALLAVIKDELNEIKKKFKVDRLSTIEAEISEIKIDKEVMVPSEEVILSLTQHGYIKRTSTRSFNASGVTEIGLKDGDRLLKHESVNTQDTVLVFTNKGRYLFIPVHKLADIRWKELGQHISQIVPIDEDEEVVNVYNEKDFKNEAFYIMATKNGMIKKSSASQFKTTRFNKPLINMKVKDKDELINVVRLESDQLITVLTHKGMSLTYSTNELSDTGLRAAGVKSINLKDEDYVVMTEDVNDSDSIIMVTQRGAMKRIDFNVLQEAKRAQRGITLLKELKKKPHRIVAGAVVKENHTKYIVFSQHHEEYGNIDDVHLSEQYTNGSFIIDTDDFGEVESMILE

SEQ ID NO: 4297 - protein, 111 aa, Staphylococcus epidermidis
NGIEVDNMVGQTNLFDDVIKKEERFVIVVQALEEKNGKLLKRTLREYPSLEHTQMNDLFSHLKEVFLEEPFGVNQSAYSITVYTNLDYAADQVYAHVKRYKGKHDWTHTAK

SEQ ID NO: 4298 - protein, 675 aa, Staphylococcus epidermidis
LKIDINCRREDTTMFNEKDQLAIDTIRALSIDAIEKANSGHPGLPMGAAPMAYTLWTRHLNFNPQSKDFFNRDRFILSAGHGSALLYSLLHVSGSLELEELKQFTQWGSKTPGHPEYIHTDGVQVTTGPLGQGFAMSVRMALAESHLAGKFNKDQFDIVNHYTYVLASDGDLMEGISHEAASFAGHNQLDKLIVLYDSNDISLDGDLYKSFSEDTKQRFEAYGWNYILVENGNDLDEIDNAITQAKSQQGPTIIEVKTIIGFGSPNKAGSNGVHGAPLGEEERALTFKEYGLDPEKRFNVPEDVYEIFKSTMLKRANENEEAWNNMLKNYSEAYPELAEEFKLAMSGKLPNNYADALPEYDLNHSGASRADSGEIIQKLSEFVPSFFGGSADLAGSNKSNVKEAKDYNKDTPEGKNVWFGVREFAMGAAINGMAAHGGLHPYAATFFVFSDYLKPALRLSSIMGLNSTFIFTHDSIAVGEDGPTHEPIEQLAGLRAIPNMNVIRPADGNETRVAWEVALESEHTPTSLVLTRQNLPTLDVDKQTVENGVRKGAYIVFETEQQLEYLLLASGSEVNLAVEAAKELEQQGKGVRVISMPNWYAFEQQSSEYKESILPSDVTKRIAIEMASPLGWHKYVGIEGKVIGINSFGASAPGDLVVEKYGFTKENILKQVRSL

SEQ ID NO: 4299 - protein, 232 aa, Staphylococcus epidermidis
CQIEVCPKGFRNMHGFGSHKYSMYNDKGERVWVKYHFRTQQGIENYTDEEAAKIVGMDRDSSQRDLYNAIENGDYPKWKMYIQVMTEEQAKNHPDNPFDLTKVWYKKDYPLIEVGEFELNRNPENYFLDVEQAAFTPTNIVPGLDYSPDKMLQGRLFSYGDAQRYRLGVNHWQIPVNQPKGVGVENLCPFSRDGQMRFLDNNQGGGPHYYPNNQGIYESQPEHKKPTIPDRW

SEQ ID NO: 4300 - protein, 327 aa, Staphylococcus epidermidis
PKSERAFKDKILIPQNDLNHAPKKNKVLDTFEQQKINFVKQQSQIGETSAPYVHDHKDKNHDVESHKNNLDSTSSTNNESTEVSNELHNYIDDSYLQSQKEVFFDMEQNTSNEYEISNQQSNDIKGTVSQTPHRRVPYMEIVGQVHGTYIIAQNENGMFMIDQHAAQERIKYEYFREKIGEVTNEVQNLLIPLTFHFSKDEQMIIDQYKDELDKVGVHLEHFGGHDYIVNSYPVWFPKEEAEEIIKDMIELVLKHKSVDVKKIREDAAIMMSCKKSIKANHYLKNNEMADLIDQLREAEDPFTCPHGRPIIINFSNYELEKLFKRVM

SEQ ID NO: 4301 - protein, 690 aa, Staphylococcus epidermidis
TLADNLVIVESPAKAKTIEKYLGKRYKVIASMGHVRDLPRSQMGVDTEDNYEPKYITIRGKGPVVKDLKKHAKKAKKIFLASDPDREGEAIAWHLSKILELEDSKENRVVFNEITKDAVKDSFKHPRGIEMDLVDAQQARRILDRLVGYNISPVLWKKVKKGLSAGRVQSVALRLVIDRENEIRNFKPEEYWSIEGEFRYKKSKFTAKFLHYKNKPYKLNNKDDVQRITEALNGDQFEITNVNRKEKTRYPAHPFTTSTLQQEAARKLNFKARKTMMLAQQLYEGIDLKRQGTVGLITYMRTDSTRISTSAKSEAQQYINDKYGEQYVSQRKSSGKQGDQDAHEAIRPTSTMRTPDDMKAFLTRDQHRLYKLIWERFVASQMAPAILDTVALDVTQNDIKFRANGQTIKFKGFMTLYVEAKDDKENDKENKLPQLDKGDKVTATKIEPAQHFTQPPPRYTEARLVKTLEELKIGRPSTYAPTIDTIQKRNYVKLESKRFIPTELGEIVYEQVKEYFPEIIDVEFTVNMETLLDKIAEGDMNWRKVIGDFYNSFKQDVERAESEMEKIEIKDEPAGEDCEVCGSPMVIKMGRYGKFMACSNFPDCRNTKAIVKTIGVTCPKCNEGDVVERKSKKNRIFYGCSRYPECDFISWDKPVGRDCPKCHHYLVNKKKGKSSQVVCSNCDYEEEVQK

SEQ ID NO: 4302 - protein, 97 aa, Staphylococcus epidermidis
SMQDTLMSIQIIPKTPNNNDVIPYVDEAIKIIDDSGLHFRVGPLETTVQGEMSECLILIQKLNDRMVELECPSIISQVKFYHVPEGIEIETLTGKYD

SEQ ID NO: 4303 - protein, 299 aa, Staphylococcus epidermidis
KEQDNMTHMFEGVGVALATPFTNNEVDFNALERHVQFLLNNNIQAIIVNGTTAESPTLSDEEKEKVLATVVKLVNHSVPVIAGTGTNNTYKSIQASIRAKEIGADAVMLITPYYNKTNQRGLIQHFETIANEVKLPVILYNVPSRTNMTIEPETVGILSHNPYIVALKDATNDFDYFDQVKQRINTNEFALYSGNDDNVVKFYQRGGNGVISVIANVIPQEFQYLYDQRQNETDITNYFKPIEKLLEALSLDVNPIPIKVLTAYLGYGHYEVRLPLVPLEEAQCKQVERAFEQFKAGEQ

SEQ ID NO: 4304 - protein, 128 aa, Staphylococcus epidermidis
RMKDAIQEAEKLAKMNKDQKNQYELEKLLKENEELKAEKALSQMKNETRSMLNESGLENFDDQIVNILVNTDAEKTRKNVESFTNLLNQMVKSNVEKALRQDSPVSTQSNKMTKDEESDYLVSGRKCL

SEQ ID NO: 4305 - protein, 263 aa, Staphylococcus epidermidis
LKGDNRVFFTYIFTYFYDREDKKMAQTSKYKRVVLKLSGEALAGDKGFGINPIIIKSVAQQVAEVAKMDCEIAVIVGGGNIWRGKTGSDLGMDRGTADYMGMLATVMNALALQDSLEQLDCDTRVLTSIEMKQVAEPYIRRRAIRHLEKKRVVIFAAGIGNPYFSTDTTAALRAAEVEADVILMGKNNVDGVYSADPKVDANAIKYEHLTHIQMLQEGLQVMDSTASSFCMDNNIPLNVFSIMEEGNIKRAVMGEKIGTLITK

SEQ ID NO: 4306 - protein, 55 aa, Staphylococcus epidermidis
TSLDMLQLLIKSLNKFVSYYTTDCTYFHEKQIVNNTIKKSRLDLKLCFIIFPALY

SEQ ID NO: 4307 - protein, 51 aa, Staphylococcus epidermidis
NRLESKTPIILPGKANALPVPNEIRSTEEIKACAKPYHGPTNTAHNTFTKC

SEQ ID NO: 4308 - protein, 41 aa, Staphylococcus epidermidis
VVLLHLLYLTFGSFNTIYISNLNKYTIVVVKTKILSCKTFI

SEQ ID NO: 4309 - protein, 573 aa, Staphylococcus epidermidis
IVSLYMDGSLFIGGNILSLIKKKNKDIRIIPLGGVGEIAKNMYIVEVDDEMFMLDAGLMFPEDEMLGVDIVIPDIQYVIENKERLKGIFLTHGHEHAIGAVSYVLEQIDAPVYGSKLTIALVKEAMKARNIKKKVRYYTVNHDSIMRFKNVNVSFFNTTHSIPDSLGVCIHTSYGSIVYTGEFKFDQSLHGHYAPDLKRMAEIGDEGVFALISDSTEAEKPGYNTPENIIEHHMYDAFAKVKGRLIVSCYASNFVRIQQVLNIASQLNRKVSFLGRSLESSFNIARKMGYFDIPKDLLIPINEVENYPKNEVIIIATGMQGEPVEALSQMARKKHKIMNIEEGDSIFLAITASANMEVIIADTLNELVRAGAHIIPNNKKIHASSHGCMEELKMMLNIMKPEYFVPVQGEFKMQIAHAKLAAETGVAPEKIFLVEKGDVISYNGKDMILNEKVQSGNILIDGIGVGDVGNIVLRDRHLLAEDGIFIAVVTLDPKNRRIAAGPEIQSRGFVYVRESEELLKEAEEKVRKIVEEGLQEKRIEWSEIKQNMRDQISKLLFESTKRRPMIIPVISEI

SEQ ID NO: 4310 - protein, 259 aa, Staphylococcus epidermidis
KLKLLTIKNLNINDKEGQAIIKNVDLNIYNQSLNVIIGESGAGKSLTVKAILNHLPTQLHMSFDEFKMQGQNTSGIKQLLGKHIGYISQNYAQSFNEYTRLDKQLIAIYRYHFNVSKDNALKKIKKALTWVNLNDESIINKYSFQLSGGQLERVNIASVLMLDPELIIADEPVASLDVVNGHQIMQLLQHIVKDHHNTVLLITHNMNHVLKYADYFNVMRNGMMIESGEIDKLFNHHHLHRYTEQLLNYRSKLQKEDNI

SEQ ID NO: 4311 - protein, 284 aa, Staphylococcus epidermidis
GSPCFLGGMYMNAYLAEFLGTAILILFGGGVCANVNLKRSAGNGADWIVIAFGWGLAVTMGVYAVGTFSGAHLNPAVTVALAMDGGFSWAQVPGYIVCQMLGGIVGGVFVWLMYLPHWKVTEDPAVKLGVFSTAPAIKNYFANFLSEIIGTMALTLGILFIGVNKIADGLNPIIVGSLIIAIGLSLGGTTGYAINPARDLAPRIAHAILPIHGKGKSNWSYAIVPVLGPMAGGMLGAIVYEVFYKQTFNFSCFIGLIVLIFTLILGVILNKISQNKNNDIESIY

SEQ ID NO: 4312 - protein, 44 aa, Staphylococcus epidermidis
HENCKKYIYHYRLFTLGGCFNEKVAISRYYCIRSFGFTWRLWRK

SEQ ID NO: 4313 - protein, 370 aa, Staphylococcus epidermidis
ERRCTLMESRSWGVRIGELSTLIYLIFPILAIFVDKRGNFLTYLIVCTIFIISYVTMIIFYKYLSDSILYSLLVIHYLGIFYFVYSVNPMNSLFFFYSAFALPFIFNVRVVSKEFITFLIAMISCLILTYIFNPTFVVPLSAFYLVILIVAVGNFKNRDERIMKAKLEEKNKYINVLIAQQERNRISQDLHDTLGHVFASLTLKSELAVKLIDTNPKEAKNEMQAINQLSTEALNKVRLIIDDLKIQSFEDEISSLEHLLQNANLHFKFNNKSAAKSLNPAKQSILSMIFREAINNVIKHAHATEVIGELKVHEHQIILKIKDNGVGIENEDASNLKSIKERVDYLNGKLIVQSNNGTLIIVEIPRGDLL

SEQ ID NO: 4314 - protein, 273 aa, Staphylococcus epidermidis
RFKCIYFINIYRRRKIMSLLSKTRELNTLLQKHKGIAVDFKDVAQTISNVTVTNVFIVSRRGKILGSCLNELLKSERIKDMLEDRHIPREYTEELMNVKQTESNIDIDNELTVFPPENREVFLNSRTTIFPILGGGERLGTLVLGRVQDDFNENDLVLGEYAATVIGMEILREKHNEVEKEARDKAAITMAINSLSYSEKEAIEHIFEELGGTEGLLIASKVADRVGITRSVIVNALRKLESAGVIESRSLGMKGTFIKVKKDKFLDELEKNK

SEQ ID NO: 4315 - protein, 56 aa, Staphylococcus epidermidis
FFILVYIIYIIGSCIYNHKSPSLNLQLNLHGIYIYYLQSFLLFTFLVEFIIAIYIC

SEQ ID NO: 4316 - protein, 173 aa, Staphylococcus epidermidis
IIILEELSTMNIRKLTITAFLIAINVVLSSLIVIPLGPIKAAPVQHFVNVLCAVFVGPWYGLAQAFISSVLRISFGTGSAFAFPGSMIGVLLSSLFYMYRKHIFMASVGEVLGTGVIGSLMCIPLAWFLGLQDFFIKPLMLMFIVSSFIGALISYILLIILKRRGLLDRFNKN

SEQ ID NO: 4317 - protein, 104 aa, Staphylococcus epidermidis
LMVRTDLTSFRSGDTLRVHVRIVEGSRERIQVFEGVVIKRRGGGISETFTVRKISSGVGVERTFPLHTPKIEKIEVKRRGKVRRAKLYYLRSLRGKAARIQEIR

SEQ ID NO: 4318 - protein, 50 aa, Staphylococcus epidermidis
YSYRIKIKLYINKEPGTLINIPDSCVNVKTIINYFVIHQFLVSIPHKVLL

SEQ ID NO: 4319 - protein, 45 aa, Staphylococcus epidermidis
ATDRIYGQWLIKYNIKNRAYKRSDIMIYFNCKSTSFISFKISAVS

SEQ ID NO: 4320 - protein, 45 aa, Staphylococcus epidermidis
VHTLISFSHSICMKKPNSSLRFKMMFIIDNHSQLITFSYCTNILR

SEQ ID NO: 4321 - protein, 234 aa, Staphylococcus epidermidis
MKALVIGGSGTIGRAIVKRLLFEGYEVFLHYHSAQYSDLSNQFKNSKVTFIQCDLTKDIELEDYFGHIDELDCLIYTSGTALYGMLQDMSDCDIDNSYALNVRQFIRLTRYFIDILRQSNNGRIIVISSIWGETGASLETIYSAMKSAQIGFVKALSQELALTSVTVNAITPGMVKGKMSDVWSKDELSNIVSELPQQRMIDPSEVAHACAYLCSTMSKSITGTVHKVNGGWYI

SEQ ID NO: 4322 - protein, 97 aa, Staphylococcus epidermidis
TSKRRRINHEREVLKQQALNEGKPEKIVEKMVEGRLRKYLQEICAVDQNFVKNPDETVEAFLKAKGGKLTDFVRYEVGEGMEKREENFAEEVKGQMK

SEQ ID NO: 4323 - protein, 445 aa, Staphylococcus epidermidis
SCSRYNLCTNERRPTLMKTHQYELIDEKVFEHEFDNGLKLFIIPKPGFQKTYVTYTTQFGSLDNHFKPIGSQQFVKVPDGVAHFLEHKLFEKEDEDLFTAFAEENAQANAFTSFDRTSYLFSATSNIESNIKRLLNMVETPYFTEETVNKEKGIIAEEIKMYQEQPGYKLMFNTLRAMYSKHPIRVDIAGSVESIYEITKDDLYLCYETFYHPSNMVLFVVGDVSPQSIIKLVEKHENQRNKTYQPRIERAQIDEPREINQRFVSEKMKLQSPRLMLGFKNEPLDESATKFVQRDLEMTFFYELVFGEETEFYQQLLNKDLIDETFGYQFVLEPSYSFSIITSATQQPDLFKQLIMDELRKYKGNLKDQEAFDLLKKQFIGEFISSLNSPEYIANQYAKLYFEGVSVFDMLDIVENITLESVNETSELFLNFDQLVDSRLEMENR

SEQ ID NO: 4324 - protein, 54 aa, Staphylococcus epidermidis
YIHSSLVQFMLSCSTKPNFTKDGVSSHLPLTFWCYLNFSYFTLLQKNHNNAIIL

SEQ ID NO: 4325 - protein, 40 aa, Staphylococcus epidermidis
CSRLYLWMFRDKCLKYSLFMAYDSHHFKHTLPQRIMLLIN

SEQ ID NO: 4326 - protein, 299 aa, Staphylococcus epidermidis
HKSRGVTIMIELRHISKSFKEHKVLEDISIDIKNNCCTALIGKNGAGKSTLIDIIVGNNHYDSGQIADKSNLLNRHKMGILFQKTEFPKYIKVCELLHLYQSFYQTFISFHQFKEITQFSDRQMNQFACNLSGGQQRILDFALALVGKPELLILDEPTSAMDVEMRQHFWNVIDKLKMNNTTILYTSHYIEEVERMADQVMMLDKGKIQLDDSPENIKRNQSYSVIRIPCKYQELINQLKHKYEIELIKNRYEIKTTDVSDVLQLLKQYHVNFNKIEILKKSLLEVMFSNDLSKGGNYQ

SEQ ID NO: 4327 - protein, 367 aa, Staphylococcus epidermidis
YQESLSCRGSLIIMKRWQGLVKEFKEYLPVNQSTPALTLNEGHTPLIYCENLSQKLDIELYVKYEGANPTGSFKDRGMVMAVTKAKEQGKKVVICASTGNTSASAAAYAARAGLKAIVVIPEGKIALGKLSQAVMYGAEIVSIEGNFDEALEIVKEIAEENDEIELVNSVNPFRIEGQKTGAFEIVEQLDGQAPDILAIPVGNAGNITAYWQGFVEYHNKKNTQLPQMFGFQAEGASPIVQNKIIKNPETIATAIRIGNPASWQKAVNALDESNGLIDSVIDEEILEAYQLMTTNEGVFSEPASNASIAGLIKLHRSGKLPKGKKIVAILTGNGLKDPDTAISLLDNPIQPLPNNKESIIRYIKGAI

SEQ ID NO: 4328 - protein, 40 aa, Staphylococcus epidermidis
RKRRIVCNCFINLRQTKLSQVFLMKIINVSQLKFYYHICI

SEQ ID NO: 4329 - protein, 424 aa, Staphylococcus epidermidis
ILKRFNQDNTKVRVNVLPTDKFKTTTITFKFMAPLNYKTITSRSILSKVLVRATQQWPTDKTLNKQLSELYGAYVNSFVSKFKDKHVITISLEVVNEKFLKDKTPLFEKGLDTLKEIIWNPLIKDRCFDHTYVAQEKSLLSKKLEAMEDNKAQYSFLQLMNYMFKQEPYRYIATGQLEQIPQVTSESLYDTYLSMVQNDDCAIYVVGNINKEEVTQLILDKFAIKPFYLENKESTEITPSFDQPQYIIEKDDVDQAKLNLGYRFPSYYGKSNYYAFIVLNMMFGGDPSSVLFNEVREKQSLAYSIHSQIDGKNGFLFVLSGVSAEKYEQAKDTVIKEFDKIKNGDFDSNKIELAKKIIISHRHEASDRPKSIIEILHNQLLLNRQQTDQDFINAVNQVTKKDVIKLANEAVLDTIYVLTKGDQH

SEQ ID NO: 4330 - protein, 388 aa, Staphylococcus epidermidis
ISGSISLMNISIVAVGSELLLGQIANTNGQYLSKLFNSIGKSVVEHTVIGDNPQRLEYVIKQCLSRFDTIVLTGGLGPTKDDLTKHTVAKVLGKNLVTDEASLNFIKNYFKEQGQDMTSNNKQQALVIEDAIVLPNKNGMAPGMLVELGKQKIILLPGPPKEMQPMAKNELLPYLMDKDEVIFSELLRFAGIGESKLETLLIDLIDDQTNPTIAPLAGTHEVYFRLTANAESKERCQLLIKPIRDEILNRVGTYYFGSDEVNIEESVINSAKQNFAIYDGVTNGALFTRLKNADSKNLVKGMLPHSNQFIDVTSEFNAVLFNAAQYVRDLYQTDLGIVLLNKDNIVYLGIYDGNNFDIETFKMSQSRNLLRSRSQNYAMIRLLNWFNK

SEQ ID NO: 4331 - protein, 195 aa, Staphylococcus epidermidis
KFIGGNSMILIIDNYDSFTYNLVDIVEKQCETIVKYPDDTDICNLKGITAVIISPGPGHPLDNQLLIKLIENFENLPILGVCLGAQALTCYYGGDVIQGSCVKHGKVDTLTIVNQSPLYKGIKSSFKVMRYHSLISDPCSFPESLLITGQTYDSIQSFQHKNRKHYGIQFHPESFATENGKQIIINFINIATRGS

SEQ ID NO: 4332 - protein, 309 aa, Staphylococcus epidermidis
GKDGSTKMSVFIDKNTKVMVQGITGSTALFHTKQMLDYGTQIVAGVTPGKGGQVVEGVPVYNTVEEAKNETGANVSVVYVPAPFAADSIIEAADADLDMVICITEHIPVVDMVKVKRYLQGRKTRLVGPNCPGVITADECKIGIMPGYIHKKGHVGVVSRSGTLTYEAVHQLTEEGIGQTTAVGIGGDPVNGTNFIDVLKAFNEDSETKAVVMIGEIGGTAEEEAAQWIKENMNKPVVGFIGGQTAPPGKRMGHAGAIISGGKGTASEKIKTLNDCGVETADTPSEIGTTLIDAAKKAGIYEELLTIKK

SEQ ID NO: 4333 - protein, 424 aa, Staphylococcus epidermidis
NKFGIPNLFFFILCMSPLIIGGLKLNRSVLKFGGSSVSDFKKIKNIAEMLKTRIEDGEELIVVVSAMGKTTDQLMNNVSSLTSTPKDQELALLLTTGEQQTVSYLSMVLNDIGVNAKAMTGYQAGIKTVGHHLKSKIAEINPNIFNEAFKNHDILVVAGFQGINEDFELTTLGRGGSDTTAVALAASNQTPCEIYTDVDGVYATDPRIHNEAKRLEYVSYEEMMEMSALGAGVLETRSVELAKNYDIPLYLGRTLSNVKGTWIMSKSDLLEKKAVTGVALDTHMMHVTISYPLPDNQLLTQLFTALEEESVNVDMISQIVNLEGLQLSFSIKDSDAHQISSILENLSTHFSALDYKINEAYVKISLIGSGMRDMSGVASKAFTTLINSDIPFYQTTTSEISISYVIDEENGEKAVEELYHAFEI

SEQ ID NO: 4334 - protein, 276 aa, Staphylococcus epidermidis
LLKGVLYYMTQYKMVVLDMDDTLMNSDNKLSIETKSYLLDIQKRGYYVVLASGRPTEGMLPTARELELNKYNSFIISYNGGKTINMANENVEVDQPVSKEDFDNIVDYCRDKNFLVLTYDNGYIIHDSSHEYMNIESQLTGLPMNRVADLKEYINHSVPKVMGVDYVGHITEARIELDGYFNNDIDVTTSKPFFLEFMAKNVSKGNAIKALCKRLQISLEEVIVFGDSLNDKSMFEVAGYSVAMGNASDELKKIADEVTLDNNSNGIPYALKELLV

SEQ ID NO: 4335 - protein, 603 aa, Staphylococcus epidermidis
MSEGLPLREEVPVKETWDLKDLFTSDQAFYQTLEQVVQMSLDFNHTYYQKLNNIETIEKALDEYERILIEIDRLYNYPELRLSVDTSNEEAQKVNAKLNTTSGKLAGLLSFVDSEILELPDEIISELRSQTKYPHFIKQLQDRKPYQLSADVEKVLATLTPTLRSPFELYGTTKSLDINFESFDYEGVTYPLDYATFENEYEDHPSPEFRRKSFRAFSDALRQYQHTTAATYNMQVQQEKIEADLRGYDSVIDYLLQDQEVTKDMFDRQIDVIMSDLAPVMQKYAKIIQRVHNLDKMRFEDLKISIDPNFEPEISIEESKKYIYGALKVLGDDYVKMLESAYDYRWIDFAQNKGKDTGAYCASPYITHSYVFISWTGKMAETFVLAHELGHAGHFTLAQNHQNLLESEASMYFVEAPSTMNEMLMANYLFNSSNNPRFKRWVIGSILSRTYYHNMVTHLLEAAYQREVYSRVDNGESLTAPLLNEIMLNTYKAFFGDTVEMTDGVELTWMRQPHYYMGLYSYTYSAGLTIGTVVSQCIKKEGQPAVDRWLKTLQAGGSQSPIELAQIAGVDITTDAPLKETINYISNLVDELEVLTYQIKENS

SEQ ID NO: 4336 - protein, 474 aa, Staphylococcus epidermidis
QYGGMLNMDTNGIKLTPKDIVSKLNEYIVGQNDAKRKVAIALRNRYRRSLLKEEEKQEIAPKNILMIGPTGVGKTEIARRMAKIVGAPFIKVEATKFTEVGYVGRDVESMVRDLVDVAVRLVKDGKKSLVKDEATKKANDKLVKLLVPSLKKKAAQGNNPLENLFGGAIPNFGQNQDEEEEPPTEEIKTKRSEIKKQLEQGKLENEKVRIKVEQDPASMGMLGTNQNQQIQDMMNQLMPKKKVEREVSVETARKILADDFADELIDQETANQQALELAEQMGIIFIDEIDKVATNNQNSGQDVSRQGVQRDILPILEGSMIQTKYGTVNTEHMLFIGAGAFHVSKPSDLIPELQGRFPIRVELESLSVEDFVRILTEPKLSLVKQYEALLQTEEVTVNFSEDAIQRLAEIAYQVNQDTDNIGARRLHTILEKMLEDLSFEAPSMPNAVVDITPQYVDDKLKSISTNKDLSAFIL

SEQ ID NO: 4337 - protein, 394 aa, Staphylococcus epidermidis
ETGGWKMNIHEYQGKEIFRSMGVAVPEGRVAFTAEEAVEKAKELNSDVYVVKAQIHAGGRGKAGGVKIAKSLSEVETYANELLGKQLVTHQTGPEGKEVKRLYIEEGCDIQKEYYVGFVIDRATDKVTLMASEEGGTEIEEVAAQTPEKIFKETIDPVVGLSPYQARRIAFNINIPKESVGKATKFLLALYNVFIEKDCSIVEINPLVTTGDGQVLALDAKLNFDDNALFKHKDILELRDLEEEDPKEIEASKYDLSYIALDGDIGCMVNGAGLAMATMDTINHFGGNPANFLDVGGGATKEKVTEAFKIILGDDNVKGIFVNIFGGIMKCDVIAEGIVAAVKEVELTLPLVVRLEGTNVERGKAILNESGLAIEPAATMAEGAQKIVKLVKEA

SEQ ID NO: 4338 - protein, 44 aa, Staphylococcus epidermidis
TPFIYNKSVDKSLLYHIFSVIMYGVYSIPIFSYKILRALNTMAC

SEQ ID NO: 4339 - protein, 119 aa, Staphylococcus epidermidis
ILLIGARAMTIFDMPNYLWITILGMILLTVFYTLVLNKWFQSAIITFVVLAVLAFFIPNFQNISYQPLLGYAGFLGIMSLIISFLIWYFSRNWRKNRRKIKLEKEIRKYDDEESLRRHK

SEQ ID NO: 4340 - protein, 332 aa, Staphylococcus epidermidis
LFIMTRLAVAGATGLVGTKMLETLDRKQIPFDELVLFSSARSAGKKVEFQGQLYTVQELTDEAASEHFDYVLMSAGGSTSEHFAPLFEAAGAIVIDNSSQWRMAEDVDLIVPEVNEPQFTRGIIANPNCSTIQSVVPLKILQDAYGLKRVAYTTYQAVSGSGVKGKRDLAEGANGKEPEAYPYPIYNNVLPHIDVFLENGYTKEEQKMIDETKKILNDQDLKVTATCVRVPVQDSHSIEIDVTLNQDTTVKEIQELFAQDQRVVLVDNPSKNEYPLAIHSTGKDEVFVGRIRRDDSLENTFHVWCTSDNLLKGAALNAVQVLEQILTLKGAR

SEQ ID NO: 4341 - protein, 422 aa, Staphylococcus epidermidis
MGVMKMKFTNLTAKEFSDFTDRMTYSHFTQMEGNYELKVAEGTESHLVGIKNNDNEVIAACLLTAVPVMKIFKYFYSNRGPVIDYNNKELVHFFFNELSKYVKKYNCLYLRVDPYLPYQYLNHEGEITGNAGHDWIFDELESLGYKHEGFHKGFDPVLQIRYHSVLNLANKSANDVLKNMDGLRKRNTKKVKKNGVKVRFLSEEELPIFRSFMEDTSETKDFADREDSFYYNRFKHYKDRVLVPLAYINFDEYIEELNNERNVLNKDYNKALKDIEKRPENKKAHNKKENLEQQLDANQQKINEAKNLKQEHGNELPISAGFFIINPFEVVYYAGGTSNRYRHFAGSYAVQWKMINYAIEHGINRYNFYGISGDFSEDAEDAGVVKFKKGYDADVIEYVGDFIKPINKPMYNIYRTLKKLKK

SEQ ID NO: 4342 - protein, 263 aa, Staphylococcus epidermidis
VMTILNEIIEYKKTLLERKYYDKKLEILQDNGNVKRRKLIDSLNYDRTLSVIAEIKSKSPSVPQLPQRDLVQQVKDYQKYGANAISILTDEKYFGGSFERLNQLSKITSLPVLCKDFIIDKIQIDVAKRAGASIILLIVNILSDDQLKELYSYATNHNLEALVEVHTIRELERAHQINPKIIGVNNRDLKRFETDVLHTNKLLKFKKSNCCYISESGIHTKEDVEKIVDSSIDGLLVGEALMKTNDLSQFLPSLKLKKNLYDS

SEQ ID NO: 4343 - protein, 134 aa, Staphylococcus epidermidis
NIYMLYNQKYILKEGLCFMLKEFKEFALKGNVLDLAIAVVMGAAFNKIVTSLVQYIIMPLIGKLFGSVNFAEDWSFWGIKYGLFIQSIIDFIIIAFALFIFVKIANTVMKKEEKEEEVEENTVLLTEIRDLLKK

SEQ ID NO: 4344 - protein, 498 aa, Staphylococcus epidermidis
IYYILLIKVVPRVSVLITKEADFFRKRRKSMDIVYKKVNAQITPEALAKLKQKKIIFESTNQQKLKGRYSIVVFDHYGKITLDNSQLLIKLDNHCEIVKNQPYQRLKEFVDKYYFEIKDKYLKDLPFISGFIGTCSFDLVRHEFKKLQDIKLEDHQTHDVQFYLVEDVFVFDHYKDELYIIASNLFSDRTKERLKESIERKIEDLKNIHFSVEDINYKSIPRHITTNISEQQFVQTIRILKKKITEGDMFQVVPSRIYSYKHHFQHNLHQLTFQLYQNLKRQNPSPYMYYINKDVPIVIGSSPESFVKVKDGKVYTNPIAGTIKRGQNKKEDENNEKTLMKDEKELSEHRMLVDLGRNDIHRISKTGTSQITKLMTIERYEHVMHIVSEVIGELKPHLSPMSVIASLLPTGTVSGAPKLRAIQRIYESYPYKRGIYSGGVGYINCNHHLDFALAIRTMIIDEEKVSVEAGCGVVYDSIPEKELEETKLKAKSLLEVTP

SEQ ID NO: 4345 - protein, 1362 aa, Staphylococcus epidermidis
QLIFQLKIPTIKMSFALKYFGHCIDQTRLSPKVKGQLKQKKLIMSGNVLKVLVSNDIERNHFDRACNGSLVKAFRQCGFEIDKVVFETDSTNHDDDLGSLEAHIPQEDEQSAREATEKLEKMKAEKAKQQDNNESTVEKCQIGKPIQIENIKPIESIIEEEFKVAIEGVIFDINLKELKSGRHIVELKVTDYTDSLVLKMFTRKNKDDLDHFKALSVGKWVRAQGRIEEDTFVRDLVMMMSDIEEIKKTPKQDKAEDKRVEFHLHTSMSQMDGIPNISAYVEQAAKWGHQALAVTDHNVVQAFPDAHNAAEKHGIKMIYGMEGMLVDDGVPIAYKPTDRNLKDATYVVFDVETTGLSNQYDKIIELAAVKVHNGEIIDKFERFSNPHERLSETIINLTHITDDMLTDAPEIEEVLTEFKEWVGDAIFVAHNASFDMGFIDTGYERLGFGPSTNGVIDTLELSRTINTEYGKHGLNFLAKKYGVELTQHHRAIYDTEATAYIFIKMVQQMKELGVNNHLEINKKLTNEDAYKRARPSHVTLIVQNQEGLKNLFKIVSASLVKYYYRTPRIPRSLLNEYREGILIGTACDEGELFTAVMQKDQSEVEKIAKFYDFIEVQPPALYQDLMDRELIRDNETLTQIYKRLIDAGKSANIPVIATGNAHYLYEHDAIARKILIASQPGNPLNRSTLPEAHFRTTDEMLDDFHFLGEEKAYEIVVTNTNELANKIEKVVPIKDKLFTPRMDGANEEIRELSYSNAKKLYGEDLPQIVIDRLEKELDSIIGNGFSVIYLISQRLVKKSLDDGYLVGSRGSVGSSFVATMTEITEVNPLPPHYICSHCKTSEFFDDGSVGSGFDLPDKKCPTCGNELIKEGQDIPFETFLGFKGDKVPDIDLNFSGEYQPNAHNYTKVLFGEDKVFRAGTIGTVAEKTAFGFVKGYLNDQGIHKRGAEIDRLVKGCTGVKRTTGQHPGGIIVVPDYMDIYDFTPIQFPADDQSAAWMTTHFDFHSIHDNVLKLDILGHDDPTMIRMLQDLSGIDPKTIPVDDKETMQIFSGPESLGVTEDEILCKTGTFGVPEFGTGFVRQMLEDTKPTTFSELVQISGLSHGTDVWLGNAQELIRQGICDLSSVIGCRDDIMVYLMYAGLEPSMAFKTMEFVRKGRGLTDEMVEAMKENNVPDWYLDSCRKIKYMFPKAHAAAYVLMAVRIAYFKVHHPLYYYAAYFTIRASDFDLITMIKDKTSIRNTVKDMYSRYMDLGKKEKDVLTVLEIMNEMAHRGFRLQPISLEKSQAFDFIIEGDTLIPPFISVPGLGENVAQRIVEAREEGPFLSKEDLNKKAGLSQKVIDYLDELGSLPDLPDKAQLSIFDM

SEQ ID NO: 4346 - protein, 53 aa, Staphylococcus epidermidis
LTYMFTLMIKLKFESPFHLLSCANLHLPLAFCLLQNIMITLSIKLSDFSNYLV

SEQ ID NO: 4347 - protein, 504 aa, Staphylococcus epidermidis
RSHIPMEKYILSIDQGTTSSRAILFNKEGEIKGVSQREFKQHFPHPGWVEHDANEIWTSVLSVMAELLNENNINANQIEGIGITNQRETTVVWDKNTGRPIYHAIVWQSRQTQDICTNLKEQGYEETFREKTGLLLDPYFAGTKVKWILDHVEGAREKAENGDLLFGTIDSWLVWKLSGRTAHITDYTNASRTLMFNIYDLKWDDELLELLNIPKQMLPEVKESSEIYGKTIDYHFFGQEVPIAGIAGDQQAALFGQACFDRGDVKNTYGTGGFMLMNTGEEAVKSESGLLTTIAYGLDGKVNYALEGSIFVSGSAIQWLRDGLRMINSAPQTENYASRVESTEGVYMVPAFVGLGTPYWDSEARGAIFGLSRGTEKEHFIRATLESLCYQTRDVMEAMSKDSGIEVQNLRVDGGAVKNNFIMQFQADIVNSSVERPEIQETTALGAAYLAGLAVGFWDDKEDIRERWKLQTEFKPEMDADQRHKLYSGWKKAVKATQVFKLED

SEQ ID NO: 4348 - protein, 391 aa, Staphylococcus epidermidis
KKHIELKRTNVLIRRIIMKIVHTADWHLGKILNGKQLLEDQKYILTQFKQHMEKEQPDLIVIAGDLYDTSYPSKEAIGLLEETIEYLNIELKIPIIMISGNHDGRERLNYGSKWFENNQLYIRTQLENIDDPIELSGVQFFTLPFATVSEVQNYFKDKQIETYQQALNECLEQMSSSIDNNKVNILIGHLTIEGGKTSDSERPLTIGTVESVDMHSFRLFDYVMLGHLHHPFSINNSFIKYSGSILQYSFSEVNQSKGYRVLDIENNQLLNETFVPLKPLRELEVIEGDYEDIIQERIKVKNKNNYFHFKLTNVSHITDPMMKLKQIYPNILALSNVVFDHSENFSHVEIKKQDDQTIIENFYKNMTDQHLSQVQSDKIKHLLSFILDREG

SEQ ID NO: 4349 - protein, 196 aa, Staphylococcus epidermidis
GFNMNIPNQITVFRVILIPFFILFALVDFGFGQISILGGNHIRIEILISAIIFVVASLSDFADGYLARKWQLVTNMGKFLDPLADKLLVASALIVMVQLGFTNSVVAIIIIAREFAVTGLRLLQIEQGFVSAAGQLGKIKTAVTMVAIIWILLGDPFLHYLHFPIGVWLLYIGVFFTILSGIEYFYKGRDVFKHSK

SEQ ID NO: 4350 - protein, 124 aa, Staphylococcus epidermidis
HNNMYSEKEIIRKVESLAEKIGKLEVVQDYHNVEKQIHNNQAIKQKMNRLKAQQKQSVNFQNYGKQNALEQSEVKIQNLKDEINELPIVEEFRSAQYEANDLLQMMVKTMEDRLNEYNKKEHNE

SEQ ID NO: 4351 - protein, 44 aa, Staphylococcus epidermidis
ALIIKVVSLTGVKITMQSKTVINKRNLLIVFTYYFLLISITIKD

SEQ ID NO: 4352 - protein, 104 aa, Staphylococcus epidermidis
HRIIGWSDKLMRKKKIPMRKCIISNEMRPKKDMIRVVINKEGEIFADATGKKQGRGAYVSKDVALVEKAQQREVLEKYFNATKDTLDPVYKEIIRLIYREEIPK

SEQ ID NO: 4353 - protein, 43 aa, Staphylococcus epidermidis
LRTIAIIKIIIIIDKIIVKDITTHPNLLILNSICKINYKLLKF

SEQ ID NO: 4354 - protein, 870 aa, Staphylococcus epidermidis
GFAMIKNIWNKPIKRFTLIVLVSCILSFILYGPFLYQFITKGIVFSGSGDGFRQMMPFQMYLYEHFTSLKGFYDASFGLGGDYVKSLAYYYSLSPLMWINFSMIWILEQTINVNPHDISFWPINQLIMAYVRTVITFIFSFYLFSYLRLKPAPMFIATILYGMSTVVTYYNFTWSFYGNLLIMLPMSLWAIERFFKERKIGWFIFAIAYTLFSNFYFSYYEAIVIGFYFIYRFAIPHEKDIVNRWQKLYILVCATLLSVLVSIYGLYTGISSFLDNDRAQNPNFKITFFTNLFETNYNIFADGFYITISFIAIIALFCFKLYQHYYYKLFAIATWILLIGSFSQWFDSAFNGFSLPQRRWVYFLALSTSVLIALFIQHLSEISIKEYTFVAIPVFIYGFIFIALSERSVKWMFVALILIIVLFIFIKYKSLLTRTSMMVLLVVLFLAQQVLMTNDSRKITIEPYQTTIKTINDSSYRSPVLNKKIKYMHQSSTDPLKRLDYFSYYALNSPLIYHYNGTSLYSSIFDGDILKYYDQTLQINMPVDKNSTYRYLNNRANLMSLWDVQDRLRHPDDLNMPYGFKKKELITDKKDQWIHSVNTINYPSAHITNKIYDARKLKSPLDREQAMLKGVVLNHKSQANTDFKPNPNLLSNAKQNLNHANWIDSKHLKVKQHNGGVTLNLLRNIVKNYKDMYIEMDVELLSLDKEHKVGVNEYSQERNRLSYKYRRFVSPVTMRAKASNQLNIKMSKGVYRFKVKGIYGENYQTLKKASQQLQPVKVKKERNGFTIIKKKKEHGYLVLPMVYAKGMHAMANGKPLKVQQGNGIMTTIPVKEGQTKIKLSYTPPYFYLLITVSCIGIILSILFTHYVKRK

SEQ ID NO: 4355 - protein, 40 aa, Staphylococcus epidermidis
ESYILIVRLSTDMCQDMKLHYTHFKLLFLKNKSKTTKKDG

SEQ ID NO: 4356 - protein, 51 aa, Staphylococcus epidermidis
LVVLSMNNRKLEKQFPMALSTSLQVTRNFGNLYTVNKNVFKFVNQGIIIFS

SEQ ID NO: 4357 - protein, 48 aa, Staphylococcus epidermidis
VLNIGFSSTPTIDVKNKALKCLDLCFNFVNKIEKIDSFLSIKNHHNEL

SEQ ID NO: 4358 - protein, 429 aa, Staphylococcus epidermidis
NMSILITIISFIIVFGVLVTVHEYGHMFFAKRAGIMCPEFAIGMGPKIFSFRKDETLYTIRLLPVGGYVRMAGDGLEEPPVQPGMNVKIKLNNQDEITHIILDDQHKFQQIEAIEVKKCDFKDDLYIEGITSYDDERHHFTIAKKAFFVENGSLVQIAPRDRQFTHKKPLPKFLTLFAGPLFNFILALVLFIGLAYYQGTPTNVIGEVVKKSPADEAGLHKGDKIVQVGNHKIKNFDDIKHVLDQNKTAKTTVKIKRDGQNKSVDLQPKKVERKITKTKTQTTYQIGFAPTTEHSVFKPISYGIYNFFDKGKLIFTAVVGMLASIFTGEFSFDMLNGPVGIYHSVDSVVKSGIINLVGYTALLSVNLGIMNLLPIPALDGGRILFVLYEAIFRKPVNKKAETGIIAVGALFVVIIMILVTWNDIQRYFL

SEQ ID NO: 4359 - protein, 54 aa, Staphylococcus epidermidis
LILIVLNKFTNSHRRFFMNRKMIFILNDARVKLKVVGLAIIKYNYEVIDKSLRK

SEQ ID NO: 4360 - protein, 57 aa, Staphylococcus epidermidis
HIIIFNIIYRFNYLDDFLIKHKFIRGVEHEHFNYDYFIYHRIWCTRNCSRIWTHVFC

SEQ ID NO: 4361 - protein, 41 aa, Staphylococcus epidermidis
TIVIELIIDKLKIKLLSVSKFVKFEGENLILLILSVIFMTT

SEQ ID NO: 4362 - protein, 341 aa, Staphylococcus epidermidis
VNTIKRFLLLITVLLCIVIFTPVKETTFMIKAQNDIRHQINRWIDSDSNDDNTQLAIPKKQEFAINNIQMNMTKKDVEAQLGQHKRMTSSVYGTNWYTYYSNDYNQFLMVSYINNHVNALYTNQNLISSKSQIKYDTPKDVVRERYGPPIQVIKKGKVGFDVKSNEYDVFHKDHIYTTVFYDKHRDNGVKSLLQVSEKMENRLRYQYGKPSKLLAKSFELQNFDIVNAERKQHGLKTLDYSKDVSHTARKHSVDMVKHNYFDHVNQKKLSPFDRLKKDGIEFNAAGENLAYGQLNSIYAHEGLMNSLGHRKNILNTHFDYLGVGVYFNDRRQPFWTENYTS

SEQ ID NO: 4363 - protein, 403 aa, Staphylococcus epidermidis
LMKIQTEVDELGFFGEYGGQYVPETLMPAIIELKKAYEDAKSDTHFKKEFNYYLSEYVGRETPLTFAESYTKLLGGAKIYLKREDLNHTGAHKINNAIGQALLAKRMGKTKLVAETGAGQHGVASATIAALFDMDLIVFMGSEDIKRQQLNVFRMELLGAKVVSVSDGQGTLSDAVNKALQYWVNHVEDTHYLLGSALGPDPFPTMVRDFQSVIGNEIKSQILSKEGRFPDALVACVGGRSNSIGTFYPFIQDDVKLYGVEAAGKGSHTHNHALAIGKGKPGVLHGSKMYLIQNDDGQIELAHSISAGLDYPGIGPEHSYYNDIGRVSYVSATDNEAMEALITFSKVEGIIPAIESAHALSYVEKLAPNMDEKEIIVVTISGRGDKDMETIKQYKENGGEQNE

SEQ ID NO: 4364 - protein, 383 aa, Staphylococcus epidermidis
ILEMTHIQYCYSENSETRRRSMRNILFVGLGLIGGSLASNLKYHYSNFNILAYDSDYTQLDEALSIGIIDQKVNDYATAVEIADIIIFATPVEQTIKYLSELTNYNTKTHLIVTDTGSTKLTIQSFEKELLKHDIHLISGHPMAGSHKSGVLNAKKHLFENAYYILVFNEIENNEAATYLKKLLKPTLAKFIVTHANEHDFVTGIVSHVPHIIASILVHLSANHVKDHSLIEKLAAGGFRDITRIASSNAQMWKDITLNNQNHILSLLNEIKEQITGIENLIREQNSNSIYDFFVKAKDYRDQLPVKQHGAISTAYDLYVDIPDKPGMISQITNIISSHNISIINLKILEVREDIYGALQISFKSPEDRENAIKALANFDTYY

SEQ ID NO: 4365 - protein, 193 aa, Staphylococcus epidermidis
MTEMTKPFLIVIVGPTASGKTELSIEVAKKFNGEIISGDSMQVYQGMDIGTAKVTTEEMEGIPHYMIDILPPDASFSAYEFKKRAEKYIKDITRRGKVPIIAGGTGLYIQSLLYNYAFEDESISEDKMKQVKLKLKELEHLNNNKLHEYLASFDKESAKDIHPNNRKRVLRAIEYYLKTKKLLSFSQESAPIY

SEQ ID NO: 4366 - protein, 40 aa, Staphylococcus epidermidis
MNRMLNIKGEVKRPIFLKIKRNRYKDINGSYEDEVYEFDS

SEQ ID NO: 4367 - protein, 67 aa, Staphylococcus epidermidis
QRRMLIMPIINVKLLEGRSDEQLKDLVTEVTHAVEKTTGANKEAIHVVIEEMRKDHYAVGGVRKSDQ

SEQ ID NO: 4368 - protein, 204 aa, Staphylococcus epidermidis
VFMMIIVMLILSYLIGAFPSGLIIGKLFFKKDIRQYGSGNTGATNSFRVLGRPAGFIVTFLDIFKGFITVFFPLWFPVHADGVISTFFTNGLIVGLFAILGHVYPIYLKFNGGKAVATSAGVVLGVNPILLLILAIIFFSVLKIFKYVSLSSIIAAISCVIGSIIIHDYILLAVSGIVSIILIIRHKSNIVRIFKGEEPKIKWM

SEQ ID NO: 4369 - protein, 123 aa, Staphylococcus epidermidis
FIMISLVITEDQLMLRKAMVQLIEMHEEMNVIKDFENGVEALEFIENNEPNVAILDIEIPGLTGLEILSYVRKKQLNTRIIIVTTFKRPGYFEKAVANDVDAYVLKERSIDDLIKTIYKVTKG

SEQ ID NO: 4370 - protein, 79 aa, Staphylococcus epidermidis
YWMILKYKYKFLTYMTIVIVCCIIFSNFFLSVNQGVQSEQTYEMTDHKIHQHNQQGTTQNYKDKQNSEQNDQSVFALVN

SEQ ID NO: 4371 - protein, 130 aa, Staphylococcus epidermidis
VKTIGEVLKSRRERLGMTLSELEQRTQLKRQTLIHIENNDFNELAKSDYTEGFIRKYAKVVNIEPNQLIEAHQDEIPETQYQIDDVIQTFSNGYEPPYRRQSKEAFQLLMWMGFIILISLIVWILAVLII

SEQ ID NO: 4372 - protein, 266 aa, Staphylococcus epidermidis
TETIRLGGKTMFKKLKNKNKTETNHNNDLDIHNIPEHVAIIMDGNGRWAKKRKMPRIKGHYEGMQTIKKITREASDIGIKYLTLYAFSTENWSRPESEVNYIMNLPVNFLKTFLPELIEKNVKIETIGFYEGLPQSTIDAIDFAKAKTQHNTGLTLVFAINYGGRAEIIQSMKAIYNELQLNGQGSEVIDEALIKRHLMTHSYPDPDLLIRTSGEQRISNFLIWQASYSEFIFNEKLWPDFDEKELRECLKIYQSRQRRFGGLSEE

SEQ ID NO: 4373 - protein, 288 aa, Staphylococcus epidermidis
LMAIQWYPGHMAKAKRQVSEQLKKVDVVFELVDARIPYSSRNPMIDDVIKQKPRVVILNKKDMTNLKELEKWEIYFKNEGFYPVAVDAKHGKNLKNVEVEAIKATQEKFDREKAKGLKPRAIRAMIVGIPNVGKSTLINKLAKRSIAETGNKPGVTKQQQWIKVGKSLQLLDTPGILWPKFEDEEVGKKLSLTGAIKDSIVHLDEVAIYGLNFMIKHDVSALKRHYNIDTHEDAEILDWFDAIGRRKGLLQKGNEVDYESVIELIINDMRNAKIGTYCFDILKEMKSE

SEQ ID NO: 4374 - protein, 452 aa, Staphylococcus epidermidis
NWRIYTMPKRSFTKDDIRKFAEEENVRYLRLQFTDILGTIKNVEVPVSQLEKVLDNEMMFDGSSIEGFVRIEESDMYLHPDLDTWVIFPWTAGQGKVARLICDVFKTDGTPFEGDPRANLKRVLRRMEDMGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPEGDLQLTDTAYQFTAGVLKNARGFTAVCNPIVNSYKRLVPGYEAPCYIAWSGKNRSPLVRVPTSRGLSTRIEVRSVDPAANPYMALAAILEAGLDGIENKLEVPEPVNQNIYEMNREEREAVGIQDLPSTLYTALKAMRENKSIKNALGNHIYNQFINSKSIEWDYYRTQVSEWEREQYIKQY

SEQ ID NO: 4375 - protein, 50 aa, Staphylococcus epidermidis
SIYFNVPCITSARLCGGISVAYPEEIPVDPLINKLGNLAGNTIGSKVVSS

SEQ ID NO: 4376 - protein, 489 aa, Staphylococcus epidermidis
EGFVLQDFDNLIPGWFKTFVQVGNDLIWSQYLIGLLLTAGFFFTISSKFIQLRMLPEMFRALTEKPETLSSGEKGISPFQAFAISAGSRVGTGNIAGVATAIVLGGPGAVFWMWIIAFIGAASAFMEATLAQVYKVHDKEGGFRGGPAYYITKGLNQKWLGIVFAVLITVTFAFVFNTVQANTIAESLNTQYNISPVITGIVLAVITGIIIFGGVRSIATLSSLIVPIMAIVYIGMVLIILLLNIDQIVPMIGTIIKSAFGVQQVTGGAVGAAILQGIKRGLFSNEAGMGSAPNAAATSAVPHPVKQGLIQSLGVFFDTMLVCTATAIMILLYSGLQFGDSAPQGVAVTQSALNEHLGSAGGIFLTVAVTLFAFSSVVGNYYYGQSNIEFLSNNKMILFIFRCFVVLLVFVGAVAKTETVWSTADLFMGLMAIVNIISIIGLSNIAFAVMKDYQRQRKEGKRPVFKPENLEINLFGIETWGQHAKMPKK

SEQ ID NO: 4377 - protein, 676 aa, Staphylococcus epidermidis
RTYVCRRAKSLAMNKQNNYSDDSIQVLEGLEAVRKRPGMYIGSTDKRGLHHLVYEVVDNSVDEVLNGYGDAITVTINQDGSISIEDNGRGMPTGIHASGKPTAEVIFTVLHAGGKFGQGGYKTSGGLHGVGASVVNALSEWLEVEIHRDGNIYTQNFKNGGIPATGLVKTGKTKKTGTKVTFKPDSEIFKSTTTFNFDILSERLQESAFLLKDLKITLTDLRSGKEREEIYHYEEGIKEFVSYVNEGKEVLHDVTTFAGHSNGIEVDVAFQYNDQYSESILSFVNNVRTKDGGTHEVGFKTAMTRVFNEYARRINELKDKDKNLDGNDIREGLTAIISVRIPEELLQFEGQTKSKLGTSEARSAVDSVVSEKLPYYLEEKGQLSKSLVKKAIKAQQAREAARKAREDARSGKKNKRKDTLLSGKLTPAQSKNTDKNELYLVEGDSAGGSAKLGRDRKFQAILPLRGKVINTEKARLEDIFKNEEINTIIHTIGAGVGTDFKIEDSNYNRIIIMTDADTDGAHIQVLLLTFFFKYMKPLVQAGRVFIALPPLYKLEKGKGKNKKVEYAWTDEELENLQKQLGKGFILQRYKGLGEMNPEQLWETTMNPETRTLIRVQVEDEVRSSKRVTTLMGDKVAPRREWIEKHVEFGMQEDQSILDNKEVQILENEKYIEEETN

SEQ ID NO: 4378 - protein, 344 aa, Staphylococcus epidermidis
FIFFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDRIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 4379 - protein, 494 aa, Staphylococcus epidermidis
EYLVMNFGFLGTILTILLVVGFITNVVLAFVIIFLERDRRTASSTWAWLFVLFVLPVIGFILYLFLGRTVSKKKMEKNNGDELHAFEDLVQDQIDSFDKHNYGYINDQVIKHRDLIRMLLMKQDAFLTENNKIDLFTDGHKLYEKVLEDIYNAQDYIHLEYYTFELDGLGKRILDALETKLKEGLEVKLLYDDVGSKKVRLSKFKHFRALGGEVEAFFPSKVPLINFRMNNRNHRKIIIIDGQIGYVGGFNVGDDYLGLGKLGYWRDTHTRVQGECIDALQLRFILDWNSQSHRPQFKFDQKYFPKKNGDKGNAAIQIASSGPAFDLHQIEYGYTKMIMSAKKSIYLQSPYFIPDQSYINALKMAANSGVEVNLMIPCKPDHPFVYWATFSNAADLLDSGVNIYTYQNGFIHSKILMIDDEISSIGSANMDFRSFELNFEVNAFIYDEDIAKQLRQAFEKDIEQSKLLTKEVYDKRPLSIKFKEGLAKLISPIL

SEQ ID NO: 4380 - protein, 145 aa, Staphylococcus epidermidis
IELVKLRDDVGELPAAKETIIVSPIALDIPNTIEATTPEVAAGNTTFVATSNLVAPNPNAPSRILSGTDDIASSLILVIIGTIIIPTTIPGLIELNSPKLGIRFLNIGVTNVKAKKPNTIVGIPAKISNIGLMILRERSDAYSLR

SEQ ID NO: 4381 - protein, 115 aa, Staphylococcus epidermidis
CLIVLNLVLIKVVIILAMTNREKFKVLADQIKISNQLEQDILEQGELTRIDVSNKNRTWTFQISLPHFLSHEDYLLFTHAIEEEFKEIATVAIDFSIKDTNNQDEFRFKIFRTLY

SEQ ID NO: 4382 - protein, 357 aa, Staphylococcus epidermidis
LSVVGGLVLDNERQKALDTVIKNMEKSFGKGAVMKLGDNKGRRVSSTSSGSVTVDNALGVGGYPKGRIIEIYGPESSGKTTVALHAIAEVQKNGGVAAFIDAEHALDPVYAQALGVDIDNLYLSQPDHGEQGLEIAEAFVRSGAVDIVVVDSVAALTPKAEIEGEMGDTHVGLQARLMSQALRKLSGAISKSNTTAIFINQIREKVGVMFGNPETTPGGRALKFYSSVRLEVRRAEQLKQGQDIVGNRTKIKVVKNKVAPPFRVAEVDIMYGQGISKEGELIDLGVENDIVDKSGAWYSYNGDRMGQGKENVKNYLKENPQIKEEIDRKLREKLGIFDGDVDENENEDDSPKTLFDE

SEQ ID NO: 4383 - protein, 48 aa, Staphylococcus epidermidis
KNGFFFHLFLFHFSLNSPRLKNTSIYFLIYCKNKLKNTIFILPQITIL

SEQ ID NO: 4384 - protein, 535 aa, Staphylococcus epidermidis
MLQVTDVSLRFGDRKLFEDVNIKFTEGNCYGLIGANGAGKSTFLKILSGEIDSQTGHVSLGKDERLAVLKQDHFAYEDERVLDVVIKGHERLYQVMKEKDEIYMKPDFSDEDGIRAAELEGEFAEMNGWNAEADAANLLSGLGIEPDLHDKNMSELENNQKVKVLLAQSLFGDPDVLLLDEPTNGLDIPAISWLEDFLINFENTVIVVSHDRHFLNNVCTHIADLDFGKIKLYVGNYDFWYQSSQLAQKMAQEQNKKKEEKMKELQDFIARFSANASKSKQATSRKKQLEKIELDDIQPSSRRYPYVKFTPEREIGNDLLTVENLSKTIDGEKVLDNVSFTMNPNDKAILVGDSEIAKTTLLKILAGEMEPDEGTFKWGVTTSLSYFPKDNSEFFDGVDMNLVEWLRQYAPEDEQTETFLRGFLGRMLFSGEEVKKKASVLSGGEKVRCMLSKMMLSSANVLLLDEPTNHLDLESITAVNDGLKSFKGSIIFTSYDFEFINTIANRVIDLNQAGALSKEVPYEEYLQEIGVLQNN

SEQ ID NO: 4385 - protein, 261 aa, Staphylococcus epidermidis
KMKVRTLTAIIALLIFLPILLKGGLILMLFAFLLALIALKELLNMNMIKFLSIPGLISALALIIIMLPQDAGEWVQVIQLKGLIAMSFIVLSYTVLSKNRFSFMDAAFCLMSVAYVGIGFMYFYETRSEGLRYILFAFLIVWLTDTGAYIFGRLMGKHKLWPVISPNKTIEGFFGGILCSILVPLVMQMFVDLHMNIWLLLLVTIVLSMFGQLGDLVESGFKRHFGVKDSGRILPGHGGILDRFDSFMFVLPLLNILLIQT

SEQ ID NO: 4386 - protein, 247 aa, Staphylococcus epidermidis
IKGVIQLMVQHLSAQEIIQYISDAKKSTPLKVYVNGHFENVTFPESFKVFGSEHSKVIFCEADEWKQFYQQNHSLITELEIEMDRRNSAIPLKDLTNTNARIEPGAFIREQAIIEDGAVVMMGATINIGAIVGEGTMIDMNATLGGRATTGKNVHVGAGAVLAGVIEPPSASPVVIEDNVLIGANAVILEGVRVGAGAIVAAGAIVTQDVPAGAVVAGTPAKVIKQTSEVQDSKREIVSALRKLNNE

SEQ ID NO: 4387 - protein, 85 aa, Staphylococcus epidermidis
IKGVLTMIANENIQDQALENFKSEKTEVTIFFLNGFQMKGVVENYDKYVVSLNSQGKQHLIYKHAISTFTVDNESSEATEVNSEE

SEQ ID NO: 4388 - protein, 183 aa, Staphylococcus epidermidis
CRGVLIMKENILPAIRNMRDLEKLIKTDYKACVVLDMHIGHLKSIMELLKSHSIECYVHIDLIKGLSHDEFACEYIIQQYKPKGIVSTKAKVIKKAKMLNTLTIFRVFIIDSQALTRSIELIKKVEPDYVEVLPGVASKAVSKIQQETSASVIAGGLIDEQSEIREAISNGAKYVTTSYEKLW

SEQ ID NO: 4389 - protein, 728 aa, Staphylococcus epidermidis
MNMVRSDYMSKKRIYEYAKELNLKSKEIIDELKSMNVEVSNHMQALEEEQIKALDKKFKASQAKDTNKQNTQNNHQKSNNKQNSNDKEKQQSKNNSKPTKKKEQNNKGKQQNKNNKTNKNQKNNKNKKNNKNNKPQNEVAETKEMPSKITYQEGITVGELAEKLNVESAGIIKKLFLLGIMANINQSLDEETLELIADDYGVEIEKEVVVDEEDLSIYFDDETDDSDAIERPAVVTIMGHVDHGKTTLLDSIRNTKVTEGEAGGITQHIGAYQIENSGKKITFLDTPGHAAFTTMRARGAQVTDITILVVAADDGVMPQTIEAINHAKEAEVPTIVAVNKIDKPTANPDRVMQELTEYGLIPEDWGGDTIFVPLSALSGDGIDDLLEMIGLVAEVQELKANPNKQAVGTVIEAELDKSRGPAASLLVQNGTLNVGDAIVVGNTYGRIRAMVNDLGKRIKSAGPSTPVEITGINDVPLAGDRFVVFGDEKQARRIGEARHEASVIQQRQESKNVSLDNLFEQMKQGEMKDLNVIIKGDVQGSVEALAASLMKIDVEGVNVRIIHTAVGAINESDVTLANASNGIIIGFNVRPDAGAKRAAEAENVDMRLHRVIYNVIEEIESAMKGLLDPEFEEQVIGQAEVRQTFKVSKVGTIAGSYVTEGKITRNAGVRVIRDGIVLFEGELDTLKRFKDDAKEVAQGYECGITIEKYNDLKEGDIIEAFEMVEIQR

SEQ ID NO: 4390 - protein, 266 aa, Staphylococcus epidermidis
LFQVVEIKIWKQLNNTKKTVVNKMSKLFIPYIMGDLNFIHHLKTLTENGADIVEIGVPFSDPVADGPIIMKAGRNAIDEGSNIKFIFDELIKNKNTISSKYVLMTYYNILSAYGEELFLDKCDEAGVYGLIIPDLPYELTKKFKKDFYHHSVKIISLIAMTASDARIMQIAKNSEGFIYTVTMNATTGNSGEFHPDLKRKIEYIKKVSKIPVVAGFGIKNPEHVKDIASVADGIVIGSEIVKRIEIDSRKEFITYIKSIRTTLNSL

SEQ ID NO: 4391 - protein, 226 aa, Staphylococcus epidermidis
FEEVYIFMSKKVLFVLTSTSQFTDGTETGLWLEEAGAPYNILTEEGINVDVISIKGGKVNLDPNSVSNESLNQYAKFVSHLNDTPSIENVNADEYDAIYLPGGHGTVYDFANNEKLADILLQFKNSNKIISSVCHGPSAFVGVKDANNHYLVDGVKITSFTDSEEKAMGFENKVPFLTQSKLEEQGANFVVKDDFTSHVEKDGQFITGQNPQSSEDIGKALANELK

SEQ ID NO: 4392 - protein, 126 aa, Staphylococcus epidermidis
INLFFSILTLLELRIDVYLANLLIILVPSITSAILIIFTSKMKLYLWLNVISNLIFYIIYSKYIMHLDGYLSYIERAQINNSDIEIKISPNMLELSQIIFLFFVYLIPQMIVVFIKHKRGEINARI

SEQ ID NO: 4393 - protein, 51 aa, Staphylococcus epidermidis
ITVFIAFYILGNLSDTKKLNISVLLINLIIRLPIRHTHLRYQLITQVFFYV

SEQ ID NO: 4394 - protein, 81 aa, Staphylococcus epidermidis
LLVFLYTLYLRYWFHTYLCYLNEDTIATMEMMLVSTLSLKKKKELNNNIYNFRLEQQNNNVPVFFIFKSHTFAIMICLVII

SEQ ID NO: 4395 - protein, 558 aa, Staphylococcus epidermidis
IMSLSTLKRDHIKKNLRDTEYDVVIVGGGITGAGIALDASNRGMKVALVEMQDFAQGTSSRSTKLVHGGLRYLKQLQVGVVAETGKERAIVYENGPHVTTPEWMLLPMHKGGTFGKFSTSIGLAMYDRLAGVKKSERKKMLSKQETLNKEPLVKRDGLKGGGYYVEYRTDDARLTIEVMKKAAENGAEIINYTKSEHFTYDSNKKVNGIEVLDMIDGETYAIKAKKVINASGPWVDEVRSGDYARNNKQLRLTKGVHVVIDQSKFPLGQAVYFDTEKDGRMIFAIPREGKAYVGTTDTFYDNEKATPLTTQEDRDYLINAINYMFPTVNVKDEDIESTWAGIRPLILEKGKDPSEISRKDEVWEGESGLLTIAGGKLTGYRHMALEIVDLLAKRLKQEYGLKFESCATKNLKISGGDVGGSKNFEHFVEQKVDAAKGFGIDEDVARRLASKYGSNVDQLFNIAQTAPYHDSKLPLEIYVELVYSIQQEMVYKPTDFLVRRSGKLYFNIQDVLDYKNAVIDVMADMLNYSETQKEAYTEEVEVAIDEARTGNDQPATKA

SEQ ID NO: 4396 - protein, 288 aa, Staphylococcus epidermidis
LATFKDFRNNVKPNWCPGCGDFSVQAAIQKATANIGLEPEDVAIITGIGCSGRLSGYINSYGVHSIHGRALPLAQGVKMANKDLTVIASGGDGDGYAIGMGHTIHALRRNMNMTYIVMDNQIYGLTKGQTSPSSAKGFVTKSTPKGNIEKNVAPLELALSSGATFVAQGFSSDIKALTKMIEDAIHHDGFSFVNVFSPCVTYNKVNTYDWFKEHLTSIDDIEGYDITDKQLAMKTVLDHESLVKGIVYQDTTTPSYESQISELEHEALAKRDIHITEETFNDLTAQFL

SEQ ID NO: 4397 - protein, 42 aa, Staphylococcus epidermidis
QNTFISLNSHIKIKKLLAKHLALSAAFYRTNTLSSYMIHFNF

SEQ ID NO: 4398 - protein, 40 aa, Staphylococcus epidermidis
LFTLFMYLIITLSKISFVKYFIYIFKIIWNKLCHSYIIYF

SEQ ID NO: 4399 - protein, 212 aa, Staphylococcus epidermidis
DDFSEVNMDKFKSMTELKELTKEGKDWEIECENRSSIVTILALHGGGIEPATTELAYTIAHCGDYNYFSFKGMRSKGNNELHVTSTHYDDQIALDLVRGSQRTVAIHGCEGNESVAYIGGSDDRLIELITESLEDIGISVREAPHHISGTQENNIVNMTQTQGGVQLELTAQLRKELFKNRKSSRKNRENKDNWDDLMYDFADAMKKAIERA

SEQ ID NO: 4400 - protein, 682 aa, Staphylococcus epidermidis
LMKFSWVRWILYIVALFLPIFIFYTVARPVDRNNRNMGVYCTVVSCVEWMAAATVLYFAALIVDIHISFMTFVRIFVIAALSGLVSFIPGGFGAFDLVVLLGLKSLGISEEKILLALVLYRFAYYFVPVMIALILSSFEFGNTAKKYLDNSKYFIPVKDFTSFLRSYQKDILAKVPSFSLAILIFLTSIIFFINNLTIVYDGLYDGNHFAYYIALAVQTSACLLLILNVRGIYKGSRRAIIYAFISIILIASATIYTYASFLLLSWLIIIFVLLILAYQRAQVLKRPLRFKKLAVMLLLSIFILYLNHILISGTLYALDVYHIEIDTSLLRYYFWMTIVIIMLLVGVIAWLFDYKYKCPHHSIDLTLCDAIIQKYGGNYLSHLVYSGDKDCFFNENKDSFIMYRYKSNALVVLGDPIGNTKSFESLLEAFYQFAEYQGYEIIFYQISDQYMPLYHNFGNQFFKLGEEAIIDLTTFTTSGKKRRGFRATLNKFDDLNINFEIIEPPFTQDFFDELKFVSDKWLDGRSEMHFSVGQFTQTYLSKAPIGVMRDHSGKMIAFCSLMPTYSNNAISVDLIRWLPELDLPLMDGLYLHMLLWSKEKGYKAFNMGMATLSNVGQLHYSYLRERMAGRVFEHFNGLYRFQGLRRYKEKYSPNWEPRFLVYQKHYSLWESMLKVMRVIRHK

SEQ ID NO: 4401 - protein, 67 aa, Staphylococcus epidermidis
SYISLCRLVSSLINRHSLLLFEIIISLITFSNTHLFVMLLTQNLCSDKLLIQTNVLGVILDDFKIQI

SEQ ID NO: 4402 - protein, 208 aa, Staphylococcus epidermidis
MAISAKLVKELREKTGAGMMDCKKALTETDGDIDKAIDYLREKGIAKAAKKADRIAAEGLVHVEVKDNEAAIVEINSETDFVARNEGFQELVKEIANHILHSKVETVDALMESKLSSGKTVDERMKEAISTIGEKLSIRRFSIRTKTDNDAFGAYLHMGGRIGVLTVMEGTTDEEAAKDVAMHIAAINPKYVSSEQVSEEESIMKEKY

SEQ ID NO: 4403 - protein, 290 aa, Staphylococcus epidermidis
TKISCASLLTRGDQEMTFAKRKEWYLEYEITVNRAGLLGDISSLLGMLGISIVTINGVDQGKRGLLIKTDQLEKVERFEQIVKEINEIEITKLRVPELRDRLAVRHGRYIEQDADDKKTFKFEREDLGLLVDFLAELFKEEGHKLIGIRGMPRVGKTESIVAGSVCAHKRWLFISSTLIKQTVRRSLFKGEYDSNHVYIIDGAVTARELNPEHQELVREVMTLPSIKVVEHPDLFVESCNYNMEDFDYIIELRENEDQEIRYEEMKKHTVQSKNNLDFGDPFGGGFGFFE

SEQ ID NO: 4404 - protein, 156 aa, Staphylococcus epidermidis
EDVSMKKWQLVGTTVLGASVLLGACGGNDGGSGDGKDLKGSAKGEGSSTVAPIVEKLNEKWAKDHKDAKISSGQAGTGAGFQKFIAGETDFSDASRPIKDEEKKKLEDKGIKYHEFKIAQDGVTIAVNKDNDFVKELTKSQLKDIYSGKAKTWKDR

SEQ ID NO: 4405 - protein, 44 aa, Staphylococcus epidermidis
LLPSFEYLIFQGSKIKKLNFILKFLTLPIHFNRLTKVFNIIKFT

SEQ ID NO: 4406 - protein, 248 aa, Staphylococcus epidermidis
RRELPVISTYFKIELKIIFRKKLYLVMSIFLPVVFYLLFTSILDMPEEAKLKFYKEYMYSMTVFSLMNFCLLSFPLDLIEERNQGWYKRLMVTPLSSFQYYLVKISKTMCQFLIAITIIFSVAHFYKDVHMTVFQWIFSALTLWIGVSLFLTLGLIIAQLNDIQKASSFANLLNITLAILGGLWFPVYTFPDWLQSISKHMPTYNLKLLAIDLAQNKGVNIEAFGYLVVYCIIFVSIALFMNKKGDVH

SEQ ID NO: 4407 - protein, 43 aa, Staphylococcus epidermidis
LNRSLYVILIYTLILYISTQLIRGFNNSAMHCRIILSGITYYA

SEQ ID NO: 4408 - protein, 54 aa, Staphylococcus epidermidis
LKSSFNFSIIDFILNKNISSVYLSAGWRGLNLEIMMEFIFYLTTISPFDFLLKS

SEQ ID NO: 4409 - protein, 54 aa, Staphylococcus epidermidis
YLISKKSEKSKSFLFDTFMHNIITQLHKLLLLFHLKCNSIIAILLNRNNYVFQK

SEQ ID NO: 4410 - protein, 269 aa, Staphylococcus epidermidis
FLLSVECIDLFGCSGAPDCAGVPGSTGLPGSTGLPDSAGLPGSAGVPGSAGLPGSAGVPGSAGLPGSAGVPGSAGLPGSAGVPGSAGVPGSAGLPGSAGLPGSAGLPGSAGVPGSAGLPGSAGVPGSAGLPGSAGLPGSAGLPGSAFVGPYSTISSTGCLVTFSVDLPSPTFSPVIGLTNIGVVIVFVPGSPFCLTRSSPGFKSGLNTRFLSNGISSVDVIGLPTFGPYFVTSSTGGVTTSPVSGFLTPGLPGTSVLLSTGAFGSNSSL

SEQ ID NO: 4411 - protein, 125 aa, Staphylococcus epidermidis
VMTSIVVVSHSHKIAEGVKQLINQMTDGGVDLIAVGGLSDDEIGTSFDQIVSVINGLENDALCFYDIGSAGMNLDTALEMYEGDHKIVKMEAPIVEGSFIASVGIKSNMSMDSVISEVRAKYPEE

SEQ ID NO: 4412 - protein, 538 aa, Staphylococcus epidermidis
KLGSYSTNPTITCIQYSTSSIFGDDSMKTYKPYRHQLRRSLFASTIFPVFMVMIIGLISFYAIYIWVEHRTIHQHTYQTQTELQRIDKHFHTFVTQQQKQWRHVDLSHPADITKMKRQLLKQVHQQPAILYYDLKGSSQSFTNNYEQLDTTKMYLISKYRIDFKDDTYILKIYMSSTPLLKNIKKNSGQSALIVDSYDTVLYTNDDRFSIGQKYQPPQFGFINESLKLNSHHAHLIIYKDIHETIEDGIALLVVMGVVLILLVIFGYISADRMAKRQSEDIEAIVRKIDDAKNRHLGSYEPLKKHSELEEINNYIYDLFESNEQLIQSIEQTERRLRDIQLKEIERQFQPHFLFNTMQTIQYLIPLSPKVAQTVIQQLSQMLRYSLRTASHTVKLAEELSYIEQYVAIQNIRFDDMIQLYIDATEGVQHQTIGKMMLQPLVENAIKHGRDSEPLKITIRIRLTKRKLHILVHDNGIGMSPSHLEHVRQSLHHDVFDTTHLGLNHLHNRAMIQYGTYARLHIFSRSQQGTLMCYQIPLV

SEQ ID NO: 4413 - protein, 2404 aa, Staphylococcus epidermidis
CKLFMSYYGNEYERRTLMNIEALYFQKYFYFKHLNQSSSEHRVTYWVKLSRDIELRRLMYALLDVVQSQPVLRTQFVTDDFNQLKINLRDFFPFIEIKEVNEMSQSIDLEAFFTRNLNSYHFNQLPLFNFKIYQFLDEAYLLLDFHATIFNESQLTPFLQQLNIAYTHSLKSEYSISDFYNWIKEMNQKMDQNQVVCPSKHFNVLNADGDNYAYIPVKNTCEKKKMCSLHAELPSLDIDVWIVSIYLAHHFISQSSDVTLGIHFSIDNKNTENMMVLNTDIAPLNLSISQSDVVKDMVDECSALLEELQMCGASFVVQPKAVQIDVETMIHIEKVQEQFELNHICHHIHRLYNEASSFADLEFYPHVQDGFDIVYNDNVYDDLTVHTLVKLINGIYMQITQNPSLLIKDIKLSDRSDLAKYNDINLQNNDINYSEVTYKTVVERFERQVHQHPDSIALQYEQRSMTYHQLNQCANLLAYRLRLNHQIEPNDMVALIAERSLEMIIGMLGILKAGAGYIPIDPDYPEERMNYIIEDAKPKAVVTYRTSFQSGLPQMDIELIVDSREHDIDNPRGINCSEDIAYVIYTSGTTGKPKGTLVPHRGIDRLVHNPNYVELNENTTVLLSGTVAFDAATFEIYGPLLNGGRLVITSKDTLLNPQLLDQAITENKVNTMWLTSSLFNQIASERIEALESLTYLLIGGEVLNAKWVHLLNSRECHPQIINGYGPTENTTFTTTFAIPQEMPSRIPIGLPISGTTVYVMQGDRICGVGVPGELCIGGAGLAKGYLNQPKLTAERFIQSPFNNEMLYRSGDLVRLQEDGYIDYISRIDKQVKIRGFRIELSEIEKALEAIRDINKAVVIVREQDQDKQIVAYYEASQLKSTGQLKDILSETLPEYMIPVHFMKVDRIPITMNGKLDVRALPEINLKNNRNYVEPRNDIERTVCRIFEEILHVDQVGVKDNFFELGGHSLRATLVVNRIEERLKKRLKVGDLMKSPTVEQLGQQIEELQNDVYEVIPKANESYQYDLSASQKSMYLLWKVNPKDTVYNIPFLWRLSSELNVMQLQRALSKLIERHEILRTQYVIDDNEVKQRIATHVSPDFEEVTTSLTNEQDIIQSFMEPFDLEQPSQMRVKYIHGPQQDYLFMDTHHSINDGMSNTILLSDLNALYQDKSLPELKLQYKDYSEWMVHRDLSKQRHFWLQQFENQVPILNMPTDYPRPSIKTTNGNMLTFHYNRQIKQQLKSYVEQHQVTDFMFFASAIMVLLHKYTRQDDIAIGSVISARTHRDTENMLGMFANTLVYRGRPHDQKTWDQLMAEMKEMCLGAYEHQEYPFESLVNDLVDERDASHNPLFDVMLVLQNNETNHANFGHSQLTHIPPQSTTAKFDLSFIIEEDQDDYVVNIEYNTDLYKQETIHHIAEQLQMIIKHVISTENLKIQDIDENDDLLIWLDKHVNDCSLDLPKNKSIQQLLHDVMKAKADDVALKMNGQSMTYQELDDYSNSMAQTLIQNGIQKGERVALLTERSFEMVASMIAVLKVGGSYVPIDVTYPDKRIEFIIEDAEVAAVLTYGKAISSHIPVIKIEDIDNTENNKRLNIEYAGNLEDDMYHIYTSGTTGKPKAVSVKQRNILNLVCAWTKRLNLSDDEVYLQYANYVFDASATDFYCSLLNGYPLVIATSVERTNTDLLEKLISQENITIASIPLQVYNVMHHFYIPKVITGGAPSTPAFVQHISKHCDMYVNAYGPSENTVITSCWIYEKGDAIPSTIPIGKPLANVDIFIMSGGKLCGVGIPGELCIAGESLTSGYLNRPELSAEKFINNPFGPGQLYRSGDLARLMPDGQIEFLGRIDKQVKVHGYRIELGEIENIINSVDTVTDSVVILAKQGEREVLHAYYVGSQEDENHISQHLNQYLPKYMIPKTLTAISEIPLTGNDKVDESRLPVPNVHKNKFVAPRNNIEREIAQIVSGVLDVSSMSIDDDFFEMGGTSLDAMVVVSKLKSNGIHITMQDVYQFKTVRYIANHTEKRQALPEVVLPDHLPQLQSLVERRYQLKSQHLTQSSLGHVLLTGATGFLGAYLIDEMQDDADQITCIVRGHDINQAKTNLENNLNCYFDTAHVDKLMKHIDIILADLSELDHLIIDSAIDTIIHAGARTDHFGDDETFFDVNVRSTQALIDLAKNKKAKLIYISTISVGTVFEVHQDDITFSEKDLYKGQLFTSPYTKSKFYSEIKVLEAVNEGLAAQIIRLGNLTSASTGPLNMKNLTTNRFSIVMHDLLKMPFIGESISKAKVEFSFIDVTARHIIKLARSNAIPIIYHVYAPCSITMKQVIDNAKGSEMTVVSDSEFEQKLHELGMHELIGLNSNGDNQISGVTDSNMTQTVMKELQGEWPHLSYQWLQQWYHLLFEKFDAN

SEQ ID NO: 4414 - protein, 47 aa, Staphylococcus epidermidis
GYTPTHVKNRFIYFVKTKEMKLYQTFIAIEYSRFLITIEETFTFISF

SEQ ID NO: 4415 - protein, 312 aa, Staphylococcus epidermidis
AYHPLKNGVENKFLIISMYFNLKIKRMNKMKFKKSLITALATITLVPSLMILDTQHEAKAVGNYYYNGMEDHNASAAYHKAKKVDNSQIVIKRYNYAHKNKYKAVGRVSNMDGWKGPGKDSMGTGFMVGNHTFVTNAHVVDKKNGQRTSPSKIKFQLNRDGKKIPYQFHAKKIYKIPSYDMVVVETKENMAQKANVQPLKLATNQKIKSLKFNKKLYSLGYPVMNGNNTYAYWNKLRFLQEASNKSELMTKDKFRAGDSGSPMVDSQYVVYGVRTYGYNLRGSSNHPYAQQEVAGAESLYGNPRDFILKHNK

SEQ ID NO: 4416 - protein, 71 aa, Staphylococcus epidermidis
IKVPPFILNNNIPSLRIIENRIPGASCVGTSSSHNKGMNAFDIKVKIGVRDNRLTIRQIPIKIGKACTINI

SEQ ID NO: 4417 - protein, 207 aa, Staphylococcus epidermidis
LKKFLKGFILFFLIVMLGFAGGLGYSHYKDSKANTDVSSKETQTSNKNTHEDTISQDEMQNQVDSQTNEVSNETSTKTLSEKAKRLREAFNVNDEEAQILADEIDRADVNKDGTITMDEMTPTLDRFAKEGKFQPSAGGTTNEAHHPKYTAEDARNMSDDEFLDAYTEGMSDDEAATIHESAQESNEYMKFLRGQVEARAKGQGGNY

SEQ ID NO: 4418 - protein, 320 aa, Staphylococcus epidermidis
MKKLIQDKNTILKDMLDGITVSNNDVEVVSDTIVVRKHKKQSGVALVSGGGSGHEPAHAGFVAEGMLDAAVCGEIFTSPTPDKILDAIKAVDNGDGVLLVIKNYAGDVMNFEMAQEMAQMEDIKVESVIVRDDIAISDPEKRRGVAGTVFVHKYAGYLAEKGVALDEIKSKVEALLPDIKSIGMALTPPMVPTTGKNGFDIEDNQMEIGIGIHGEKGLHREDVQPINVIVERLLDQLYKEIEKKPLIVMVNGMGGTPLSELNIVTKYLDEQFNQNDIDVKQWFVGDYMTALDMQGFSITVLPFSEELSEALAAPTASKYF

SEQ ID NO: 4419 - protein, 280 aa, Staphylococcus epidermidis
WEKLFQRRTVALLLPWCIVRRFRLIMSNYQQKNNAVNTVVNVNQLSILDQEKVLLKDVDLTVTKGAFHCIIGESGSGKSLLTRTILGMKQSQLCYQGDIDIDLTQTDAVFQDVQSNMFQNITLAKHFQYIYEANRTHLTKQRIKEDVLQMMQLLGLRQGEQLLERYPFELSGGMAQRVAFIMSLIRRPNYLFLDEPTSALDQENIKKFMHYLLRAQERYQMTIVFITHDINLVKDCATHISIMQQGKLIENGEAASILTKPTHNYTKKLITIAHRRQPYA

SEQ ID NO: 4420 - protein, 76 aa, Staphylococcus epidermidis
APITIPITVFVAPKSCPLRGMKTLSMAFALKNINVKIYNLKKGQDMAPFILSLLRLIVVYQSVLLYNHFVAYAIHL

SEQ ID NO: 4421 - protein, 327 aa, Staphylococcus epidermidis
KKELKIMTLNLAQRVLNREPLTKEEALTIFESSELDTFDLLNEAYTVRKHYYGKKVKLNMILNAKSGICAEDCGYCGQSVKMKEKQRYALVEQDQIKEGAQVATENQIGTYCIVMSGRGPSNREVDHICETVEDIKKIHPQLKICACLGLTKEEQAKKLKAAGVDRYNHNLNTSERYHDEVVTTHTYEDRVNTVEMMKDNNISPCSGVICGMGESNEDIIDMAFALRAIDADSIPINFLHPIKGTKFGGLDLLSPMKCLRIIAMFRLINPTKEIRIAGGREVNLRSLQPLALKAANSIFVGDYLITGGQPNEEDYRMIEDLGFEIDS

SEQ ID NO: 4422 - protein, 142 aa, Staphylococcus epidermidis
MEITSVNHICFSVSDLNTSIQFYKDILHGDLLVSGRTTAYLTIGHTWIALNQEKNIPRNEISHSYTHIAFSIDEEDFQQWIQWLKENQVNILKGRPRDIKDKKSIYFTDPDGHKIELHTGTLKDRMEYYKCENTHMQFYDEF

SEQ ID NO: 4423 - protein, 45 aa, Staphylococcus epidermidis
KKVTLHTRYIKYMYLTFKIKYMGGIIWANVDKVLLIKKWIFYLTN

SEQ ID NO: 4424 - protein, 273 aa, Staphylococcus epidermidis
KHVTLLKVAHLGIKDTWSDETLVDNVNFTVQCGETLGIIGESGSGKSITCKALIGLNAQRLSVSGDIFFEHQNLNTITEKQLRKIRGKDIAMIMQQGTRAFDPSTKVGKQMIETLRAHTTLSKQQIKQELIHYMTYMKLKDPQSLLKAYPYMLSGGMLQRMMIALALALKPKLIIADEPTTALDTITQYEVINAFKDIKHHFDCAMIFISHDLTVINKIADRVVVMREGRVIEEGRTNMVLQQPRHHYTAYLLSTKKTIYDYFQFVLRGDFNA

SEQ ID NO: 4425 - protein, 309 aa, Staphylococcus epidermidis
FHYLKERNEMKRHFLAIGAITITTLLAGCDFGDLVGQHQSDKQSENSNTQTEQASNNKNSNSDNDHSNNNDESRDRVEDLTQSQKVALAINDPSVSQYVVNASELRNHSFYANYNGGGQRKSIHTYKLESLPKKVEGAPNDMTFYTAKPSKGSFVTLIGIGNEKVLIAGTQSSGTYQQYAHSEAARELDLHELLDKYGKSSNYKNLANQITFTQGQLSNASEYTSDEGTSNNDASNDDKVTRDNVIDKVEAYEGHQLDTDTYTFKEPEQNEDGDWGFSILDKEGNLEGSYIVTSDGEVTKYDENGEEIE

SEQ ID NO: 4426 - protein, 65 aa, Staphylococcus epidermidis
LLYFKIIIVFKYIILVISILIVSEIKFNSTTTQKREGEFVLSFLGFLKVNKKVLSNGMELLNIFS

SEQ ID NO: 4427 - protein, 327 aa, Staphylococcus epidermidis
VLYLEMTYCSLSIKIYTLKILIVLTIGGHVVIMSQFKDTLYKLFEPMMKIEFYQNLLVNLLIILAYILMGMIVIAISRKLVTKFFNVNEKKKNRHKIKRSETLSTLIQNLISYVVWFIVLTSILSRFGISVSAILAGAGVVGVAVGFGAQTIVKDIITGFFIIFEGQFDVSDYVQINASGVTIAEGTVKTIGLRSTRIQSDTGEIYTLPNGMISEIVNYSATDVSPIVMIPISPNENYKVIEEKLLTFLPTLKNKYDIFVSAPDLLGLDSVDGNEMVIKLLAHVKPGMHFPGQRLLRKEVIQYFSEEGIHIPKPTLVKLDKELNKKE

SEQ ID NO: 4428 - protein, 50 aa, Staphylococcus epidermidis
LDSAACTEPPPINNIDATMIEDAPTLNFRMLYEFFLFFMFKAPLSFLYHL

SEQ ID NO: 4429 - protein, 208 aa, Staphylococcus epidermidis
IMYLYVTKMTETLEEVELLLNRSSRQLKKPERIHYRFLKDRLMHQLGDALIQYAIEQCAGLTPKEWEYHITTMGKVEIRSSCHIYVSISYSYPYIICIIDNQPIGIDIEEMKDLDYKHLAKNFTKNEFNQVTTLKDFYEIWTKKESYTKLIGEGLMNGLDCYDVTQNLRFLKKHVQFTSVDYFKRLIQICHMSKHSLNFEVVPLTQLL

SEQ ID NO: 4430 - protein, 292 aa, Staphylococcus epidermidis
QFNLKIYIKKECFMQRQVVEFSKYNPSGNMTILVHSKHQPSEYAAIAHQLMATTHMCCEQVGFIESVNYENGDNYHLVMSGNEFCGNATMSYIHYLKERLLIQHQQFQLRVSGCSHPVECKVHSQHYEVTMPKVHQVKERFVKLGEQQFKAFEISYDTYIHYVMMCDDVDLAIKQCVEDFVSAQTWHRQFKTIGVMLFQQDKQFIYPLIHIPAIDSLIWENSCGSGAASIGVLVNYLTDHDIQDYLVNQPGGSIIVSSRKSGQNEYQTTIKGQVSTVATGQAYIEQETMTQI

SEQ ID NO: 4431 - protein, 503 aa, Staphylococcus epidermidis
YINLERNMHMSEANHKNIVVVGAGIIGTSVATMLSKVSPNWHIDMFERLEGAGIESSNENNNAGTGHAALCELNYTVEQDDGSIDASKAQEINEQFELSRQFWGNLVKNGDISNPEEFIQPLPHISFVMGPTNVNFLRKRYETLRTLPMFDTIEYTEDMETMRKWMPLMMENREPGHQMAASKIDEGTDVNYGALTRKLAHYLEQKSNVSLKYNHDVVDLTQREDGKWEVVVENRETKEKVTKIADKVFIGAGGHSIPLLQKSGVKQREHLGGFPISGQFLRCTNPDIIKQHAAKVYSKEPQGKPPMTVPHLDTRYINGKQTLLFGPYANIGPKFLKFGSNLDLFESIKPYNITTMLASAVKNVPLIKYSIDQMIKTKEGCMNYLRTFIPDAKDEDWELYTAGKRVQVIKDSEQHGKGFVVFGTEVVNSDDNSMIALLGESPGASTSLSVVLEVLEKNFADDKEAWEPVVKEMVPTYGRSLINDEKLMRETRRETSKNLHLNR

SEQ ID NO: 4432 - protein, 41 aa, Staphylococcus epidermidis
LTYYDVHSRSWPKIYLYGVFFMIEYDKFYFKIKVFQEYING

SEQ ID NO: 4433 - protein, 415 aa, Staphylococcus epidermidis
NKCYIQFERVAKNFSKGVLFMKKKLSYMITIMLAFTLSLALGLFFNSAHADSLPQKNGANQKTTKVTVSNKDVPDAVRKLAEEQYLSRVALLDKASNHKATSYTLGEPFKIYKFNKESDGNYYYPVLNKKGDVIYVVTISPNPSNSKASKQQNNYSINVSPFLSKILNQYKNQKITILTNTKGYFALTEDGKVTLVLKTPRNNEKTYENATESTKPKDLNDFKQTASVTKPTLEYQSTRNEMYAEYVNQLKNFRIRETQGYNSWCAGYTMSALLNATYNTNRYNAESVMRYLHPNLRGHDFQFTGLTSNEMLRFGRSQGRNTQYLNRMTSYNEVDQLTTNNQGIAVLGKRVESSDGIHAGHAMAVAGNAKVNNGQKVILIWNPWDNGLMTQDAHSNIIPVSNGDHYEWYASIYGY

SEQ ID NO: 4434 - protein, 298 aa, Staphylococcus epidermidis
EKRYRIGYFKKVQGIGKEVVPTVVIDLVDQLKVKYSIKLILEVLNIPKSTYYRWKNKTYKNDTVTQKVIELCKANHYTYGYRKITALINQCYTSPINHKRVQRMMQKHHLNCRVRPKKTTRIGKPYYKTDNLLQRQFKASCPIEVLTTDITYLPFGHSMLYLSSIMDIYNGEIVAYKIDDKQDQSLVNDTLNQIDIPEGCILHSDQGSVYTSYAYYQLCEEKGIIRSMSRKGTPADNAPIESFHPSLKSETFYINNELNRSNHIVIDIVEKYIKNYNNNRIQQKLGYLSPVKYRELIA

SEQ ID NO: 4435 - protein, 79 aa, Staphylococcus epidermidis
NTLYCTSKRIYITNNGGHHDFNYFIYLFLYSTHQLKDIYATRKTAKGRGRGGIWCEKFKISSHYACINLHECSYRNIHS

SEQ ID NO: 4436 - protein, 261 aa, Staphylococcus epidermidis
EKRYDVMKKYQTYIAIGSLLSLMVVLITYGLMQDTQHLNPLESPNGQHWLGTDQLGRDFLVRLIVGSLVTLSLTGIVILLSVCMGLIFGLIAGIERRWLDQIIMFVADMLLAIPSFIIALVILSLVSNSMIGLILALTIGWIGRYLRYFRNLTRDIQKRPFVQYARLSGNSTFKTTVTHVIPHLLSSIFALVTADFGKMMLSISGLAFLGLGIKPPTPELGTILFDGKSYFNGAPWLFFFPGVLLGGFALLCQIINKKITQ

SEQ ID NO: 4437 - protein, 493 aa, Staphylococcus epidermidis
MMDFWSSKRGKMLEITVLVFITIFGVGSQFFSNLAYSLNQGILQTSFGIGSQYLIIPSVLANFTFALGIPLGHTLTHKYGFKRNYLCFVFIFLIGSILGLLSFNLIILSIAKMIQSFSSGVLFFTLLPKLFLNFPKQYRNVFLLMVIVGLFGSNALGGLSGSLSLELDRWHWIFVVNIISAILCLILGNVILRKNEYHQTSDIHISRSMMITLVLSTISLMIPMSLLTQKGYHSLWVWPILLIAIFFIVNFIITNRQATHPIVHFHTLFSKKPFVGATMAISSHLTLLTGIAGINVYIVRILKLPFDISLHFYFFFFVGVIITGILKMFFYSSVGAGFLGTLGSSALLYVSIHWIILGNTINIPLLYIQGLLLGFGASMTLVSGSMATLLDGDLKEAAQRSQTMHTIRNFSAAMLIPIIAYTIKNHIQKGTQSIYAENITDKMIYLKKLQDVAIDADHQIFLLMIIFNMVMFVSSIIQMILGKGRRITPPRES

SEQ ID NO: 4438 - protein, 41 aa, Staphylococcus epidermidis
NPPHLRYASAYQLMMRFLFLVFIFNTQMILYTSVPTEIYFF

SEQ ID NO: 4439 - protein, 43 aa, Staphylococcus epidermidis
RPIHPIVKASIKPIMELLTKLKMTNAIINDGIASNISATNMMI

SEQ ID NO: 4440 - protein, 477 aa, Staphylococcus epidermidis
KEYHSMSNISMTTSKRNAIVTVMLISAFVSMLNQTILNTALPAIIKGLNITETTAQWLITGFMLVNGIMIPLTAFLMDKYSTRHLYIFSMAIFLIGSIVAAFSPTFTILMISRIIQAIGAGILLPLMQFTVFTLFPAEQRGFAMGLAGVVVQSAPAIGPTLTGLFVDLFSWRMPFYLVSAIAAVAFILGFFFVENNTKTKDIVLDKISVVYSTFGFGLILFAFSSVSTFGITSLPVIVTFVLGIAIIIIFTTRQLKLKHPLLNMRVFKNKVFTLSAVSSMLVYITMVSPALLIPIYIQTGLGQSALLSGVVVLPGAVINGLTMVYTGKIFDKHGIKVLVIPGFILLISMTFLYSFLTTGTPYWFVILVYTIRMIALGLLVMPLNTVGLNALESDDVSHGTAIMNSLRIIAGAMGTAVSVTILSIVAKQYTASHSTMSKMKLTQEATVHGIDVAFIFTTVLIIIGFILALFIKEEKNH

SEQ ID NO: 4441 - protein, 47 aa, Staphylococcus epidermidis
DKVHFINCTLTKLMLCIQNVTHVLYIQLHFFSYQNTVQQILQIKHIQ

SEQ ID NO: 4442 - protein, 50 aa, Staphylococcus epidermidis
IEKHIHIIDIINVRLGVLTHKFYRHFNLELISHMGIIFKINSTLSHFPRS

SEQ ID NO: 4443 - protein, 49 aa, Staphylococcus epidermidis
GIRQHIFLIPYPSITEFNYLLILISLVNNYRPVLLHVLQLVLLKISYTR

SEQ ID NO: 4444 - protein, 464 aa, Staphylococcus epidermidis
CELHMLKVTFNLRDGTFTDIPDDAHYFLIEDYDKLTPSQQTLLKRYIIKHQLDISLQHAILSSPLHSLNMIKKLETFVKESKAYHPQFHNIICGWCFIVLMFALPIYLSYHVSDGLQYYVSHWLTKLSQISLFQENKLQHILFGHYGVISLGTYSFVWALPVVFMISLSTALIDITHLKHYIVWSIEPTMMRLGLHGSDIIPLLEGFGCNAAAITQATHQCHRCTKVQCMSLVSFGTACSYQIGATLSIFNASHRSWLFLPYIGMVFLGGIIHNKLWYSHQTPKTTPSVFQRQLVRWPKPNLLLKAAWKSIQMFIVQALPIFIGICLIVSLLSLTPILTFISNAFIPLLWLLDVPTQLAPGILFSMIRKDGMLLFNMNGGTLIQRLSAFQLLLLVFFSSTFTACSVTMTMLMRRLGSILGIKMIMKQMVSSTICVTILVIAMLSITKISDLGVMLWKSLLSVVF

SEQ ID NO: 4445 - protein, 220 aa, Staphylococcus epidermidis
LRLHIGDNLMLKIERLTKYIDTQLIFKEISCTINDQHLLISGESGCGKSTLAKIIAGLDTDYQGELYLNGRLRESYTSKEWMKHIQYVPQYQRDTLNQRKTVLATLLEPLKNYKVNKQRYTSSIEAVLDQCNLPHDILNHKVSTLSGGQFQRVWIAKALILEPEILILDEATTNLDVINEEAILQMLISLKMTQLIIISHDTYVLSQFEGIQLQLNKLNN

SEQ ID NO: 4446 - protein, 127 aa, Staphylococcus epidermidis
TMKHHRCLLHCKQKKEAMQKHLNLSQRRQKKEAMQKHLNLSQRRQKKEAMQKHLNLSQRRQKKEAMQKHLNLSQRRQKKEAMQKHLNLSQRRQKKEAMQKHRMFQLSKLIQIMIHKHNFQKPLQEMT

SEQ ID NO: 4447 - protein, 281 aa, Staphylococcus epidermidis
LSFKNDTGGMKMTNRLILFDFDETYYKHRTNQADIPYLKEMESLLQNITAKNNVITAILTGSTIESVLKKMSKVNMSYKPQHIFSDLSSKMFTWNNCEYIESDEYKNEVLIEPFLLEDILDILKHVSSKHKVEFIPQRIFRENETLYNFYLYSSGDTHLDKTILEDLSQYSKTRDYTMTFNRCNPLAGDPENAYDINFTPKNAGKLYATKFLMNKYGVPKELIIGFGDSGNDEAFLSYLDHAMIMSNSQDEEMKSKFKNTKYPYYKGIYTHVREFIEYENV

SEQ ID NO: 4448 - protein, 304 aa, Staphylococcus epidermidis
CNIKSAFKGGNEMIVLRRLFQDRGAIFAIAIITIYVVLGVLAPLITFYEPNHIDTANKFAGISWSHWLGTDHLGRDVLTRIIYAIRPSLLYVFVALIISVVIGAILGFISGYFPGYIDAIIMRICDVMLAFPSYVVTLALITLFGMGVENIIIAFILTRWAWFCRVIRTSVMQYIEADHVKFAKVIGMNDLTIIRKHILPLTFTDIAIIASSSMCSMILQMSGFSFLGLGVKAPTAEWGMMLNEARKVMFTHPGMMMTTGVAIVIIVMAFNFLSDALQMAIDPRMSAKEKRLALKKGVKARDTA

SEQ ID NO: 4449 - protein, 474 aa, Staphylococcus epidermidis
KHCLIIHLKQLTKHNGDVKNYKHDRSRFLILHFIVKWHQKLVLNMSKILMVGSGPVAIQLARLCNLHGEHMVDMVSRVHASTKSKRVFDAYHRDGFFSVMTQNDAHQCFLGKFTVRHFFKDVKDITQYYDVVILACTADAYRPILQQLSKSTLKRIKQIILVSPTLGSHMLVKQILSDVHCEGEVISFSTYLGDTRIFDKAQPHCVLTTRVKSKLFVGSTHSQSITLYKLKSLFDYLNIELTTMDTPLHAEIHNSSLYVHPPLFMNQFSLKAVFEGTKVPVYVYKLFPEGPITMTLIHEMRLMWQEMMMILKKLKVPSVNLLKFMVKENYPIRDETMREVDIESFENLSAIHQEYLLYVRYTAILIDPFSNPDDQGAYFDFSAVPYKHVDTDEQGVIHIPRMPSEDYYRTLMIQAIGRALNVATPMIDTLLLRYETTVKQYCDTHLHQQLSKQFELHHFKQDLALVTNYLTFYK

SEQ ID NO: 4450 - protein, 378 aa, Staphylococcus epidermidis
YKYKRCFGGILMSKFIYQSPGRYVQGKGIVSSIAEETERLGSHALIIADEVVWNITEEKIKESFSANNNVDFEYEVFKGESSEEEIQRIVKQYKEKNIDVVIGLGGGKALDTGKAVAFELKASVIDFASTASMDAPTAAVSVIYNEDGSFSGYEFYPKNPDTVIVDSEIVAQAPVRLFASGMSDGLATLIEVESTLRRQGQNMFHGKPTLASLAIAQKCEEVIFEYGYSAYTSVEKHIVTPQVDAVIEANTLLSGLGFENGGLAGAHAIHNGFTALEGDIHHLTHGEKVAYGILVQLVLENAPTEKFMKYKTFFDNINMPTTLEGLHIENTSYEELVQVGERALTPNDTFANLSDKITADEIADAILTVNDLSKSQFN

SEQ ID NO: 4451 - protein, 55 aa, Staphylococcus epidermidis
GRDNLMEHVSKLGEAIVDTVTAAQAEDGAELAKSIVNIVANAGGIIQDIAHAFGY

SEQ ID NO: 4452 - protein, 405 aa, Staphylococcus epidermidis
TTINLRSDNMKGAMSWPFLRLYILTLMFFSANAILNVFIPLRGHDLGATNTVIGIVMGAYMLTAMLFRPWAGQIIARIGPIKVLRIILLINAMALVLYGFTGLEGYLIARIMQGVCTAFFSMSLQLGIIDALPEKYRSEGVSLYSLFSTIPNLLGPLIAVGIWHVENMSIFAIVMIFIAVTTTLFGYRTTFANTQKEVSPKDEVLPFNAMTVYVQFFKNKALFCSGMIMILSSIVFGAMSTFIPLYTVREGFANAGIFLTIQAITVVIARFYLRKYVPSDGLWHHRFMMIVLTLLMVASVIVAFGPHIVSIFVYISAIFIGITQALVYPTLTTYLSFVLPKIGRNMLLGLFIACADLGISLGGVLMGPISDTVGFKWMYILCALLVTIAMTLSKIRQRQSVSKAS

SEQ ID NO: 4453 - protein, 341 aa, Staphylococcus epidermidis
FIHKELLLMKNLRNRSFLTLLDFSRQEVEFLLTLSEDLKRAKYIGTEKPMLKNKNIALLFEKDSTRTRCAFEVAAHDQGAHVTYLGPTGSQMGKKETAKDTARVLGGMYDGIEYRGFSQRTVETLAQYSGVPVWNGLTDEDHPTQVLADFLTAKEVLKKEYADINFTYVGDGRNNVANALMQGAAIMGMNFHLVCPKELNPTEELLNRCERIATENGGNILITDDIDKGVKDSDVIYTDVWVSMGEPDEVWQERLKLLKPYQVNQALLEKTGNPNVIFEHCLPSFHNAETKIGQQIYEKYGISEMEVTDDVFESKASVVFQEAENRMHTIKAVMVATLGEF

SEQ ID NO: 4454 - protein, 42 aa, Staphylococcus epidermidis
NDSKTFYTQKNLLFQQFHNACSAGLKDVMILKYDNDLDNQLS

SEQ ID NO: 4455 - protein, 255 aa, Staphylococcus epidermidis
GGSKMLKGHLHSVESMGTVDGPGLRYILFTQGCLLRCLYCHNPDTWKINEPSREVTVDEMVNEILPYKPYFEASGGGVTVSGGEPLLQMPFLEQLFKELKANGVHTCIDTSAGCVNDTPAFNRHFDELQKHTDLILLDIKHIDNDKHIKLTGKPNTHILKFARKLSDMKQPVWIRHVLVPGISDDKEDLIKLGEFINSLDNVEKFEILPYHQLGVHKWKNLGIPYQLENVEPPDDEAVKEAYRYVNFNGKIPVTL

SEQ ID NO: 4456 - protein, 70 aa, Staphylococcus epidermidis
FVLKKQCYSIDNLIRRREYNVEHVSKLAEAIANTVSAAQAEDGAELAKSIVNIVANAGGIIQDIAHAFGY

SEQ ID NO: 4457 - protein, 45 aa, Staphylococcus epidermidis
PEINPSIAPITTEIINATNTYNKLGLMAYIIRVNTSRPKWSVPNQ

SEQ ID NO: 4458 - protein, 42 aa, Staphylococcus epidermidis
RVVKIMIMAIPSTNVTMTGREVIPNVLTLLNANKIKPKPKVE

SEQ ID NO: 4459 - protein, 56 aa, Staphylococcus epidermidis
VAQNDLEISSSSEPRGNIKLIIITYIFHIKYIVINKNNQKIIYIGIVIRLSYVNLY

SEQ ID NO: 4460 - protein, 77 aa, Staphylococcus epidermidis
IHKNTETFDDVSDIYHISLVDLSTCLFKSQLTSVIIYTTLFNNKTLFVKLNPHVVIYDVQLYLYDIKPENFSTTVMP

SEQ ID NO: 4461 - protein, 454 aa, Staphylococcus epidermidis
LMMKNKLTLKENLFIGSMLFGLFFGAGNLIFPIHLGQTAGSNVWTANLGFLITAIGLPFLGIIAIGVSKTNGVFEISSRISKIYGYLFTIGLYLVIGPFFALPRLATTSFEIAFSPFISSGTAQALLPIFSILFFGVAWLFSRKPSKILDYIGKFLNPVFLILLGIVVVLAFIRPMGGISHAPVSADYSNSVLLKGFIDGYNTLDALASLAFGIIIVTTIKKLGITNPNTIAKETLKSGTISIIAMGVIYTLLALMGTMSLGRFKVSENGGIALAQIAQHYLGDYGIIILSLIIIVACLKTAIGLITAFSETFTELFPKSNYLWLATGVSILACIFANVGLTKIIMYSTPVLMFIYPLAITLILLALLSPLFKHSKIVYRFTTLFTMVAAFVDGVKASPEFFVNTKFAQTIIGFGENYLPFFNIGMGWIVPAFIGFIIGIIVYFMTAKKSSHVQ

SEQ ID NO: 4462 - protein, 150 aa, Staphylococcus epidermidis
NKVKQSYYSHTPQSKIKSVAINKHAHQSISIGIVFVVVIFVSVIQILLHQRLKQNAPLERLYLVPYSQLKLYLTYISVHVVILMLMLLMISLLMHQPLSILFYLKTLIIVLFYEAGIALLLFKINVLSHRIFMAIIYTVAIGIIYLWIQL

SEQ ID NO: 4463 - protein, 74 aa, Staphylococcus epidermidis
ERPNYGMNLGHKSMFQVFYNVKTVMNFWALTECISIDKAIWLSTIKEWHNEGIMNICLILQLFSRKSNGLMVVK

SEQ ID NO: 4464 - protein, 175 aa, Staphylococcus epidermidis
EMRKCVLMTVAASATLLLAGCGNGQKEDKDVTVSLPTEAKADKLDAQGYDAAMPVYSAVYDALVKYDKDKGIKAGLADKWSVDESGKVYEFHLKKNVKFSDGSALDAKDVKFSIDRAKAMNKDSTVETLKKLDKVVVKNEHVVQIRLKSPSNQVLNELTQVRPLRIMSPHSVEGC

SEQ ID NO: 4465 - protein, 263 aa, Staphylococcus epidermidis
IRRKIDMSKTAIITGAAGGLGKGIAERLANDGFNIVLQDINEALLLETEKEFKEKGYQAVAFKSDVSKKKEQEELVQFAVTEFGQLDVMVNNAGVDAVTPILEIGEEELSKLFNINVFGTLFGIQAAANQFIKQKSKGKIINACSIAGHESYEVLGTYSATKHSVRSFTQTAAKELADKGITVNAYCPGVAKTEMWDRIDEEMVKLDDSLEIGDAFEAFSSEIKLGRYQEPSDVANLVSFLASNDSDYITGQSILTDGGLVYR

SEQ ID NO: 4466 - protein, 445 aa, Staphylococcus epidermidis
CKIELRLIYMRLITFFKDLKSIICFNRERRMNVKQLSTTLKVRLICDFFQNIIVTAFLPFIALYLTDMVNQHFSGLFLFGLVMINFPISLISGHIIERLPKKTLTLSYQFILSLMLVIMAISISQHTFKIILFCIAYTIFSITIGMQQPIMDTIIMDAITPEVEQYIYKISYWLTNIAVAFGALIGGLMYGAHKSMLFFIAFVIYIMVFIALIVWLPKDLNIVTQSHTHHANEKQFSMGQILKSYKPAFKDTTYLLLIIGFSILTMGELSASSYISVRLKQEFDPMILFSLHINGVKMYSLLLMTNTIIVIIFTYFISKIVMRMNVKTALLVGIIFYVIGYSNLTYLNDFTLLIIFMIIATIGEMVYSPILEENRFKMVPSHKRGTYSAVHALGFNLAELLARFGIILGVFLTSMEMGIYMFVLLLLGGMSLYIAVSRFNNTNSQ

SEQ ID NO: 4467 - protein, 52 aa, Staphylococcus epidermidis
VQSDDLNAIYMLKDSHIDLIDDMSSIVVHIATQYYRDVGALDVRIFQPRFYK

SEQ ID NO: 4468 - protein, 80 aa, Staphylococcus epidermidis
KTTDNNDFHNITPKSEILVMLNIAMTSMVTQIVDDTICFIIILIPRIEPSRRMSIVIVTEHAVNVELKKTSNNNWNAESL

SEQ ID NO: 4469 - protein, 175 aa, Staphylococcus epidermidis
PQLDDTTPFKKGVGIDLARLSLEKAETLKGQRPLTYYLTDKPQETKHVFDTAVSTSVLYLIEDIPQHAKDLKEVLKPGGVYYASFADLTNNPSRQFMDDTINQYGATPSQNHSLKHIVDSFVDAGFEVAVMKEHVPDVIDLTHYSDFYLSPNDYLQTLYEESFLIKASVKEGTEK

SEQ ID NO: 4470 - protein, 54 aa, Staphylococcus epidermidis
LSIDTKALMSITVTIALRLEVVIEMLDIEWYSFQNEVADTKLKIVWKTITETSW

SEQ ID NO: 4471 - protein, 58 aa, Staphylococcus epidermidis
VKVDVLHHLGNHKKMLNQKLGTLQVIHCNVPSSIYKDLVLFFRIFSSYFRDNTIHTHI

SEQ ID NO: 4472 - protein, 48 aa, Staphylococcus epidermidis
RFPDKCSSLKVKAGDVSLAIAFIFGMPKPLVVNDGVMVFVDRGQCLNE

SEQ ID NO: 4473 - protein, 692 aa, Staphylococcus epidermidis
YKKDRGALNMKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQFNQPQTSMPNNDQQNPKKVAEHTTKSINAKKEETRKNENAKSLVQPQQDDKTTSEQTKMKESREQEITNEQKQLQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKAITKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTFATDKVQKGVWTGTPV

SEQ ID NO: 4474 - protein, 327 aa, Staphylococcus epidermidis
IMKENFWSTLPRPFFILAPMEDVTDIVFRHVVSEAARPDVFFTEFTNTESYCHPEGIHSVRGRLTFSDDEQPMVAHIWGDKPEQFREMSIGLADMGFKGIDLNMGCPVANVAKKGKGSGLILRPETAAEIIQASKAGGLPVSVKTRLGYYDIDEWRDWLKHVFEQDIANLSIHLRTRKEMSKVDAHWELIEAIKTLRDEIAPNTLLTINGDIPDRQTGLELANKYGIDGIMIGRGIFHNPFAFEKEPREHSSKELLGLLRLHLSLFEKYDKDEARHFKSLRRFFKIYVRGIRGASELRHQLMNTQSIAEARELLDTFEARMDARSEV

SEQ ID NO: 4475 - protein, 170 aa, Staphylococcus epidermidis
QTMEDIMILTILFIFFCIRLISLKISMQHAKQLKVEGAVEYGVKNSKYLAITHVLIYMSAAIETFIHKDTFNLLNGIGLIILIVAYIMLFIVIKTLGRIWTLKLFILPNHPIIKSGLYKVTKHPNYFLNIIPELIGVLLLTNATYTTLLLVPYAYFLIVRIRQEEKLMNI

SEQ ID NO: 4476 - protein, 325 aa, Staphylococcus epidermidis
SLKEDNMKNYKKYLIVLVLCLTVLSGCNLPGLKNSHSDDDVRITSLGTSESQIISHMLRLLIEHDTKGEIKPTLINNLGSSTIQHNAVTSGQANMSGTRYTGTDLTGALKEDPIKDPKKAMKATQEGFKKKYNQTFFNSYGFENTYALIVTKETAKKYHLETVSDLEKHAKDLRVGMDSSWMDRKGDGYPAFKKEYGYSFGTVRPMQIGLVYDALSSGKLDVAVGYSTDGRISAYDLKVLEDDRRFFPPYDASPLASDQLLKEKPELKPIVKKLEGKISTEQMQELNYQADGKGKEPATVAEDFLKKHHYFEDDDNKKDKQKGGQ

SEQ ID NO: 4477 - protein, 525 aa, Staphylococcus epidermidis
LSKEMKPLEQAINDNKKKKRFNFRMPGAFMILFILTVVAVIATWIIPAGAYSKLSYEPSSQELKIVNPHHQVKKVPGTQKELDRLGVKIKIEQFKSGAINKPVSIPNTYERLKQHPAGLDQITSSMVKGTIEAVDIMVFILVLGGLIGVVQASGSFESGLLALTQKTKGHEFMLIAFVSILMIIGGTLCGIEEEAVAFYPVLVPIFIALGYDSIVSVGAIFLASSVGSTFSTINPFSVVIASNAAGTTFTDGLYWRIGACIIGAIFVISYLFWYCKKIKKDPKSSYSYEDKAAFEKQWSVLHDDGSSEFTLRKKIILTLFVLPFPIMVWGVMTQGWWFPVMASAFLIFTIVIMFIAGTGQYGLGEKGTVDAFVNGASSLVGVSLIIGLARGINLVLNKGMISDTILHFSSSIVQHMSGPLFIIVLLFIFFCLGFIVPSSSGLAVLSMPIFAPLADTVGIPRFVIVTTYQFGQYAMLFLAPTGLVMATLQMLNMRYSHWLRFVWPVVAFVLIFGGGLLITQVLIYS

SEQ ID NO: 4478 - protein, 41 aa, Staphylococcus epidermidis
NGEEWNNRMHCMNMIKLISTYTLKRYFVMSVPILPSSAASN

SEQ ID NO: 4479 - protein, 292 aa, Staphylococcus epidermidis
GSSFNCRNRTSIYRTGDNDANMNEHTKIENQLQYYLEQFTYLHQLVLEDSRHIVDLENLIDEYSQWILQPLAEHHYLTWNDLETKISFTKKLQEVSAKCVKQVEVIRAQRLLNGRASTSGYFENIEHCINEEFGRWQIGQNDKLLLIGSGAYPMTLIQVAKETGAAVIGIDIDSEAVDLGQRVVNVLAPNEDIVISNQTVDQLEDIQSVTHIIFSSTIPIKYDILNELYTLTNDEVVVAMRYGDDMKALFNYPSQATDETQWRCEELQTRPKQIFDIALYRKVASKVGVEHV

SEQ ID NO: 4480 - protein, 41 aa, Staphylococcus epidermidis
TFQLRAHKPYGDYIQNKFYSISFSTLLIYLFIINFFLFKKP

SEQ ID NO: 4481 - protein, 306 aa, Staphylococcus epidermidis
KIKLLEVLMMQKVVLTAAITGAGDTIQKNENVPVTPQELADSAIKCARAGATVAHIHVRDPETGGVSHDPELYAETVRLIREADEDIVINVTSGGGGDFIPSLEHPETGGEGTWIQTPEERFKPIGDLLPEMCTLDCGSVNMGDAIYLSPASWLRKQAQMVKDAGVKPELECFDTGHVSFAKQMIEEGLIDGDPMFQFCLGIPWGAENDPETIEYLKSRIPENAHWSAFGIGKMQLPTVRKVAQRGGNVRVGLEDNIYLRKGVKATNEALVEEAKRILAELDIEPLTPAEAREKFNLRNPHGKGDK

SEQ ID NO: 4482 - protein, 652 aa, Staphylococcus epidermidis
GKKLIEVIFLKNNNETRRFSIRKYTVGVVSIITGITIFVSGQHAQAAEMTQSSSDSNEQSQQTEQVEHKEDTTHLSNELNQEGETASQSKTSQENQSDGNVQKKSNQIQQDSTQTSPLNDQKQTSMEQQSKDNHVTPNSRQDTYPKGQNQDDKGKQQFKDNQHSQTGHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHINQLTAQAQYKNQYPVVFVHGFVGLVGEDAFSMYPNYWGGTKYNVKQELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQQPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQCYMSMINNMLKVEELDGITRK

SEQ ID NO: 4483 - protein, 77 aa, Staphylococcus epidermidis
KKPWFRETHKKHPQPVQIFMDRNRGLEFFLIKKGLSAIFQLGPNFPNMWSQNFLISSLEIRTSDVSEPRKSPWSHLC

SEQ ID NO: 4484 - protein, 301 aa, Staphylococcus epidermidis
NFRLRSDVMEIIIIGGFLGSGKTSAINHLIADALENNLNPAVIMNEFGKRSVDGQLIERPEVPMSEITEGCICCAMKSDVSQQLHELYLKYQPDIIFIECSGVAEPLAVVDACFTPVLAPFITLRSMVGIIDASMYSRIKSYPQDIAALFYEQLRHCSTLFVNKIDKIEVEETARLLRQLERLNSDANIQVGQFGELNLKSLLEPTHINSNACGTLHSNINHQFIENPRLQTKEEMISALDNLPQDVYRVKGFVRFSDQQHVYLVQYAQGNIELSPIQLKNDVPLYLIVIGKHLKQIQLDL

SEQ ID NO: 4485 - protein, 43 aa, Staphylococcus epidermidis
RVLCLFISVIFRNDLLLIIYKDLYIENIDCFNNRRSCCYYESV

SEQ ID NO: 4486 - protein, 52 aa, Staphylococcus epidermidis
LNQCEKHIYRKFIKYIEDIQLIKKNNLICNLNLYFCHLSYSNNSIFKHFHIL

SEQ ID NO: 4487 - protein, 239 aa, Staphylococcus epidermidis
TLKCNKFTLKIGDMINMNIFVTGTNTDIGKTYVTKYLYKALRTRGYRVCIFKPFQTEEIGGGRYPDLEIYKNECDLDYDVTSLYTFKDPVSPHLAFKIERHQQLNHQTMIDKLESLKAQFDMILIEGAGGIAVPIYEYSDHFYMTTDLIKDTSDFIVSVLPSKLGAINDAIVHQKYIDHQELPPNVLIMNNYTDSAIEQDNLHTIEKLIHKSVYTLGHQATQESFSEAFIQRIIGGSNG

SEQ ID NO: 4488 - protein, 47 aa, Staphylococcus epidermidis
PSKCFNTITSILNNHIPKLPLTNKLMAESFYMKLFFITFFTTTKYEQ

SEQ ID NO: 4489 - protein, 267 aa, Staphylococcus epidermidis
IERCENMQHSSKIIVFVSFLILTIFIGGCGFINKEDSKETEIKQNFNKMLDVYPTKNLEDFYDKEGYRDEEFDKDDKGTWIIRSEMTKQPKGKIMTSRGMVLYINRNTRTAKGYFLIDKIKDDSNGRPIENEKKYPVKMNHNKIFPTKPISDDKLKKEIENFKFFVQYGNFKNLKDYKNGDILYNPNVPSYSAKYQLSNNEYNVQQLRKRYDIPTKKAPKLLLKRDGDLKGSSVGHKDLEFTFVENKKENIFFTDSINFKPTERDES

SEQ ID NO: 4490 - protein, 222 aa, Staphylococcus epidermidis
TERWSINMEGNLIQQLVHYYQMNFGYLWELFVNHLLMSVYGVLLACLVGIPLGIIIARFGKLSGVIITIANIIQTVPVIAMLAILMLSMGLGMNTVIFTVFLYALLPIIKNTYTGINEVDPNIKDAGKGMGMTRNQVLTMIELPLSLSVIIGGIRIALVVAIGVVAVGSFIGAPTLGDIVIRGTNATDGTLFILAGAIPIVIIVILIDVLLRLLEKKLDPAT

SEQ ID NO: 4491 - protein, 43 aa, Staphylococcus epidermidis
KSLLNQYVFEYFSNHPTSKFKVLRKIIIKEYKGELMLSIQKQR

SEQ ID NO: 4492 - protein, 49 aa, Staphylococcus epidermidis
DLIREYMLASIIPTILLKVIKGASTGVKHASTTASGSATPLHSIKMISG

SEQ ID NO: 4493 - protein, 320 aa, Staphylococcus epidermidis
IAMLKRTIKFILYLIVSSFIIFILVEKTSGNPAILYLQRHGYTSITQDNIEAAQHQLGLGQHVLLRYIDWVGHALTGNLGYGFSTNEAVTAMIMEAIVPTLVLIIVSSCIMLPFGYIVGYFVGTRPHTRYANGIRGFAQVMTSMPEYWLAILFIYYLGVRWQLLPFVGSDSWQHFVLPIFTIVVIEGCHILLMTAHLITQTLDQDAYQLAQLRHFSLKARIIVQIKEIFAPLMTISINSIIHLIGKAVILEVIFSMSGIGKLLINAINQRDYPLIQGIVIFIIVFIMLMNYLGDVIILKNEPRLRRRHTQQSGNEKRGTM

SEQ ID NO: 4494 - protein, 109 aa, Staphylococcus epidermidis
KGVLMHNYNNINIVSDDSKYQEICWFHTLEGIWHPVEVETSPLNITFNKDITPNYVCTLINEDSRKIILSNVDNPNIIIEMILINSKKLVFNAISKEGLGTSPKITFTK

SEQ ID NO: 4495 - protein, 42 aa, Staphylococcus epidermidis
TIKRENSVIIYLKVVVSYVSFVVISSCVKIRDYYYKEGLNKS

SEQ ID NO: 4496 - protein, 344 aa, Staphylococcus epidermidis
ILKRNNFDLGDVHMYKKGLILFFVAVLTLALAACGKDSHNQSSDHKGKLDVNTTVYPLKSFAQQIGGKYVNVESVYPKGVDPHTYDPSQKQMVDIGKSDLFLYTGDNLDPVAKKIAKAINDKDKTLSLESTLDKNKDLLKGEEHEHEHGEGHEHGESHEDEHEHEHHHHGKYDPHIWLDPVVSQKFAKAIKDELIEKDSKHKSYYEKNYNQLVKELKDLDKDMKHAVKGNEDKTVYISHDSIGYLAERYHFEQEGIENMNAEEPSQKDLTNIVKQIKEDKVKNILIEENVSHKVADTVRKETNAKTIKFYNMGSHTKQQDDDNNTYQSFMKENIKAIEKALQNE

SEQ ID NO: 4497 - protein, 64 aa, Staphylococcus epidermidis
SNILEGLRENNHATPKNKILKIGNNAWAVPDEINGENAISNDVVASLGNAKNGPITRYKPIVNK

SEQ ID NO: 4498 - protein, 47 aa, Staphylococcus epidermidis
KTIRKIKINKILINIVLLKLRAIWYELYISNLKNYCEFVLLKRLTAM

SEQ ID NO: 4499 - protein, 466 aa, Staphylococcus epidermidis
RKSRRPLTMSEQFNKGKQLIVAIILGILTYWLFAQSFLNIAPHVQRFYHVDMSIVNIAVSLTSLLTGVFIVVAGGLSDKIGRVKITNAGLILSILGSIALIISHAPILLLLGRVLQGLSAACLLPATIALINSFFQGEERQKVLSYWSFGSYGGTGLASLFAGIIATFIGWRWIFVLSIIFSIIALILLRGIPESKDESAYNKKFDIVGIIIFVVMMLSINVVITQGDRIGWLNPLILILIAIFIVTLIAFYIFEKRQDEPFIDLSLFSNNVYIGTTLANLMVNMDIGSLALFNIYVQDDKHLSAAQAGLITIPYMLCSLLMIRVGERFMQKRGPQLPLMLGPVSITVGIILLAFTSLPNMIYYIVACIGFIFIGLGLGFFATPALSTAVSNVPAEKAGTASGIIKMTSTLGAAFGIAVVTTIYTALSVNHPAYLAATIAFIVGAGLVFIAFIAAYCLIPKKNVDI

SEQ ID NO: 4500 - protein, 47 aa, Staphylococcus epidermidis
IFKRYIVAVKSSVSNLKLYLIMHKNNNFSTNILTTFDISQSYYYHHV

SEQ ID NO: 4501 - protein, 50 aa, Staphylococcus epidermidis
KRGRNRVKVQSIVEIKNLENGNISQEIDNVSILKASVVFVCLTLILLCIL

SEQ ID NO: 4502 - protein, 41 aa, Staphylococcus epidermidis
IGMSNAGLTIVIYTSIEETAESVNTLFLNTRIFNNGCFNLS

SEQ ID NO: 4503 - protein, 315 aa, Staphylococcus epidermidis
KEVSEMAKIVVALGGNALGKSPQEQLELVKNTAKSLVGLITKGHEIVISHGNGPQVGSINLGLNYAAEHDQGPAFPFAECGAMSQAYIGYQLQESLQNELHSMGIDKQVVTLVTQVEVDEGDPAFNSPSKPIGLFYTKEEANRIQQEKGYQFVEDAGRGYRRVVPSPQPISIIELESIKTLVENDTLVIAAGGGGIPVIREQHDSFKGIDAVIDKDKTSALLGADIHCDQLIILTAIDYVYINYHTDQQQALKTTNIDTLKTYIEEKQFAKGSMLPKIESAISFIENNPNGSVLITSLNQLDAALEGKIGTLITK

SEQ ID NO: 4504 - protein, 111 aa, Staphylococcus epidermidis
IIRRFFSMKRASYSVETKYKAVEMKAAGFSTKEIMKELNIRNRTQVKTWWRWYRNGESYRFSQQVGKQYTYGKGLEELSEVEQLKLENKRKDIELDILKKYKALERKWYQQ

SEQ ID NO: 4505 - protein, 81 aa, Staphylococcus epidermidis
YNRRNSKMKVYKLNYQHHKDIVDDNVLTMFVTADNQDEVEAFAKKLHYKIEHLSPLTKKEFEDEKAKDSHYRLEHVDHYLN

SEQ ID NO: 4506 - protein, 997 aa, Staphylococcus epidermidis
IHGRYNMGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAEAPQSEPTKAEEGGNAEAPQSEPTKAEEGGNAEAPQSEPTKTEEGSNAEAPNVPTIKANSDNDTQTQFSEAPTRNDLARKEDIPAVSKNEELQSSQPNTDSKIEPTTSEPVNLNYSSPFMSLLSMPADSSSNNTKNTIDIPPTTVKGRDNYDFYGRVDIESNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEITEYGGE

SEQ ID NO: 4507 - protein, 64 aa, Staphylococcus epidermidis
RIYGYWSLIPKFSYYIFNEIPCHFHIFNSINNYIIFLKIKYIKIFFFIFNIIISVYLPTLPLAL

SEQ ID NO: 4508 - protein, 105 aa, Staphylococcus epidermidis
SSHGTICFKPSLIILSSSQITTLNIFIPPRQVVFGNTLMSLAGFLRKCADVHMFHIESWLYYVNDLNLGVSYQKHRDEGIGARVLNVMETYRCHYHEPEYVICAS

SEQ ID NO: 4509 - protein, 1081 aa, Staphylococcus epidermidis
IKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQTTQPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGKPAEPGKPAEPGTPAEPGTPAEPGKPAEPGTPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 4510 - protein, 375 aa, Staphylococcus epidermidis
IQKGCTIMSHHRIIIIGAGAAGVGMAITLQEFNIKDVLIVEKGTIGHSFKHWPLSTKTITPSFTTNGFGMPNMNAIAKDTSPAFTFNEEHLSGKRYAEYLSLVATHYNLNVKTNTNVSRVTYIDGIYHVSTDYGVYTADYIFIATGDYSFPYHPFSYGLHYSEIQTFTQLKGDAFTIIGGNESAFDAAINLSQTGAKISIYTSKTGLKKEDADPSIRLSPHTQQRLQNAIQEGALIEMHVGYQARKITYQNHSYKIHFDNGHIVHSHTEPIIATGFDVTQNPLIEQLFQVRQSEVQLTELDESTKFPNVFLIGATVRHQNAILCYIYKFRARFAVLARIVSLREGLPEDTSLIQSYRQKNMFLDDYSCCDVNCTC

SEQ ID NO: 4511 - protein, 312 aa, Staphylococcus epidermidis
VERGSQKVKTLMIKAMGTVIRLSIEHQHPDTLLQEAEIKIRAWESQFSANDPKSDLMNVNQHAGIAPVKVSSEIFNMIRYGYETTLSSNFKMNILIGPLVKLWKIGFKDALKPKEVDIQRALLCMNPENLVLNSKTHEVFLTQSGMEIDLGAIVKGYFADQLQQYFLAHGVSSGIIDLGGNVLTIGRQPETLEKWHVGVRNPFHKDTLPLVTLSVEHQSVVTSGIYERYFIQENQLFHHILDSTTGYPVDNDIASVTIISDHGIDGEVWSTICSFGQSQKNIELLNLIDGIEGIIVTRDGSVLMTSKMQKYL

SEQ ID NO: 4512 - protein, 327 aa, Staphylococcus epidermidis
WDIMKVKLYTLLLLLIFLIACAPTSTSQSPHPLRTLIVYSPYPSHLIRPILNDFEKREHVKVEIKHGSTQVLLSNIHKEALSKRGDVFVGGVLSEMIDHQEDFVPYHNRSTLKQIEDYRSNNPLVTSFLLMPTVIVVNTDLQGDMTIHGYKDLLQSSLKGRVVYSNPHSTTTGYQHMRAMYHMRHQVSDVHQFQHHAVQLSKSSQVIEKVAKGAYYAGLSYEQDARTWKQKGYPISIIYPTEGTMLNVDGIALVNNAQPHPKRKKLVQYLTSRSVQQRLAEEFDAKSIRKDVTETNHSSIENLDHIPLIPQSRVSNIPHHQFLEMIQ

SEQ ID NO: 4513 - protein, 258 aa, Staphylococcus epidermidis
AKIMAHITLNYLSKTLGMHQTINVILPEDKSYFDTNENAKPLKTMLLLHGLSSDTSSYMRYTSIERYANTHQLAVVMPNADHSFYSNMAYGHSYYDYILEVYDYVHQILPLSKKREDNFIAGHSMGGYGAIKFALTQSYRFSKAAMLSAPYDVSMIGQYQWYDFTPEAIVGNTQHVAGTSFDPYYLVEQAIDNGQALPQLYITCGTEDELYQGNIDFVNYLDEKGIPYQFKKAPGNHDYAFWDKAIEDVIDRFTSSHI

SEQ ID NO: 4514 - protein, 130 aa, Staphylococcus epidermidis
LVYIINILIFKILGDAQMLKINFFNKEYGVLKSQNYERISLELLNKHYHITENDFKNKDYCLDKFNSKDTFIGDIAHTEKELISLIEDNIKNPKNMEHQNLSSIFDYTDHHNNQRVYHSILDLIQDNTSS

SEQ ID NO: 4515 - protein, 257 aa, Staphylococcus epidermidis
SPYIHGYYLYGSDRYYIFMDSIVKESYSMIDIQNVSKSYKKKHIFDSLDMQFQNHKITILLGENGAGKSTLLRLIAGIENADEGRIQYFNQYLSRRRIRHIVGYVPQDIALFEHMTVMENIEFFKSLCENPISDETLHSYLSQLNFTDTKVKVSNLSGGNKRKVNIMIGLLSRPKILILDEPTEDIDLESRYDIHNLLQQMTDQCLIIMTTHHLDEVEALADDIKVIGQNPFYHDILENKGWSFKKYANALADNTKS

SEQ ID NO: 4516 - protein, 80 aa, Staphylococcus epidermidis
TYHIIYVPLSTSVNYEKILSSSIPLLNTFLFTFKNPRKERTNSPSLFCVVVLLNFISLTINILITKMMYLKTIIILKYNN

SEQ ID NO: 4517 - protein, 72 aa, Staphylococcus epidermidis
IINIEATQYEGRAVSRKAIERIARSGNLPLVKALTMPSTTDVIITTTLEIKVSFNVFINAGPIRSDTGSPVI

SEQ ID NO: 4518 - protein, 42 aa, Staphylococcus epidermidis
YNNINEVQKGGGRLIEKVFKRIYFIFSHCDARICRGIGIQSL

SEQ ID NO: 4519 - protein, 131 aa, Staphylococcus epidermidis
EANISLKIRCISMKRLIFIVVILFIQACSYVVINFFFFDMWVIHSSEQQLNQSIQHHDTKQLHKIAKDKQTYQFLKTIKKADFENATDNQGGGPIGYYRLDINKKPVGLTINIKYNFLPEKTTIKSIKLYQ

SEQ ID NO: 4520 - protein, 1017 aa, Staphylococcus epidermidis
CENIHKKLGGFAMSKEIFDTFKFKCGAELKNRVLMAPMTIQAGYFDGSVTSEMIDYYQFRAGDASAIIVESCFVENHGRGFPGAIGIDNDDKIPGLKRLAEAIQAKGSKAILQLYHAGRMANPKFNEGEQPISASPIAALRPDAVPPREMTHAQINQMIDDFGEATRRAIEAGFDGVEIHGANTYLLQQFFSPHSNRRQDSWGGSREKRTRFPIEVLTKVQHVVAEKEASHFIIGYRFSPEEIEEPGIRFEDTMFLLNTLAEYEPDYFHISANSYQRTSIVNQEDTEPLINKYIKMQSAQLAKIPLIGVGSIAQRQDAEHALELGYDLLSVGKAYLVEPQWTDKISQNEEVEQFVDIHDQKVLHIPSPLWKVMDFMILDKEEEHRKYEKLKALQNKKVKFNKGTYHVYAKGHNGNLPMKVQLSEDKIVSIEVDDSGESEGIANPVFERLPQDIINGQTLNVDVISGATVTSEGIVQGIADAIEQAGEDPDILRARPKPVVQWSDEVVEETTDVVVIGTGGAGLSAAATVLDEGKEVIMLEKFAAIGGNTIRTGGQVNAAEPKWQNAFPALAGEKETLIQLLNHDENDIDEAYIEDFNTLKRQIKDYLENSSNEDEYLFDSVELHRIQTYLGGKRKDRNNVEISGDYDLVKTLTDNVLESVYWLKDKGVHFDRSFVDMPVGALWRRGHKPMKAQGLEYIENLGDYVKHNHGRIFTETTAEKLIKEGNQVVGIEARKANGAKVKIHTRHGVVLATGGFGANTKMLQQYNTYWDNIPDDIKTTNSPAITGDGIRLGVQAGADIVGMGFSQMMPISDPKTGALFTGLIVTPSNFVFVNKEGQRFVNEFESRDVLSKAALEQKDGIFYIIADANIKALAMNTTEDKINQELEDGTLVKADTLEALAQKLNIDTTTFVNTIERYNTFVEQGQDEDFNKNAFDLKIEKAPFYATPRKPAIHHTMGGLKINTHAQVIDVEGHIIEGLYAAGEVAGGIHAGNRLGGNALADIFTFGRIAGQSAVTK

SEQ ID NO: 4521 - protein, 406 aa, Staphylococcus epidermidis
VCLIKKLKKWLKFSTKPYIKHWVRSKRGFMDIKAQLKQIQDKGLYRELQPIQSVEKQYIYINDQSYINFTSNDYLGIGQLEYQPQNFLDFIKTYSIHLSSSRLVSGNSVVYQQLEQAISEHFNFEDALIFNSGYDANLAVFNIFKNNNVVIFSDQQNHASIIDGIKLSGLSKVIYQHLNYDDLESHLARHTNPDVQKVIVSDSVFSTNGTKADINRLVHLKQRYNAILIIDASHSLGLNLFEYHADIDIVTSSLSKAWGAHGGLILSSKDIKDLIINKGRSLIYSSSLPSYHLYFIQVSLQHVIEDTYRREKLNALSEYFNHQFMELFPNQPLSNTPIKNIVCDSLASAQAQYDMLFEHGIFVSYLRYPTVSQPTLRISLSYFHDTDDINRLFNVMKQYDEGDSYV

SEQ ID NO: 4522 - protein, 46 aa, Staphylococcus epidermidis
PIIIKIKHPSLYDEGCFMNFHIKIKSADYSFLFNSLSSFTSVGFGI

SEQ ID NO: 4523 - protein, 106 aa, Staphylococcus epidermidis
CDFFKKMCRKILVYKHTITVIKGFFLHTSHNFFNTPLLSIVIEFNYIPFDIGKLNKTFQTYKQLNIPLLFKRILSNELYTIIKVLQKFESLNFTYFIYIAHFIIML

SEQ ID NO: 4524 - protein, 294 aa, Staphylococcus epidermidis
GESMNKLSKYIAIATLASTVTISAPIHTYACESHTKDNHNQTTQHQNDPNLGEQNVMAVSWYQNSAEAKALYLQGYNTAKYQLDEHIKKNKGKKKLAIALDLDETVLDNSPYQGYASMHDTSFPEGWHEWVAAAKAKPVYGAKSFLKYADKKGIDIYYISDRDKEKDFKATKENLKNIGLPQAKDNHILLKGKNDKSKASRRQQVEKNHKLVMLFGDNLLDFTDPKKSTAKEREKLVKKHAKDFGKKYIIFPNPMYGSWESTLYHNQYEISKNEKDELRKASIKQFNPKTGEVK

SEQ ID NO: 4525 - protein, 454 aa, Staphylococcus epidermidis
EDPMANTRELNHKDAQYVWHPFTQMGVYAKNDNIIIEKGRGSYLYDTEGNKYLDGYASLWVNVHGHQHKKLNKAIHKQLDKIAHSTLLGSSNIPSIELAEQLVKLTPDRLQKVFYSDTGSASVEIAIKMAYQYWKNIDAKRYAKKNKFLTLHHGYHGDTIGSVSVGGIDSFHKIFKDLIFENIQIETPCLYKSKYRNEAEMLNSILNQIENILSERNDEIVGFILEPLIQGATGLFVHPHGFLKAVEQLCRKYDVLLICDEVAVGFGRTGEMFACNHEDVQPDIMCLGKAITGGYLPLAATLTSQKIYDAFLSQSHGKNTFFHGHTYTGNQLVCSVALENINLFKKKHLIGHIQKTSQTLKQRLEALQPHKNIGDIKGRGLMYGVELVENKSTQTPLDIPTVELIIRRCKENGLMIRNLENVITFVPILSMSNKEIKKMVKIFNKALHQTLGKK

SEQ ID NO: 4526 - protein, 195 aa, Staphylococcus epidermidis
IITIIYYLEFDKEGDEMPRISKRQLILESAAAIINEKGADYLTLDAVAQRAGISKGGLFYHFKSKDELIKELVNYANNLYRENVNQHIGNEKNKKGQWLNAFIEATRAHRTDNAPITSGMLAAQGTNRSLLSPLKTSYQEWQYQITHDGLDEVDATIIRLAVDGLWLSEIFGISAIDEEMREKVIERLKMQIEKK

SEQ ID NO: 4527 - protein, 271 aa, Staphylococcus epidermidis
MYTIIERCEKMKYYGKCISYISILILTFFIGGCGFMNKENNKEAEIKENFNKTLSMYPIKNLEDLYDKEGYRDEEFEKEDKGTWIINSEMNIQKKGQAMKSRGMVLYMNRNTRKTTGHFYTNIITEDKKGRVHSKDKEYPVRLKNNKIEPTKSIADEKLKNEIKNFQFFSQYGNFKNLKDYKNGNVSYNPNVPSYSAEYQLSNEDDNVKQLRKRYDIPIKRAPKLILKGDGDLKGSSIGYKDIEFSFVDNKEESVYFVDSLEFNPSDVNNE

SEQ ID NO: 4528 - protein, 51 aa, Staphylococcus epidermidis
MFTIISNINQRINFTLLNYASLNLFNKKRVEQNPYRILYSTLTKLTRVDSL

SEQ ID NO: 4529 - protein, 64 aa, Staphylococcus epidermidis
VIQMNHFGKLHRISLILNIMFLILMPKIYSFDNIYLSIIWTLLGIANAVYLLIKQKQENTIKRK

SEQ ID NO: 4530 - protein, 325 aa, Staphylococcus epidermidis
RRQIMKFAVVGTGVIGSGWITRMLAHGHEVIATDPSEGAYERMLTQVKQNWPYAEQMGLAENASIQNLTFTPHLEEAVKDADHIQENVPEVEEIKDAVLKEIDFYAKPEATIGSSTSGIMPSELQANLSHPERLVVAHPFHPVYILPLVEIVPGKQTSEETTVKAEQIYESIGMDVLHVRHEIEGHIADRLMEALWRESLHIVNDGIATTEEVDKAFTHAAGLRYAQYGPFMTFHLAGGEGGMRHMLKQFGPALKKPWTKLIAPELTDDLYHKVVSGSEASSQGYTMSELDQKRNEFLIKVKELAEQYWPSDSKAMKKSNGAELQ

SEQ ID NO: 4531 - protein, 418 aa, Staphylococcus epidermidis
KVKIITKNEEDCEMTVLSEQDKIRLLADIVKIQTENDHEIEVCEYLKDLLSQYDIDSKIVKVNDSRANLVAEIGSGAPVLAISGHMDVVDAGDHDDWTFPPFELTDKDGKLFGRGTTDMKGGLMAMVIAMIELKQSNALKQGTIRLLATTGEETEQYGAQLLADEGYLDDVSGLIIGEPTSNIAYYAHKGSMSCVVTAKGKAAHSSMPHLGTNAVDILVDFVNEMKQEYKNIKEHDKVHELDAVPMIEKHLHRKIGEEESHIYSGFVMLNSVFNGGKQVNSVPHKATAKYNVRTVPEYDSTFVKDLFEKVIRHVGEDYLTVDIPSSHDPVASDRDNPLIQNITRIAPNYVHEDIVVSALIGTTDASSFLGTNENNVDFAVFGPGESIMAHQVDEFIRKDMYLSYIDVYKDVFKAYLEK

SEQ ID NO: 4532 - protein, 756 aa, Staphylococcus epidermidis
QYEMEAESMLETNNHTNAWQGFKTGRWNKNIDVREFIQLNYSLYEGDDEFLEGPTKATETLWDQVMQLSKEERERGGMWDMDTKVASTITSHDAGYLDKDLEKVVGVQTEKPFKRSMQPFGGIRMAKAACEAYGYELDPETEKIFTEYRKTHNQGVFDAYSREMLNCRKAGIITGLPDAYGRGRIIGDYRRVALYGVDFLMEQKLKDFNTMSTEMSEDVIRLREELSEQYRSLQDLKELGQKYGFDISRPATNFKEAVQWLYLAYLAAIKEQNGAAMSLGRTSTFLDIYAERDLQNGDITEQEVQEIIDHFIMKLRIVKFARTPEYNELFSGDPTWVTESIGGVGIDGRPMVTKNSFRFLHSLDNLGPAPEPNLTVLWSTRLPENFKIYCAKMSIKTSSIQYENDDLMRESYGDDYGIACCVSAMKIGKQMQFFGARANLAKALLYAINGGKDEKSGKQVGPSYEGIKSDVLDYDEVFERYEKMMDWLAGVYINSLNIIHYMHDKYSYERLEMALHDTEIIRTMATGIAGLSVAADSLSAIKYAQVKPIRNEEGLVTDFEIEGDFPKYGNNDSRVDEIAVDLVERFMTKLRSHKTYRNSEHTMSVLTITSNVVYGKKTGNTPDGRKAGEPFAPGANPMHGRDQKGALSSLSSVAKIPYDCCKDGISNTFSIVPKSLGKEEADQNKNLTSMLDGYAMQHGHHLNINVFNRETLIDAMEHPEEYPQLTIRVSGYAVNFIKLTREQQLDVISRTFHESM

SEQ ID NO: 4533 - protein, 167 aa, Staphylococcus epidermidis
RSGITMMNQQYVFHTKVHRDWVDHNGHLNDAMYNRIFSDTTDDWLGHLGLTINAIQSYQYTVFTLENHVMFLNEMKENEDVIVKVHLHDYDSKRLHVLMEMFNADDDLCATYEVMLMGIDTTSGRPSAFPNDILNNIEHYYNIENVEMTSQYIGHRIGIKKKPKSKE

SEQ ID NO: 4534 - protein, 96 aa, Staphylococcus epidermidis
LSTFCLSSPWKKELINAMVAGSKHAADKPCKTRPNNNKIGACEMINAIEPSILNIRPAFVILTRPILSDNPPATTINTPVKSDVRLTAILTILIST

SEQ ID NO: 4535 - protein, 84 aa, Staphylococcus epidermidis
YVMMDFLHYILPVIIYAVLLAIHYFLSRTGNKILGLIVPVGVIASLVYMYQADIIHMKMIGVIIIGIVALLFLAEEWQRAQKDK

SEQ ID NO: 4536 - protein, 213 aa, Staphylococcus epidermidis
DTMIKFISEHSGMLFAKTFEHLYISIVALVIAMIVAVPLGILLSKKEKLSKVSLTIAGVLQTIPTLAVLALMIPLFGVGKTPAIIALFLYVLLPILNNTIIGIQNIDSNLREAGRSMGMTNFQLMKDVELPLALPLILSGIRLSSVYVISWATLASYVGAGGLGDFIFNGLALFEPSMIITATILVTAIALIVDYVLSLIEKWVVPKGLKVSR

SEQ ID NO: 4537 - protein, 63 aa, Staphylococcus epidermidis
LNSITIDSKGVLKKLCEVWRKKPLITVIVCLYTRILRHIFLKKSHYQKLKNIIIINVVKNVLD

SEQ ID NO: 4538 - protein, 236 aa, Staphylococcus epidermidis
NNTMKVIAMYSIKMRASHEDVHISGAETMCEFEDLENYLKKYFNKAFNHENGNIDFLNLKIEKVKAPIQTLVALPVVENLNDTLTQLAKQTGVSEYALNKGLEFIKNDITYTGAIILSAQTGQRLDSTEQRGIRVTQLAFKTCKCNGEISERVKDARALATCINAFEGVKAELCVSDDLHYTTGYFASPKLGYRRIFNIKEKGTRHGGRIIFVDEGINLNEYVSFLETVPKEIIEK

SEQ ID NO: 4539 - protein, 56 aa, Staphylococcus epidermidis
SYFVLLTQYSHFTVLLIFSNDFHFLIKNKNPCTLNIIKNFYLLKIICQNKWIFNKK

SEQ ID NO: 4540 - protein, 192 aa, Staphylococcus epidermidis
RMNVADIKARLLDLENTFKEKESELTDLDRAIGDGDHGVNMVRGFEHLKEKIDDQSMQALFKSTGMTLMSNVGGASGPLYGFGFIKMASAVNDEIDHDNLKEVLKAFADGIQQRGKVELNEKTMYDVIERAREAVEKNETVDLDKLQSFANETKDMVATKGRASYFNEASKGYIDPGAQSSVYILNAIIGGE

SEQ ID NO: 4541 - protein, 75 aa, Staphylococcus epidermidis
NICFLYLIYHNIVQFNLKFTMFNIYSSFYILYKKHGLYLTVCSFTFRPTICLSNQSKTYFYVTFVNCSRFTTTKY

SEQ ID NO: 4542 - protein, 315 aa, Staphylococcus epidermidis
RSVVMVKFIMKRLTLMIPLLIVVTFMTFMMTYLTNEDPAVTILHAQGTPNITQDLIAETKEKYGLNQPIFTQYKNWLVDALQFKFGTSYITGDPVSERMGPAFMNTLKLTLISSVVVMITSVVLGIVSALTSGRFPDRAIRSIAFLLTALPSYWVASILIIYVSVKLNLLPTSGLTGPESYILPVFVITITYAGIYFRNVRRSMLEQLNEDYVLYLKASGVPRLTMLLHVLRNALQVAISIFCMSIPMIMGGLVVIENVFAWPGLGPLSIKAITEHDFPVIQAYVLIVAVLFILFNTLADIINAILNPRLREAMK

SEQ ID NO: 4543 - protein, 54 aa, Staphylococcus epidermidis
RPSVKVVPAALEAMTTENGLIVENVLPTELAKKIAPTETIESYPSAINIGTRTG

SEQ ID NO: 4544 - protein, 257 aa, Staphylococcus epidermidis
LTMVNIMEKFKLTGKVAMVIGGATGIGKAMAEALAQAGANIVIADLQSNIGQETATTISTQSGVKTTSLKLDITHLDEVNQIVDYVVREYGKIDILVNNASISIQDDTENISYEEWLKEINLSLNGAFSVAQTVGRQMIEKGSGSMINVSSVLGLIANKTQDQSSYETSKAGVTMLTKSLAREWSRYGIKVNAIAPGYMRTIETEKILNDNTETNTTPMERVGEPEELAGITVYLASDASSFTQGSVFNIDGGYSAL

SEQ ID NO: 4545 - protein, 194 aa, Staphylococcus epidermidis
LILLQEKKLAKVNQQKKSLNNLLTKLLSMVQQKQNQVNQRNQVNQRNQVNQRNQVRQQNQVNQRNQVRQQNQVNQRNQVNQRNQVNQRNQVRQQNQVRQQNQVNQRNQVRQQNQVNQRNQVRQQNQVNQRNQVRQQNQVNQRNQVNQWNQVNQWNQVRQHNQVHQNNQIDQCIQQIIKINYLIQVKIVKLMREL

SEQ ID NO: 4546 - protein, 473 aa, Staphylococcus epidermidis
CDIFFLTKMIGVLGMNFFDIHKMPNKGIPLSVQRKLWLRNFMQAFFVVFFVYMAMYLIRNNFKAAQPLLKEEIGLTTLELGYIGLAFSITYGLGKTILGYFVDGRNTKRIISFLLILSAITVLIMGFVLSYFGSVMGLLIVLWGLNGIFQSVGGPASYSTISRWAPRTKRGRYLGFWNTSHNIGGAIAGGVALWGANTFFHGNVVGMFIFPSVIALIIGIVTLFIGKDDPEELGWNRAEEIWEEPIDQENIDSQGMTKWDIFKKYILGNPVIWILCISNVFVYIVRIGIDNWAPLYVSEHLHFNKGDAVNTIFYFEIGALVASLLWGYISDLLKGRRAIVAIGCMFMITFVVLFYTNATSVTMVNISLFALGALIFGPQLLIGVSLTGFVPKNAISVANGMTGSFAYLFGDSMAKVGLAAIADPTRNGLNIFGYTLSGWTDVFIVFYVALFLGMILLAIVAYYEEKKIRKLKI

SEQ ID NO: 4547 - protein, 44 aa, Staphylococcus epidermidis
FISFILIFKMKSHCSHFVFMPHYRTYFLIQLNRTSFLFPIKNTP

SEQ ID NO: 4548 - protein, 543 aa, Staphylococcus epidermidis
VYIFSKRKRKTMNKLTKLSTVIFVSGIILAGCGSNKELTEKKENKVLSYTTVKDIGDMNPHVYGGSMSAESMIYEPLVRNTKDGIKPLLAKKWDISPDGKTYTFYLRDDVSFHDGTKFDADAVKKNIDAVQQNKKLHSWLKLSTLIDDVKVKDKYTVQLHLKEAYQPALAELAMPRPYVFVSPKDFKHGTTKDGVKSFDGTGPFKMGEHKKDISAEFNKNNQYWGEKAKLNKVEAKVKPAGETAFLSMKKGETNFAYTDDRGTDSLDKDSLKQLKETGSYQVKRSQAMNTKMLVVNSGKKDSAVSDKAVRQALGHMVNRDKIAQDILNKQEKPATQLFAKNVTDINFNLPTRTYDKKKAQALLDKAGWVLSKDRQVRQKEGKDLNLKLYYDKGSSSQKEQAEFLEAEFKKLGVQLDINGETSDKVAERRSSGDYDLMFNQTWGLLYDPQSTLAAFKTKTGYESATLGIKNKSQLYKDIDEAFKIQDAKARSKAYQQILKQVDDEGVFIPITHGRMTVVAPKDLQKLSFTQSQYELPFNEMQYK

SEQ ID NO: 4549 - protein, 171 aa, Staphylococcus epidermidis
FMILCFFCKYSICQIFIMYESYTHSSQIRGSYSMSKKKILIFISVILIIFGGVYLKMKYDEKAKQKEIYYKEQQERITLYLKYNTKKPNTIKSVHFTSLKQGPMGDAIIEGYINNNKENEFVAFASSEDNFQFQGDMIESKKVSNLIKYQTKTPDEIKKDLDKKKNAKDFY

SEQ ID NO: 4550 - protein, 69 aa, Staphylococcus epidermidis
CPPLFVIYILLLVQYKVFYIENVSNAINYLLTLAPTHNSSNTSHIKFSFSDNLILLRILSAYIDVIYFF

SEQ ID NO: 4551 - protein, 341 aa, Staphylococcus epidermidis
TVKFEKAIGTGAFVVDKTVKEKTTLKPNKYFDHGHPINYHLAFQTIEDGDSRNSPVQSGFVDISGGALGMLSDEQIKQDKKNKNLTIEDRPSTVSHFMAFNPKNDVLNQRTIREAISKSIDAKDIAGKSVNGLFQKNVQFVTKNNQQPHDYDMKAAERLLKSEGYHKNDDGIFEKNGKPLSFNLVIQTAEFPNWKDKAEKVQRQLKQAGIKLNVKTLDSQSYYDTLWTKKDYDLIFYRTYSDALMPYNFISSVFKNNDGQPGVLADDETLTKQLDDFPSTVSKEDQQCSFDDIFKHFNQQYYGVPIAYPNETFVVSDKVKQFKFSGLTDAPIDYKALKVNE

SEQ ID NO: 4552 - protein, 253 aa, Staphylococcus epidermidis
GVISMLKVQNVIKFYGKKSMFRDKRIPVVKGVSFDCPTGASVAIIGESGSGKSTLSRMILGLEKPDQGQVTLDGQPVHLKKVRRHRIAAVFQDYTSSLHPFHTVKDILFEVMNQCRCTSKENMEEYVTVLLREVGLKSDCLYCYPHMLSGGEAQRVAIARAICMQPDYILFDEAISSLDMSMQTQILDLLKRLRHSHQLSYIFITHDIQAATYICDDLLIFKNGCIEARTSISELHRQQNGYTRELIDKQLSI

SEQ ID NO: 4553 - protein, 406 aa, Staphylococcus epidermidis
QIELPIERNGHMLSIKNLSKVYAGGKKAVDNMTIDIESGDFIAFIGTSGSGKTTALRMINRMIESTEGEITIDGKNIKELNPVELRRSIGYVIQQIGLMPHMTVKENIVLVPKLLKWSQEKKDEKAKELIRLVDLPEEYLDRYPSELSGGQQQRIGVVRALAAEQDIILMDEPFGALDPITRDTLQDLVKKLQQQLGKTFIFVTHDMDEAIKLADKICIMTNGQVVQYDTPDNILRSPANDFVRDFIGQNRLIQDRPNIRTVKDAMIKPVTVHVDRSLNDAVNIMREKRVDTIFVVGNDEHLLGYLDIEDINEGLRHHKELIDTMQRDIYRVRIDSKLQDSVRTILKRNVRNVPVVDSDNKTLLGLVTRANLVDIVYDSIWGELESDNNDNHSGIVEPESTGVETP

SEQ ID NO: 4554 - protein, 286 aa, Staphylococcus epidermidis
SHDSIWNICTSAHFLKKPARDINVLPNTTCLGGIKMFKVVICDDERIIREGLKQMVPWEDYHFTTVYTAKDGVEALSLIRQHQPELVITDIRMPRKNGVDLLDDIKDLDCQIIILSSYDDFEYMKAGIQHHVLDYLLKPVDHTQLEHILDILVQRLLERPHSTNDDAAYHTAFQPLLKIDYDDYYVNQILSQIKQHYHKKVTVLDLINPIDVSESYAMRTFKEHVGITIVDYLNRYRILKSLHLLDQHYKHYEIAEKVGFSEYKMFCYHFKKYLHMSPSDYNKQSK

SEQ ID NO: 4555 - protein, 86 aa, Staphylococcus epidermidis
CDDSINSGKTVYSFTLDNVKNETNTRSNCTWYRCCIYFYYSINHYWIYLSVIHKRRKKSLIIQKNCIRETELWDEPGTQIDVPGFL

SEQ ID NO: 4556 - protein, 55 aa, Staphylococcus epidermidis
ALCSELPEAYDTFTVLKTDAATIDEASVVLPILFINFINKLPPNMYDKSSIEDKL

SEQ ID NO: 4557 - protein, 47 aa, Staphylococcus epidermidis
IISSTMTTFFYFYIFYIPHLIISLDMPKKILSFTSLFIYLKISLVHI

SEQ ID NO: 4558 - protein, 41 aa, Staphylococcus epidermidis
IKISFYLIILYHFIVENYKNFYVVCDKVRKHTFKFKINLFI

SEQ ID NO: 4559 - protein, 51 aa, Staphylococcus epidermidis
LVVSGFLVCNITVIDLYDDCLNIKIKICISKTLCNNIYKLKFIIILRRGLR

SEQ ID NO: 4560 - protein, 41 aa, Staphylococcus epidermidis
APSSVNMQPWRIAVDESDEMIEKVMHSFGFNSRQLTTSSAM

SEQ ID NO: 4561 - protein, 121 aa, Staphylococcus epidermidis
NAHSITPQYKISEPIPAQNNMAAHVKLLNSGLSVAFPNVTFPYLPNAMYKTKQNIASPIKRYTDPIELEMALLISVMIISLAFGKTIIGITAKSNTMTTPMKVVQSITFSFFKCDPPNINL

SEQ ID NO: 4562 - protein, 738 aa, Staphylococcus epidermidis
YFRLVHNKDKLMRCMYSMQTRLGEKDINLPQYYNNRELSWLDFNYRVLQESYDKNNPLLEKLNFISIFSSNLDEFFMVRVAGLKDQVKMGYDKPENKAQMTPQEQLDAIKIKNTDYVNTQYQRYNELIKELANYDIEMVKPEDLSDALIEKLEQEFKLSVLPTLTPLGIDAYHPFPKLNNKSLNIFVDIDTEDAINSAIVQIPSLIPRFLTLNEGTKQYVVMVEDVITYFINYLFTGYEVLNTFTFRITRNADLTIHEDGAEDLLIEIERFLKERKSGSAVRLELDCRTSEKENVEWLINQLEIEDNDIYYLDGPLDLTFLFGLVDHLSHKLKYLTYEKYTPQPPRSLGNKNIYQLSLERDIFFHHPYESFEPIVDFIRQAADDPNTIAIKQTLYRVSKDSPIINSLKEAAENGKQVTVLVELKARFDEENNVHWARMLEDAGCHVIYGMTHLKTHSKIALVVKRINNELTSFVHLGTGNYNDKTAKLYTDMGIITTNKDIAEDAINFFNYLSGYSTKPEYNKLIVAPYDIRDVFIDRIDKEIRSHLQHGNGKIMMKMNSLTDKTIIEKLFEASQAGVKIQLIIRGICCLKPGIPGISENIEVVSIVGRLLEHSRIYYFHNNSEAHIYLSSADVMTRNMIKRVEILFPVEDKSIGQRLVNYMNLQLSDNQKGRYQDAQGLYHYVENNSSPLNSQSYLMQEAIKYGEELKKQSVQPSGQPVHSRRGGSWMRKLKNTFKR

SEQ ID NO: 4563 - protein, 196 aa, Staphylococcus epidermidis
TAISFKRGKLIMNIYNKVTLSVILVITIIISFLFYFYTTEKKVDKDKLYENKITNHKQAGKPKNYGVASNNKIATKVGNKIIEDGGNAVDAAIGVSYALAVTEPHSSGLGGGGATLTYNGKENETPKAYEYKTMSSYEYKEGDKIGVPGFVRGLHDMHAKEGKMDEKKILDYVIPLAKDGFEVDSELVKKFEIIWS

SEQ ID NO: 4564 - protein, 63 aa, Staphylococcus epidermidis
YLVSTYLIKPLETEFKQSLEALLLIIDIYAFFSWGIITIFQSVLFNFNELFRVRNNRWENNKF

SEQ ID NO: 4565 - protein, 76 aa, Staphylococcus epidermidis
FEVSFCLFLRLCSIFLSFLLEFVWWLIAAYNEKPNAHIRMITTIVAENFFKAYILHPFYQLYFIIILFFIVSRIIL

SEQ ID NO: 4566 - protein, 248 aa, Staphylococcus epidermidis
KRVSLMIELSHIHKSFNETEVIKGIDLKINQGEVVTLIGRSGSGKTTLLRMINALEIPTEGTVYVNGMTYNTKDKKSQIKVRQQSGMVFQNYNLFPHKSALENVMEGLITVKKMNKATANEEAMNLLAKVGLVHVKDQRPHALSGGQQQRVAIARALAMNPKVMLFDEPTSALDPELVNDVLKVIKELADEGMTMVIVTHEMRFAKEVSNQIAFIHEGVIAEQGTPEDIFNHPKTEELQRFLNVINEK

SEQ ID NO: 4567 - protein, 129 aa, Staphylococcus epidermidis
IAGFVLHCIKFHINKPTNNNPVPGNNKLRIIIIIINIEIEIINQRLLVNLSDKTPPNEVPITPATPLTSSAKDTKDISCPLDKINGLINTNVTELATSTKNVIIRYLKTSRGLMTLEPVCDSILDERGV

SEQ ID NO: 4568 - protein, 49 aa, Staphylococcus epidermidis
LNGFIFLMLISIIFVLRRNSFLLILVNYINHKINYIKFSFVMTITKNNF

SEQ ID NO: 4569 - protein, 466 aa, Staphylococcus epidermidis
MNTSQKFRGDNRLLLGIILGVITFWLFAQSLVNLVVPLQSSYNSDIGTINIAVSLSALFSGLFIVGAGDIADKIGRVKVTYIGLALNIVGSVLIIITPLPSLLIIGRAIQGLSAACIMPATLAIINEYYIGTARQRALSYWSIGSWGGSGVCTLFGGLMATNLGWRSIFIVSIILTILSMFLIKHTPETKAEPIGDQPTETKKFDVVGLIILVVSMLSINVIITQTSQFGLFSPFILGLIAIFVISLIIFVIYENKIKQPLVDFDIFKNKGYTGATISNFMLNGVAGGTLIVVNTFYQQKLDFNSQETGYISLTYLIAVLIMIRVGEMILQSLGPKRPLLLGSALTVIGLILLSLTFLPNAWYIASSVIGYLLFGTGLGVYATPSTDTAVAQAPDDKVGVASGVYKMASSLGNAFGVAISSTVYSVLAAQLNLTLGGFTGVMFNALIALLAFLSILFLIPKKQSNV

SEQ ID NO: 4570 - protein, 42 aa, Staphylococcus epidermidis
IQTSSWLNIRKVTAQRAENNQKNYKKDNFYIISIEIVFFYLS

SEQ ID NO: 4571 - protein, 57 aa, Staphylococcus epidermidis
VQTSSWLNIRKVTAQRAENHQKNYKKDNFYIISIEIVFIYLSWTFLSQPLSYSMLSQ

SEQ ID NO: 4572 - protein, 54 aa, Staphylococcus epidermidis
NFQSILCLKTSLKPVDIFSEVDVLYSKMIFIERCTLSAYIPPNLSKCIISKYNL

SEQ ID NO: 4573 - protein, 43 aa, Staphylococcus epidermidis
KCKSNLNITLMESLRPHRVSWAFSMISGQGRLSIVLFQVALTL

SEQ ID NO: 4574 - protein, 274 aa, Staphylococcus epidermidis
IGGLTMIKAIAVDMDGTFLDTNKQFDRNRFETIFKELIDKNIKFIAASGNQFAKLKSIFGDREMFFISENGAVIYKGNQLYNYRSFDQYIFQKVVNYLNLNQKINNLIICGVKSAYILKETSEAFKQDARTYYHQLIEVDSLQTLPDDDYVKIAFNINRQTHPDLDEKLALKFKDDIKLVSSGRDSIDVIMPNMTKGQALSRLLKEWQMPASHLMAFGDANNDKDMLELAEHSYVMANSEDQSLFDIASHVAPSNDEQGVLSTIENVVLGYSNK

SEQ ID NO: 4575 - protein, 521 aa, Staphylococcus epidermidis
LSESANSFYLHVDDFLIRIVKECLLTHVNSKLMLWRFVMGSFFNRMTRKENPTIYQSKDGHLKRTLRVRDFLALGVGTIVSTSIFTLPGVVAAEHAGPAVSLSFLLAAIVAGLVAFTYAEMASTMPFAGSAYSWINVLFGELFGWVAGWALLAEYFIAVAFVASGFSANLRGLIAPLGISLPKSLSNPFGSNGGVIDIIAAVVIILTALLLSRGMNEAARMENVLVILKVLAIILFVIVGLTAINFSNYIPFIPEHKVTETGDFGGWQGIYAGVSMIFLAYIGFDSIAANSAEAINPQKTMPRGILGSLIVAIVLFVAVALVLVGMFHYSQYADNAEPVGWALRESGHGIIAAIVQAISVIGMFTALIGMMLAGSRLLYSFGRDGLLPSWLSQLNHKHLPNRALAILTIIGVVIGSMFPFAFLAQLISAGTLVAFMFVSLAMYRLRKREGKDLPKPEFKLPLYPILPAITFILVLLVFWGLSFEAKLYTLIWFIVGIIIYLIYGIRHSKKNDEEAYQVPRK

SEQ ID NO: 4576 - protein, 47 aa, Staphylococcus epidermidis
VHLSYSFPPFLRYIISIKLINNLVRDDYHMLNVKSFATFGYSIHNCV

SEQ ID NO: 4577 - protein, 66 aa, Staphylococcus epidermidis
IALSSAFSLANMIVKITVMVANIPPMRIADPRKSASSGAIGKFIDKQNVTKKNVDDGPAIFSALNV

SEQ ID NO: 4578 - protein, 103 aa, Staphylococcus epidermidis
YNMSFNIWMWILLVLFIVGTIAVILILTVGSVLEERSYDRRSEDEKRKNLEKNLEMSKGHTDVSQESSNGEEQVTQEHSQHVVQDHQQTHQNINQSTQDNRNN

SEQ ID NO: 4579 - protein, 74 aa, Staphylococcus epidermidis
LYASGVKVAIPVLGSYVADPDRFICSLKLSLFTTTELDVRLEVVVVDVVVGAAIVFKTVNLLNVLKFAKEVGLD

SEQ ID NO: 4580 - protein, 41 aa, Staphylococcus epidermidis
YPKSTLYSPSKCLHFTSNVPPIGIQVNYLAYILWDSIMCYL

SEQ ID NO: 4581 - protein, 485 aa, Staphylococcus epidermidis
HLTLTYIEGETMSGKLEELQLKVARLSRRTHELGIPIMVLFEGIPASGKTRLSNELLLHLDAKYSRFIATKSPESNDLRYQFLQKYWNTLPQKGNINIYFRSWYSHFLDYKENKIKHDQYKNYDVLVNQIYHFESMLKNDNYEIIKFFIEINEEKRNEHIQQTKDNPLTRWKVQEYENVIPQESYLNQMHQFINKDKDWKVIDYTEREHAFEKMYLHLIDRLEQAIKKVEQQTTKVNGKFTSSFTTSLFNNNLEKVDKKTYKNLIVELQQRMREIQFALYERKIPLVLVFEGMDAAGKGGNIKRIREKLDPTGYEVNGISAPTDVELKHHYLWRFAKKMPKSGHIKIFDRSWYGRVLVERVEGFASQNEWQRASDEINQFEKMWTDEGTIILKFFLCLDKDEQLKRFKDRENNPDKQWKITEEDWRNREKWDEYLEASHDMIESTNTSYAPWYIVPADHKKTSRIEVLKTIIRKCEEVLWGVKTY

SEQ ID NO: 4582 - protein, 436 aa, Staphylococcus epidermidis
FKTFHNFCKALTYLLYIPGHVCYISLYKTNFLWYDTSATSKNERMSHLMNIGIDKISFYVPKYYVDMAKLAEARQVDPNKFLIGIGQTEMAVSPVNQDIVSMGANAAKDIITEEDKKNIGMVIVATESAIDNAKAAAVQIHHLLGIQPFARCFEMKEACYAATPAIQLAKDYLAQRPNEKVLVIASDTARYGIHSGGEPTQGAGAVAMMISHNPSILKLNDDAVAYTEDVYDFWRPTGHQYPLVAGALSKDAYIKSFQESWNEYARRHNKTLADFASLCFHVPFTKMGQKALDSIINHADETTQDRLNSSYQDAVDYNRYVGNIYTGSLYLSLISLLETRDLKGGQTIGLFSYGSGSVGEFFSGTLVDGFKEQLDVERHKSLLNNSIEVSVDEYEHFFKRFDQLELNHELEKSNADRDIFYLKSIDNNIREYHIAE

SEQ ID NO: 4583 - protein, 696 aa, Staphylococcus epidermidis
SYLFMLFLWHVNKKIERNELIMFKKLFGQMQRIGKALMLPVAILPAAGLLLAIGTAFQGEALQHYLPFIKNDIVQQIANMLTGAGGIIFDNLPIIFALGVAIGLAGGDGVAAIAAFVGFIILNKTMGAFLHVTPDKLSDPTNGYANVLGIPTLQTGVFGGIIIGALAAWCYNKFYNITLPSYLGFFAGKRFVPIMMATTSFILAFPMAIIWPTIQNGLNAFSEGLLDSNTGLAVFLFGFIKRLLIPFGLHHIFHAPFWFEFGSWKNAAGEIIRGDQRIFIEQIREGAHLTSGKFMQGEFPVMMFGLPAAALAIYQTAKPENKKVVAGLMISAALTSFLTGITEPLEFSFLFVAPFLFVIHAVLDGLSFLTLYLLNVHLGYTFSGGFIDYVLLGILPNKTAWWLVIPVGIIYAVIYYFVFRFLIVKFNYKTPGREDKKSSVTTTSASQLPFDVLKAMGGKENIKHLHACITRLRIQVNEKSKVDVAGLKSLGASGVLEVGNNMQAIFGPKSDQIKHDMAKIISGEITKPSETTIDEEVSDESVHVEDIVETEIYAPGHGEIIPLSEVPDKVFSEKMMGDGIGFVPDSRKIVAPFDGTVKTIFPTKHAIGLESDSGVEVLIHIGIDTVKLNGEGFESLVNTDEPVTQGQPLMKIDLEYLKEHAPSIITPVIITNQEDKTLTIEDVKQVDPGKAIMTIK

SEQ ID NO: 4584 - protein, 76 aa, Staphylococcus epidermidis
GIIPYIYESTTIPTNNTAKIVPIVTKVLTAFLGAGFLKFVTALDIASTPVSDDAPDENAFKSKNNVTPGTVLPTVE

SEQ ID NO: 4585 - protein, 529 aa, Staphylococcus epidermidis
GVLFMSVLTVMQFIVNIIIMIVLLTIMILGGIWLFKDKGQNQHSVLRNFPVLGRIRYISEKIGPELRQYFFANDNEGKPFSRSDYKNIVLAGKYKSRMTSFGTGKDYLEGFYIQNTMFPLQATELHIDHTEFISTFLYHIENERLFSREEYRKSAQVDPFFLTDEHAVVLGSNLKHPFKIKRLVGQSGMSYGALGKNAITALSMGLAKAGTWMNTGEGGLSEYHLKGNGDIIYQIGPGLFGVRDHDGNFNRDMFINLAEHNNVRAFEIKLAQGAKTRGGHMEGNKVTEEIARIRNVKPYETINSPNRFDFIKNPTDLLNFVNHLQSIGQKPVGFKIVVSKVEEIEALVKTMIEIDTYPSFITVDGGEGGTGATFQELEDGVGLPLFTALPIVSSMLEKYGIRNKVKIFASGKLVTPDKIAIALGLGADLVNIARGMMISVGCIMSQQCHLNTCPVGVATTDPKKEKGLIVDEKQYRVTNYVTSLHEGLFNIAAAVGVHSPTEITSDHIIYRQLDGTTTSIQDYKLKLIS

SEQ ID NO: 4586 - protein, 387 aa, Staphylococcus epidermidis
SRLLLIIACVALILWLGIKEKKRHANRLEKIPLRININGIRGKSTITRMAYSVLREDQYRVVGKTTGTDARMLYWFTEKEYPVIRKPQGANIGEQRDIIRKVVKQKANALVNECMAVNPDYQITFQNDLVKANIGVIVNVMEDHMDVLGPTLKDVAQAFTATIPYNGKLVVMKDNYTSFFVKEAKKRNSELIVVDKDVIPESYLRKFDYLVFPDNVAIVLGIAQAVGVDEETALQGMLNAPADPGAVRIKYFHANRTKNVFVNAFAANEPQSTKAILNKVESYNYPYDKKIIILNCRSDRVDRTQLFVDNFLGEVDYDVLICTGKSTQMVTQFMETMPEKTYINYEGRDFVEIEKGILHEAENALVFCVGNIHGPGGRIAEFIEGIE

SEQ ID NO: 4587 - protein, 248 aa, Staphylococcus epidermidis
EGAPLMSIERIIYDNFQNDPFINELDINDETKGAYEILKWAYQTYENDIVYSCSFGAESMVLIDLISQIKPDAQIVFLDTDLHFQETYDLIDRVKDKYPQLRIKMKKPELTLEEQGEKYNPALWKNDPNQCCYIRKIKPLEDVLSGAVAWISGLRRAQSPTRAHTNFINKDERFKSIKVCPLIYWTEEEVWSYIRDKDLPYNELHDQNYPSIGCIPCTSPVFDSNDSRAGRWSNSSKTECGLHVADKP

SEQ ID NO: 4588 - protein, 43 aa, Staphylococcus epidermidis
SVYPGSGKSTISPGLTTQVGNATRPFLVPYKIQTSSSLSNSTS

SEQ ID NO: 4589 - protein, 217 aa, Staphylococcus epidermidis
RRYPREMNKLIDFSKGLVPVILQHAQTDSVLMLGYMNEEAYQKTLKEKKVTFFSRSKQRLWTKGETSGHFQHVESIHLDCDQDAILIKVMPQGPTCHTGSLSCFNSEIESRFKIQALAQTIHQSAKANQSNSYTQYLLKEGIEKISKKFGEEAFEVVIGAIKHNREEVINETADVMYHLFVLLHSLDIPFSEVEQVLAHRHQKRNNFKGERKEVREW

SEQ ID NO: 4590 - protein, 47 aa, Staphylococcus epidermidis
IRCPTPVYLCFKIIFSFFNLLYIIIYDNVALVTYPSLTWKTMFPFPT

SEQ ID NO: 4591 - protein, 462 aa, Staphylococcus epidermidis
ATTLYVKVCSNMVQVKIGNCTINGIHKKNIDVFLGIPYAKSFNKISRFQHSKLMELSKPMIDATHIQSIPPQPYNSLEDFFSMTDSSFNSFKQNDYCLFLNIWKPSSNQNHLPVVIYFYGGSFLQGHGTAELYCPEHIVEQENIIVVTFNYRLGALGYLDWSYFNQHLNYNNGISDQINVLRWVHQYIEHFGGDPNNVTLMGQSAGSMSIMTLMQMPELDDYYHKVMLLSGTLTTDTPLNAHTKVQHFSQLMRHYFPNKTLKTLNSDDILYLMESQKIERGRSRGLDLIYQPIKDHHMSRSIKKFPKPTFMSYTHDEGDIYIEDATRTLPSERFIHLMSQYGTHVEKNDALTMKQQRNVITEYCFVRPIYLFLNQMNSCDTWLARFDWHQPHTSYFKSAYHILDLVFWFGHLSILTKNHYSVTQHDMNLSRNMISDLAYFARKGKMPWKCYEPQHQALHIYR

SEQ ID NO: 4592 - protein, 206 aa, Staphylococcus epidermidis
NAMLRVALAKGRLLKSFIEYLQQVNQIDIATVLLNRQRQLLLTVDNIEMILVKGSDVPTYVEQGIADVGIVGSDILNGQKYNINKLLDLPFGKCHFALAAKPETSRYKKVATSYVHTATQFFNKEGMDVEVIHLNGSVELSCVVDMVDAIVDIVQTGSTLTANGLVEKKHISEINAKLITNKESYFKQSSEIERLIKQLGVSINYA

SEQ ID NO: 4593 - protein, 275 aa, Staphylococcus epidermidis
EDMFKNNKSIEDTYATKPIIQNIVGQAQIKQVMAKQTPMRYTLKAIMAGFLLSIVTVFMLAIKTQFASTHNDGLINLMGAIAFSLGLVLVVLTNSELLTSNFMYLTVGWYYKAISVSKMIWIFIFCFIGNILGGFILFFLMKYAHVMTPEMTDSLTALVHKKTVESTWLNILIKGIFCNFFINIGIFISMQFKEGLAKAFFIACGVIVFVFMGYEHVVFNAGLYAGMMFFNMDGLSWLGVLKNIVFAFLGNYIGGGIFIGLVYAYLNGKRDSLQP

SEQ ID NO: 4594 - protein, 135 aa, Staphylococcus epidermidis
KGVLLMEKAKFVIKLILQLALIMLITFIGTEVQKLLHIPLAGSIVGLMLFFLLLQFKIVPESWINVGADFLLKTMVFFFIPSVVGIMDVASNITMNYILFFIVIIIGTCLVALSSGYIAEKMLEKSNTRKGTDHS

SEQ ID NO: 4595 - protein, 94 aa, Staphylococcus epidermidis
SIPPVACNVPPAIPIDNMINTAVTGAEPGGNWNPNIMISCATIAKMPHPSAPAVLNPNNIARIMIMISMINNNMEESPNLCRTIFTSIFYHFNM

SEQ ID NO: 4596 - protein, 76 aa, Staphylococcus epidermidis
PFKPTRGEMRPPKINWNRPSKLEALPLPPVRSAIAIEKQSGAIEVTGHILIKKPISKTYNGRCNVKVNIKITTPNI

SEQ ID NO: 4597 - protein, 290 aa, Staphylococcus epidermidis
HMKPFKLIFISALMILIMTNATPISHLNAQANEENKKLKYEKNSALALNYHRVRKKDPLNDFISLLSGSKEIKNYSVTDQEFKSQIQWLKAHDAKFLTLKEFIKYKEKGKFPKRSVWINFDDMDQTIYDNAFPVLKKYHIPATGFLITNHIGSTNFHNLNLLSKKQLDEMYETGLWDFESHTHDLHALKKGNKSKFLDSSQSVASKDIKKSEHYLNKNYPKNERALAYPYGLINDDKIKAMKKNGIQYGFTLQEKAVTPDADNYRIPRILVSNDAFETLIKEWDGFDEEK

SEQ ID NO: 4598 - protein, 49 aa, Staphylococcus epidermidis
YKKPQHREFHSEILYVGVRYRDKTIYSIHILSYPHLFSIQIIVVYNVWS

SEQ ID NO: 4599 - protein, 53 aa, Staphylococcus epidermidis
IRAFCAVFAMIGSSERAIFAVPIPKTKTKTIIGAINIIDFGKRSITRDAMYTK

SEQ ID NO: 4600 - protein, 430 aa, Staphylococcus epidermidis
IVTFEFNHFTQRMGYQLDKRQFEILDMLVRFNTESPPGRNTDPLQDEIETLLKQLDFSIQREQLYDNDSVIVATLKGHNPKAPKLILNGHVDVASVDDDQYWQYPPFKLTNKDEWLYGRGVSDMKGGMSSLFYVLEQLHQAGQRPEGDIIVQSVVGEEVGEAGTKRACEIGPKGDLALVLDTSENQALGQGGVITGWITVKSKNTIHDGARSQTIHAGGGLFGASAIEKMTKVIQSLNELERHWGVMKKSPGMPPGANTINPAVIEGGRHPAFIADECRLWITVHYLPNESYESVVNEIERYLNKVAEADVWLRENPLEFEWGGTSMIEDKGEIFPSFTVPTHHPGFKQLEEAHEHIHNKKLEHGMSTTVTDGGWTAHFGIPTILYGPGSLEEAHSVDEKIKAKELAQYSDVLYTFLKEWYEHPQSYKSS

SEQ ID NO: 4601 - protein, 471 aa, Staphylococcus epidermidis
VNAFIFVSLRRKLMAKQLQRELNNRHIQLIAIGGVIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFIFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 4602 - protein, 661 aa, Staphylococcus epidermidis
MYAFTIIVRKRSVHTMKILAITSCPNGIAHTYMAQEKLEQAAKDMGVDIKVETQGGVGAENVLTSKEIKEADGIIIAADRQVDLSRFNGKPLINESVREGIHRPKELIQRVIDQDAQIYHDQNISSNISRDQEEPHKSNIQMVYQHLMNGVSFMVPFIVVGGLLIAIALTLGGHTTPKGLVITEDSFWKSIENIGSLSFKFMVPILAGYIAVSIADKPGLVPGMIGGAIAADGSLYGSEAGAGFVGGIVAGFLAGYIAKWIKQIKVPKAMAPIMPIIIIPILSSLIVGLIFIFVIGTPISNIFGALTSWLKGMQGANIIILALIIGAMIAFDMGGPVNKVAFLFGSALITEGNYTVMGMVAVAVCTPPIGLGLATFVRKHQFNKAEQEMGKASFTMGLFGITEGAIPFAAQDPLRIIPANMIGAMIASVIAAVGGVGDKVAHGGPIVAVLGGISNILWFFIAVVVGSLVTMFTVLLFKRHTPAIAKSNNGNDTSVGTENVFSDDQSINHSKQLSHHMVFDKSLIEITKEPMTRDQAIDRLLTKLCHRHYITNIEEVRTAILKREAESTTAIGMNVAIPHAKSHAVKRPIVAVLNHKAGVEWESLDESNPQLIFLIAVPNDNNDTHLKLLQRLSRTLMKDNTRDELIHAQSRDEIFNILKEI

SEQ ID NO: 4603 - protein, 41 aa, Staphylococcus epidermidis
IKKPVNEFIKTHLLAILLGIMSQLPVSIIILFYLIYNQLNR

SEQ ID NO: 4604 - protein, 304 aa, Staphylococcus epidermidis
LLQFIFAISSYTGLKKGIQKLSDVNVWLSFLLLAFVFIVGPTVFIMETTVTGFGNMIKDFFHMATWMEPFGGIKGRKETNFPQDWTIFYWSWWLVYAPFIGLFIARISKGRTLKEVVLGTICYGTLGCVLFFGIFGNYAVYLQITEQFNVISYLNNYGTEATIIEIMHQLPFSTITIILFLISAFLFLATTFDSGSYILAAASQKKVIGEPLRANRLFWAFALCLLPFSLMLVGGERALEVLKTASLLASVPLIVIFTLMMISFLIILGRDRIKLERRADKHKEIERRSLRIVQVKDKPEDDNL

SEQ ID NO: 4605 - protein, 301 aa, Staphylococcus epidermidis
KEQLTEDNVQSIEGFDGLSLSQTLPLSETIYNKLNQLGIRQIAQRSAGFDGYNLELASKYGLIISNVPSYSPRSIAEFTVTQAINIVRHFNHIQRKMRLHDFRWEASILSQSIKDLKVAVIGTGHIGGIVAQIFSEGYLCDVVAYDPFPSEHVKPYVTYKQSINEAIKEADIVTIHMPSTQYNNYLFNENMFQMFKKGAVFVNCARGSLVDTKALLSAIEQGQIKGAALDTYEYEIGVYTTDRSEEGLNDPLLEELITREDIIVTPHIAFYTEEAIKHLIFDALDATMEVLNTGTTELRVN

SEQ ID NO: 4606 - protein, 156 aa, Staphylococcus epidermidis
YIKLSVIQKQGVFIMANSIYSTTMISNGGRDGRVFSPDNTFVQNLATPKEMGGQGGNDTNPEQLFAAGYSACFNSALSLILSQNKISDANPEVEITIELLKDDTDNGFKLGADIKVTLENMSQQDAEKFVEQAHQFCPYSKATRGNIDVQLDVTAQ

SEQ ID NO: 4607 - protein, 70 aa, Staphylococcus epidermidis
NVKLLITEGGLFMFTISIIAMIIGVVLIVLSQIIYHSKPIDAKEKMFIPGVCLFLVGLLSLIGHFVNGYV

SEQ ID NO: 4608 - protein, 54 aa, Staphylococcus epidermidis
LLFTNNLISFIIVLYKEEDKMKQNLQTARRNLNSPNIKTRKRALKIIKQHQRSK

SEQ ID NO: 4609 - protein, 94 aa, Staphylococcus epidermidis
ERITLPAPIARTTKATLTSECSKSGNTMPVVDTAATVADPNEILKTAATIHANKMGDMLVPSNILAIVSPTPPSMSTCLNVPPPPMMSNIMPIG

SEQ ID NO: 4610 - protein, 282 aa, Staphylococcus epidermidis
LCEFESEGKISMNTLDSKYELKSKKHRQRIIKNWVIVTVVAAVIIWAFAGIPGLELKSKSIEILKSIFYGLFHPDLSYIYIPDGEDLLRGLLETFAIAVIGTFIASIICIPFAFLGAKNMMKLRPVTGISKFILSIIRVFPEIVMALIFIKAVGPGSFSGVLALGIHSVGMLGKLFVEDIESLDFSAVESLKASGANKMKTLMFAVIPQILPSFISLILYRFELNLRSASILGLIGAGGIGTPLIFALQTRSWDRVGMILIGLIAMVALVDLISGAVRKRIV

SEQ ID NO: 4611 - protein, 59 aa, Staphylococcus epidermidis
LFATFIYLILFEQVKYTFTCVQFIKSIHKILFLINSMAYYTFLYFIIHIFNTNLVIKTF

SEQ ID NO: 4612 - protein, 482 aa, Staphylococcus epidermidis
KAYTFSIPPSKGEMNMNDTGDKRLSRTSLIGLVIGSMIGGGAFNIQSDMGGHAGGLAIIIGWLITAIGMISLALVFQNLTNERSDLDGGIYSYAQAGFGDFIGFASAWGYWFSAFLGNVAYATLLMSSIGNFFPIFKGGNTFPSIIVASILLWSVHFLILKGVETAALINSIVTITKLIPILLVIICMIVAFNFNTFRIGFFGMDGYGSLSFHFANTMSQVKSTMLVTVWVFIGIEGAVVFSGRAKNKKDVGTATVIGLISVLLIYFLLTVLAQGIVIQNHISKLEAPSMAQILAYIVGDWGATFVNIGLIISVLGAWLGWTLLAGELPFIVAKDGLFPKWFAKENKNGAPMNALFITNVLVQIFLISMLFTKSAYHFAFSLAASAILYPYMFSAFYQVKYTIEYKLTATPKQWIIGILASIYAIWLVYASGIDYLLLTMLLYIPGIIVYVVVQKNNQKRLTQFDYIFFGLIVILALIGLLR

SEQ ID NO: 4613 - protein, 71 aa, Staphylococcus epidermidis
YLHTFLKKPGSANGIVSMMGGIGGFFPPLVITFVTSITGSSHLAFFFLAIFGVIALITMIHLNKKEKAIRI

SEQ ID NO: 4614 - protein, 45 aa, Staphylococcus epidermidis
APNTMNAEGTSKINTIIVLENLVKFFGITVNALNPFFLIGVSINL

SEQ ID NO: 4615 - protein, 794 aa, Staphylococcus epidermidis
MANTTLTLDIIGMTCAACSNRIEKKLNRMNHVQAKVNLTTEKATIDYESDDYHLEDFVEQIQSLGYDVAVEQVELNINGMTCAACSNRIEKVLNQTQGVQQATVNLTTEQALIKYYPSATNTEALIKRIQNIGYDAETKTSSKAQSNRKKQELKHKRNKLIISAILSLPLLLVMVVHISPISIPSILVNPWVQLILSTPVQFIIGWQFYVGAYKNLRNGSANMDVLVAVGTSAAYFYSIYEMMMWLTHQTHHPHLYFETSAILITLILLGKYLEARAKSQTTNALSELLNLQAKEARVIKENKEIMLPLDKVKVGDTLLIKPGEKIPVDGKVTKGDTSIDESMLTGESIPVEKSSGDSVIGSTMNKNGSIMIEATQVGGDTALSHIIKVVEDAQSSKAPIQRLADIISGYFVPIVVSIAVITFIIWIIFVHPGQFEPALVSAISVLVIACPCALGLATPTSIMVGTGRAAENGILFKGGQFVERAHYVDTIVLDKTGTITNGQPVVTDYVGDNDTLQLLASAENASEHPLADAIVTYAKDKGLNLLDNDTFKSIPGHGIKATIHQQQILVGNRKLMNDYNISISNKLNDQLNHYEHLSQTAMMIAVDNQINGIIAVADTVKNDAKQAIKELRNMNIDVVMLTGDNNRTAQTIAKQVGIEHVIAEVLPEEKAHQISLLQDKGKQVAMVGDGINDAPALVKADIGMAIGTGAEVAIEAADITILGGDLLLVPKAIKASKATIKNIRQNLFWAFGYNVAGIPIAACGLLAPWIAGAAMALSSVSVVMNALRLKKMKL

SEQ ID NO: 4616 - protein, 54 aa, Staphylococcus epidermidis
DSGTLQTCTKRVNGQHANTVNPNNMCSLNDQGTFNIKSAFGENMNKCLNHIAMV

SEQ ID NO: 4617 - protein, 41 aa, Staphylococcus epidermidis
PYVTFYPPQFNALLLVYKYVNIQKFVLQALSFRCFDILNTI

SEQ ID NO: 4618 - protein, 45 aa, Staphylococcus epidermidis
RAYTYDMADSLIISFTFVYSGFIQNITNETRLFYSLIQEVDRHLF

SEQ ID NO: 4619 - protein, 112 aa, Staphylococcus epidermidis
CIRFHIINLITLFILSYYIINNLIPFTILIINNTSEAISRIPPIITPITSTATPFVESIKDSPAANDISPNTKHTQLKIWLNNAFLEYVDAGGCPTIHTINGNNTGAKNTLR

SEQ ID NO: 4620 - protein, 47 aa, Staphylococcus epidermidis
GYLTIFKIYNLILKRFISIMIYIHKKREVKQIVTHYSVCCAYSLARN

SEQ ID NO: 4621 - protein, 58 aa, Staphylococcus epidermidis
TKLTRCLMYKNYKMTKHTLLMETSVLIPTNDISRHVNVIAETIPETEFDKFRHYRCLI

SEQ ID NO: 4622 - protein, 58 aa, Staphylococcus epidermidis
TKLTRCLMYKEYNLTQHTLPMETSVLIPTNDISRHVNDIVETIPDTEFDEFRHHRGLI

SEQ ID NO: 4623 - protein, 69 aa, Staphylococcus epidermidis
TKLTRCLMYKDYNVTQLTLPMKTSFFIPANDISRHANDIVETIPETEFDELRHHRGATSYHSKMILKEL

SEQ ID NO: 4624 - protein, 58 aa, Staphylococcus epidermidis
TKLTRCLMYKDYNMTQHTLLMETSVLIPTNDISRHVNDIAETIPDTEFDEFRHYRGLI

SEQ ID NO: 4625 - protein, 58 aa, Staphylococcus epidermidis
TKLTRCLMYKDYNMIQHTLLMGTSVLIPTNNISRHVNDIVETIPDTEFDEFRHPRGLI

SEQ ID NO: 4626 - protein, 58 aa, Staphylococcus epidermidis
TKLTRCLMYKDYNMTQHTLLMETSVLISTNDISRHVNDIAETIHYTEFDEFRHPRGLI

SEQ ID NO: 4627 - protein, 58 aa, Staphylococcus epidermidis
TKLTRCLMYKDYNMTQHTLLMETSVLISTNDISRHVNDIAETIPDTEFDEFRHYRGLI

SEQ ID NO: 4628 - protein, 435 aa, Staphylococcus epidermidis
KRLTHRRCITMSENIIMPKLGMTMKEGTVEEWFKSEGDTVKQGESIVTISSEKLTNDVEAPASGTLLEIKVQAGEDAEVKAVLGIIGEEGEAIDKDEDDLASEKVKEDNEHEKETQEVKDTSQPSSDNKDNSPKSAARERIFISPLARNMAEDKGLDINKIKGTGGNHRITKLDIQRVEANGYDYASDTTSNEDTSHVPTQTVDTSAIGEGLNPMRQRIAQNMRQSLNSTAQLTLHRKVDADRLLDFKDRLATELKQADQDVKLTVTTLLAKAVVLALKEYGAMNARYEQGELTEYEDVHLGIATSLDEGLMVPVINHADTKSIGTLAHEIKSSAEAVREGNTGAVQLEGATFTITNMGASGIEYFTPILNLGETGILGVGALTKEVVLEADNIKQVSKIPLSLTFDHQILDGAGAADFLKVLAKYIENPYLLML

SEQ ID NO: 4629 - protein, 58 aa, Staphylococcus epidermidis
PLITLCKLLSTLLLHHKIKRMPITFMKSYKYHWQTYNFESLLFFFSKMYKKYCPMIQL

SEQ ID NO: 4630 - protein, 46 aa, Staphylococcus epidermidis
FKITNHTIPSQFIFYKHRFYIKNKLASLYIKTNSNIISLYIFKNVV

SEQ ID NO: 4631 - protein, 98 aa, Staphylococcus epidermidis
KWITPILFIDIVIFTPIIEELLFRHLIIHELGKKLTYGLMYIVSIVGFTYFHCTDAVSPFEAGPYFIAAVVFVIGYHFSHRNLAVPIALHMITNLIAF

SEQ ID NO: 4632 - protein, 74 aa, Staphylococcus epidermidis
NFSTPFTYIYVYVRNNYVSVSQTTTREDYIMSGIVESLHNAVNAGLHVKQDWVDMGFGIADTVAKIVDQVLKFV

SEQ ID NO: 4633 - protein, 63 aa, Staphylococcus epidermidis
WSPTGIFNKMPKMTIKVMIVKNIKIIFQLAIDKARPPNSGAMMVIIPFMTIREVKNFANLFPS

SEQ ID NO: 4634 - protein, 46 aa, Staphylococcus epidermidis
YITTFMLNCAFNFYFREKRCLEGIHIYRYIGGIFNGFTLCYKFKTS

SEQ ID NO: 4635 - protein, 43 aa, Staphylococcus epidermidis
NFTTFFWKIYLLLIAKYHHSLMYTSFLFNEYSNIDTLKKFKKP

SEQ ID NO: 4636 - protein, 806 aa, Staphylococcus epidermidis
THQTITGVIRMAKGVNQIINNIRLRKLRKILNQINALSEEFSNFSDEALQAKTKEFKVYLNDNKASLNHILPQAYATVREASKRVLGMYPKDVQILGAIAMHQGNIAEMQTGEGKTLTATMLLYLNALTGKGAYLITTNDYLAKRDFLEMKPLYEWLGLSVSLGFVDIPEYEYAENEKYELYHHDIVYTTNGRLGFDYLIDNLADDIRAKFLPKLNFAIIDEVDSIILDAAQTPLVISGAPRVQSNLFHIVKTFVETLEKDKDFIVNFNKKEVWLTDEGSEKASHYFKVNSIYQQQYFDLVRMIHLSLRAKYLFKYNLDYFIFDGEIVLIDRITGRMLPGTKLQSGLHQAIEALENVEISQDMSVMATITFQNLFKQFDEFSGMTGTGKLGEKEFFDLYSKVVIEIPTHSPIERDDRPDRVFANGDKKNDAILKTVIGIHETQQPVLLITRTAEAAEYFSAELFKRDIPNNLLIAQNVAKEAQMIAEAGQLSAVTVATSMAGRGTDIKLSKEVHDIGGLAVIINEHMDNSRVDRQLRGRSGRQGDPGYSQIFVSLDDDLVKRWSNSNLAENKNLQTMDASKLESSALFKKRVKSIVNKAQRVSEETAMKNREMANEFEKSISVQRDKIYAERNHILEASDFDDFNFEQLARDVFTKDVKNLDLSSERALVNYIYENLSFVFDEDVSNINMQNDEEIIQFLIQQFTQQFNNRLEVAADSYLKLRFIQKSILKAIDSEWIEQVDNLQQLKASVNNRQNGQRNVIFEYHKVALETYEYMSEDIKRKMVRNLCLSILAFDKDGDMVIHFP

SEQ ID NO: 4637 - protein, 524 aa, Staphylococcus epidermidis
NIKTHSRGECMSKILLTGASGYIGNHLKNKLKKDHEVIAISRNTHNKTDEENVTWKSADLFDLDEVTKVMKDVDTAIYLVHSMMPSAKLTQASFEDMDALLADNFARAAQKQGVKHIVYMSGLIPENDELSAHLRSRLECEKILGDYGIPVSTLRAGLIIGAKGSSYPILKRLVERLPAMVLPSWAYNKIAPVAIDDVIDGLAALVNRTPKDNEAIDITGPEVMNYKTLIQRTANVLDKRLPMLDLPIIPIIVSRYWVQLISNVPKEMVYPLMNSLTHDMVPHRKRVVSNLSVGNITFEDSVKRALREEQKTSKKKSDSKNSQSFGLMHQEIKDVRAITRFKIPEGYSIKDVTKEYAKFINNITLHIVKGTINEREFNMNLPFINKFILKMERDEADSTEDMVVYNIVGGDLAHSNDGGNARFEFRRIRNTNEGIIALQEYEPTLPWVVYKLTQAKAHKTVMNIFKNKMARLAQQKNVKDETYMSNRVTIGVTVASAFVIGSAVGFQLFKKHQIKKNTMSNAEL

SEQ ID NO: 4638 - protein, 389 aa, Staphylococcus epidermidis
KMKTVSKYFVYMMILVTFFIVVSGCSINQSFSDKQNTNKTIRVVAVGDNLIHPVVYKDAQITGNSFDFKPMYQPVKKDIQNADISFVNQESPLGGDDRPYSGFKNFNTPSSIAQDLVDTGFNFVNGANNHALDQGEQGVRNHIHTWNKFKYQVLFTGVYESEQAHRQIPIKTIKGVKVALLSYTFGTNDHQPTHDYTVDTFDENKIKQDVKKAKQQSDVVLVSAHWGNEGKHQPNATQKKYAQIFADAGVDVVLGTHPHVIQPVKWVDGREGNRTLVAYSLGNFLNGQSTGNESNDLLGRIDFKISKKDKQFQVQDVKWRSMVNYYELTQHQNQFLKSNFKVMMLDDYNDKDATHHGRNQMDSSSMSPAHLRDITRSVIDKQYLDNRSL

SEQ ID NO: 4639 - protein, 178 aa, Staphylococcus epidermidis
MLETHRLKLVKPNLSYTDELYQLHTNKVATKYTPKGIHQNKVATQDFIKGWMRHWDEYQFGYFILIMRDNHEVVGIAGFEYRTIHQQQFLNAYYRIFPSYTGVGLAFESMEEIARHLKKHDTITPKLIRTNQYNTNSIKLAQKLGYNYDANWDDVINKGDRCFLTYKRWIITKSMMNS

SEQ ID NO: 4640 - protein, 241 aa, Staphylococcus epidermidis
VDRTINDRSGYKMNYSPKQGVKSHGLPHDPFKSSTVPRPIGWISTVSKEGKDNLAPYSQYQNLTWDPPMVMFAANQSVLGDHERKDTVKNAEETGWFVWNMATYDLREAVNLSSKALPPEDDEFDFAGVTKESCIEAPGSRVKESPVHFECEYVQTVRIPTGDPVSTVDVVIGRVAQVHIDDKVIMDNGKLDIKSIRPIARLGYYDYTVVDEIFEMKAPAASKEELAGLEGRNFDNTNNES

SEQ ID NO: 4641 - protein, 60 aa, Staphylococcus epidermidis
NTRTHIINAWDTLNVSGIFIYGNRCINRKYNELYQIFKLSYTSEEHKVLFNLCSTSFIYT

SEQ ID NO: 4642 - protein, 676 aa, Staphylococcus epidermidis
MKRTDKIGVYLKLSCSALLLSGSLVGYGFTKDAFADSESTSSNVENTSNSNSIADKIQQAKDDIKDLKELSDADIKSFEERLDKVDNQSSIDRIINDAKDKNNHLKSTDSSATSSKTEDDDTSEKDNDDMTKDLDKILSDLDSIAKNVDNRQQGENSASKPSDSTTDEKDDSNNKVHDTNASTRNATTDDSEESVIDKLDKIQQDFKSDSNNKLSEQSDQQASPSNKNENNKEESSTTTNQSDSDSKDDKSNDGRRSTLERIASDTDQIRDSKDQHVTDEKQDIQAITRSLQGSDKIEKALAKVQSDNQPLDSNYINNKLMNLRSLDTKVEDNNTLSDDKKQALKQEIDKTKQSIDRQRNIIIDQLNGASNKKQATEDILNSVFSKNEVEDIMKRIKTNGRSNEDIANQIAKQIDGLALTSSDDILKSMLDQSKDKESLIKQLLTTRLGNDEADRIAKKLLSQNLSNSQIVEQLKRHFNSQGTATADDILNGVINDAKDKRQAIETILQTRINKDKAKIIADVIARVQKDKSDIMDLIHSAIEGKANDLLDIEKRAKQAKKDLEYILDPIKNRPSLLDRINKGVGDSNSIFDRPSLLDKLHSRGSILDKLDHSAPENGLSLDNKGGLLSDLFDDDGNISLPATGEVIKQHWIPVAVVLMSLGGALIFMARRKKHQN

SEQ ID NO: 4643 - protein, 201 aa, Staphylococcus epidermidis
NGGTRMIQRKGELILSWIGNGLHLLYVFLVGIFFIMTQTSEFKNGMIQGFIEENPGEYDLAYQTYNLMLGLGVVFIIILLILLIVSIVAAILIGKNAKVSGILLVITGIIGLFLSFIAGALWLIAGIMLLVRKPQTQNDQINSQYSNDIHSHVVPEEKKREQQQYNMNEPHIGQSSTSHHDHALNDQNKRENHNHDNQPYK

SEQ ID NO: 4644 - protein, 400 aa, Staphylococcus epidermidis
KGGTTTMLTVGIIPSPGIAHQHVKKIIPNVKQLLSKRTKHSQWNFDIKVDLMIGSAEDVHESVEKAAQIKEEHQWDYVVCLTDLPSISDNKVVVSDFNSDKHVAMLSLPSLGFIDLKRKLVKTMTSLIEQLYYNQPKDKNAPHPFVRVKAVEPDEDATSKQRYINILFIISWIQLIGGLTRANQPWKNIFNFKKIISVAFATGTYVSIFSMPWELSVIYSPLRLIILMVIAILGMAGWLFYAHQLIEKKTAKSQRVYRYIYNSTTLVTLSLITLINYVILYLLLIISITLFVPVELFNSWTSAQSQFTFSNYMRLIWFVSSLGLLAGAMGSTVENEEKIRRITYSYRQYHRYKEAEQEQKEQETSRDVSQQNVEQQTSSKDENNEQYEGKKQGHREEDDA

SEQ ID NO: 4645 - protein, 46 aa, Staphylococcus epidermidis
NFLTISYGLSATCNPHSVLLELDQRPARESLESNTGDVHGMQPILG

SEQ ID NO: 4646 - protein, 330 aa, Staphylococcus epidermidis
LKLTKEEHRFMDYRVLLYYKYVTIDDPETFAAEHLKFCKEHHLKGRILVSTEGINGTLSGTKEDTDKYIEHMHADSRFADLTFKIDEAESHAFKKMHVRPRREIVALDLEEDINPREITGKYYSPKEFKAALEDENTVILDARNDYEYDLGHFRGAIRPDITRFRDLPEWVRNNKEQLDGKNIVTYCTGGIRCEKFSGWLVKEGFENVGQLHGGIATYGKDPETKGLYWDGKMYVFDERFSVDVNQIDKTVIGKEHFDGTPCERYINCANPECNKQILVSEENEEKYLGACSYDCAKHERNRYVARHHISNEEWQRRLNNFKDVPEHTHA

SEQ ID NO: 4647 - protein, 321 aa, Staphylococcus epidermidis
EELTMKMEKEQAHWIYKTMNEIRFFEEKVHKIFSDGRIPGFVHLYVGEEAVATGVMSQLNDDDYITSTHRGHGHAIAKGCDLNGMMAEIMGKRDGLGHGKGGSMHVAEIDKGMLGANGIVSGGFGLAIGASISIINQGKDNVAVCFFGDGAANECNFHEGLNFASILDLPVLFICENNQFAEGTTHDYASASETIAERAAAYNMPGVRVDGMDVMEVYKATQEAVERAKKGEGPTLIECDTYRKYGHFEGDEQKVKSPDDRNADKNATVEFRKRAIEENWLTEKEADEIEKAAEQAVEDAVKFAEESELPDEDSLYKDVFA

SEQ ID NO: 4648 - protein, 288 aa, Staphylococcus epidermidis
SNMTKVITTINEMQSIVKQHQREGKTIGFVPTMGALHDGHLTMMKQSVSENDLTVISIFVNPLQFGPNEDFDAYPRQLDDDVAAVKKLQVDYVFHPSVDEMYPEELGIHLKVGHLAQVLEGAQRPGHFEGVVTVVNKLFNIVQPDYAYFGKKDAQQLAIVEKMVKDFNLPVHVIGIDIVREKDGLAKSSRNIYLTSEERKEAKHLYQSLRLAKNLYEAGERDSNEIIGQIAAYLNKNISGHIDDLGIYSYPNLIQQSKIHGRIFISLAVKFSKARLIDNIIIGDDYID

SEQ ID NO: 4649 - protein, 656 aa, Staphylococcus epidermidis
LCMTHITESEMKQKYLDLLSQKFDSAEKLATEIINLESILELPKGTEHFVSDLHGEYESFQHVLRNGSGNVRAKINDIFKDKLSQQEINDLAALVYYPEEKLKLVKNNFDSIGTLNIWYITTIQRLIDLITYCSSKYTRSKLRKALPEQYVYIIEELLYKSNEFHNKKPYYETLVNQIIELEQSDDLIIGLSYTVQRLVVDHLHVVGDIYDRGPKPDKIMDTLINYHSVDIQWGNHDVLWIGAYAGSKVCLANLLRICARYDNLDIIEDAYGINLRPLLTLAEKYYDAENPAFKPKKRPDKDVSLTKREESQITKIHQAIAMIQFKLEMPIIKRRPSFEMEERLVLEKIDYDNNEITIYNKTYPLKDTCFQTVNPNNPAELLAEEKEVMDKLLLSFQQSEKLRRHMSFLMRKGKLYLPYNGNLLIHGCIPVDENGEMESFEIEGERLSGRELLDVFEYHVRRAFDHKESTEDISTDLVWYLWTGKYSSLFGKRAMTTFERYFIEDKASHKEEKNPYYYLREDVDMIRKMLKDFGLNPDEGRIINGHTPVKEIDGEDPIKANGKMLVIDGGFSKAYQSTTGIAGYTLLYNSFGMQLVAHKEFNRKEKVLSMGADELSVKRVVDEELQRKKIRDTNIGKQLQDQIDILKILMHDRYLT

SEQ ID NO: 4650 - protein, 332 aa, Staphylococcus epidermidis
FLMTKIMFFGTRAYEKDMALRWGKKNNIDVTTSTELLSVDTVDQLKDYDGVTTMQFGKLEPEVYPKLESYGIKQIAQRTAGFDMYDLELAKKHEIIISNIPSYSPETIAEYSVSIALQLVRKFPTIEKRVQAHNFTWASPIMSRPVKNMTVAIIGTGRIGAATGKIYAGFGARVVGYDAYPNHSLSFLEYKETVEDAIKDADIISLHVPANKDSFHLFDNNMFKNVKKGAVLVNAARGAVINTPDLIEAVNNGTLSGAAIDTYENEANYFTFDCSNQTIDDPILLDLIRNENILVTPHIAFFSDEAVQNLVEGGLNAALSVINTGTCDTRLN

SEQ ID NO: 4651 - protein, 70 aa, Staphylococcus epidermidis
ASMTYISLSQKIRNANILNYQKIFTNLKIISILITILLILIYFKTIAVDSFIASYVDSYIKKSHYWEGTQ

SEQ ID NO: 4652 - protein, 295 aa, Staphylococcus epidermidis
VKVTQNENLKLAQRGAFLSLVIYIILSIAKYMTGYVYDSAAVRADALNNMTDILVSVAVIVGLKISIKPADQNHPYGHLKSENISTLLVSFIIMFVGIQVIIENFPRLFTHDSHIPNFITIIISMISGLVMLCVFAINYRLSKRTKSSSLKSAAKDNLSDSLVSIGTAIGLMFTQIGFPIIDIILANILGLLIVYTGFGIFKESIFTLSDGFNEQDLEEYRLDILEVEDVIDVNNIKGRYHGSSIFIDVTIVVDPYLSLYEAHQICDKVEIHLHNKGISSVYVHPEPYTTKDEVK

SEQ ID NO: 4653 - protein, 353 aa, Staphylococcus epidermidis
LMSTIKNIDGPKDFVFRVLSGVAIGIVAGLVPNAILGEIFKYFMQYHPIFKTLLGVVQAIQFTVPALIGALIAMKFNMTPLAIAVVASASYVGSGAAQFKQGTWVIAGIGDLINTMLTASIAVLLILLIKKRVGSMALIVFPTVVGGLAATIGVFTLPYVRLITTGIGNMVNSFTELQPVFMSMLISMVFSFIIISPLSTVAIAIAIGLSGIAAGSASIGIAATEAVLLIGTSKVNHVGIPLSIFFGGVKMMMPNMVKYPVIMIPIFLTAAISGIASGIIGISGTKESAGFGFIGMVGPINAFKFMHVDSAWLSLLLIVIAFFVVPFLVAWILDLILRRLIHLYENDIFKFMG

SEQ ID NO: 4654 - protein, 160 aa, Staphylococcus epidermidis
EKATTMKKVISLLVVLVISAVSLSACGKERTKTYEGEVNGKQVITSLTYKDDEVLKQSTIATIKYDDLGIDKDEAKQMFKNDEQAFKGIDGVTYKADFKDRKAIEHIDIDYKDADIDQLKKNLGFISSDAKKGDHVSVDRVVKQLKRNGLKDKSKMNEDN

SEQ ID NO: 4655 - protein, 40 aa, Staphylococcus epidermidis
KSETDSFQIRRLAPLQLTMIRNSQQQAFFNSFIYNKSLKH

SEQ ID NO: 4656 - protein, 46 aa, Staphylococcus epidermidis
ESETTIRGIINKKPVNEFIKNPFTGYFARNYVPASPFNFNICKINI

SEQ ID NO: 4657 - protein, 361 aa, Staphylococcus epidermidis
RNGTDSMKKNKLELVYLRAFICVIIIVTHLLTQITLENEQMSDSSLILQYYIRNIFIFGTPSFIILSQLLTTLNYESVTINYLFSRFKYIFIPYLLIGLFYSYSESLITASSFKKQFIENVVLGQWYGYFIIIIMQFFVLSYIIYKINFRLFNSKILLLLAFIVQQSYLHYFLNNDTFHQFMTHYYPLSENTMILGWIFYFFLGGYIGYNYEKILSFLEKYLIIVIMLTLGAYVLFIAVSGSDYWNVTSFTYTLTLYNSVMFFLLLGVCMHFKTMLLNTIKAISAFSFFIYLLHPIILDSLFAYTNIFEDNTIVFLAISLLMILGICIGVGMMLREFYIFRFVIGKQPYKLQFDQYQPNWN

SEQ ID NO: 4658 - protein, 50 aa, Staphylococcus epidermidis
NNFLKNGGVLKLTRINDFNEVLNSRKSLKVFDENYKIPREEMDEIITKAT

SEQ ID NO: 4659 - protein, 45 aa, Staphylococcus epidermidis
NLYLIMKNRFTYADKDRLLRYLLIKMKAYVRYSIATEEQLLLLEK

SEQ ID NO: 4660 - protein, 45 aa, Staphylococcus epidermidis
LFVAFIKPMSKKRNGTATDDWRYDVNENKHHFIHLLSASKLTPER

SEQ ID NO: 4661 - protein, 48 aa, Staphylococcus epidermidis
GPYFSKYFNVKLHMNIKYFGETLEGTGQAEDYRLKLSPKKASQQYVVL

SEQ ID NO: 4662 - protein, 66 aa, Staphylococcus epidermidis
TRSASYNKTPKYLIRPVQVSEQTVGIPASIRGKQNVHFSALFVFQLKYTFLYGHPVIQYLQPRQAS

SEQ ID NO: 4663 - protein, 51 aa, Staphylococcus epidermidis
DYYFRKIPLYITGINKIKPKSPMIGNTLPMREMNPTKVQANVIIAIITIRI

SEQ ID NO: 4664 - protein, 53 aa, Staphylococcus epidermidis
KSAAIASCFILIINSGLNSNVYIKTTVTTNIIAGINRLNLLSQKLTKLIELFL

SEQ ID NO: 4665 - protein, 527 aa, Staphylococcus epidermidis
TNYLCLSKRWGAYIVSKTNLGEKWGLLAGGSLLVDYILTVAVSISSGADAFVAAFPHLYHFKVLIACLLVLFILMMNLRGLTESATVLSYPVYLFIIGLIVLIVVGTFRVATGQIAPHIHSTVGSTVPGVTLFLLLKAFSSGASSLTGVEAISNAVTNFKNPAPKNAVKTLVTMGTILAVLLVGIVVLSYIYGIMPQTETTVLSQLASQIFGENVAFYFIQATTVMILVLAANTGFTAFPMLAASMSKDKYMPRMFTVRGDRLGYSNSIIILGVLAIILIILFEGMTENLIPLYAVGVFIPFTLAQFGMVLKWLRERPERWGIKLTINLIGGTITFIVFMILLITKLNQVWPILLFLPFIVFIFIRIHVHYENIACELRSEIDIHDIPVVDRNLAIVPIQSITTVVDKSIYYAKLLANDDVIAVHVTFGDEDEQAFMTKWKKHFPDVRLVILHSEYRSIIHPISRFIDKIRKKANDKNYLITVVVPEFIPKKAWQHLLHNQTSLRLKLHLIYQKNVTLCTIPFKLIK

SEQ ID NO: 4666 - protein, 50 aa, Staphylococcus epidermidis
LNNALLFVKIIKPPTQIARMLMGNTLTKYAEIGAATIPPRLKAITANQLI

SEQ ID NO: 4667 - protein, 330 aa, Staphylococcus epidermidis
HSYLCNFIMKEFVKMKKFGKKVVLVGDGSVGSSYAFAMVTQGIADEFVIIDIAKDKVEADVKDLNHGALYSSSPVTVKAGEYEDCKDADLVVITAGAPQKPGETRLQLVEKNTKIMKSIVTSVMDSGFDGFFLIAANPVDILTRYVKEVTGLPAERVIGSGTVLDSARFRYLISKELGVTSSSVHASIIGEHGDSELAVWSQANVGGISVYDTLKEETGSDAKANEIYINTRDAAYDIIQAKGSTYYGIALALLRISKALLNNENSILTVSSQLNGQYGFNDVYLGLPTLINQNGAVKIYETPLNDNELQLLEKSVKTLEDTYDSIKHLV

SEQ ID NO: 4668 - protein, 88 aa, Staphylococcus epidermidis
IPSASTPENEPGPTALININAITISGNTRIMLNMNLLMPVTGRNFIIFLAPKNAKGIHIIEAMNVPITAIAKVSSKPLSKSSPSGIYM

SEQ ID NO: 4669 - protein, 192 aa, Staphylococcus epidermidis
NGGAMMDYNNNDSQYIEEAKDLVINSIGETMDLYGINRSVGNLYGIMVFEGSMTLDEMRQQLQMSKPSMSTGVKKLQEYDIVKQQFTRGSRKQHFIAEKDFFTFFRNFFTKKWEREIDTNMEAIEDAENIIHPLLEKNDIDEEVKKQAINVKAQLDHSKIYYKWLAQLSEALESGEIFNYFPIPDEQHHHDQ

SEQ ID NO: 4670 - protein, 86 aa, Staphylococcus epidermidis
VCIACLKCGFLMLRCYFNVFSFYQNGKLYLLKITKPVTWLWLDRHLQLNISNVKVTMIKQTPKLHLLILSREVDKKEYSLLQIPTK

SEQ ID NO: 4671 - protein, 316 aa, Staphylococcus epidermidis
WRYLLMSITYPGTVYLIGAGPGNPNLLTKKAERLIRSADVILFDRLVNPFILQYASSQTKVINVGKKPYCKHIQQEEINQKIVEAANQYQCVVRLKGGDPAIFGRITEEVQTLEDHHIHYEIVPGVTSASAAVATMNMGLTMRSIAPSVTFSTGHFKDSVNHDMDIRNLINGGTLAIYMGVKRLGQIIKQIESYTNEDYPIAIVFNASCYNEKIVIGHLSTIEEQLVSQQLEGHPGICILGNILDDINRTLLNNNKNDKGNLYLIKGDKERAIAKAETLYDEGIQCLIDFDHSYHISQQNVYNEMIKHKSIKTIYV

SEQ ID NO: 4672 - protein, 43 aa, Staphylococcus epidermidis
KLKAPVHTLMYRRLIYVLKYTLFYFELINGHVIDYLFIKQINL

SEQ ID NO: 4673 - protein, 198 aa, Staphylococcus epidermidis
RNGAYVMNYQIKRNTEETQLNISLANNGTQSHINTGVGFLDHMLTLFTFHSGLTLSIEATGDTYVDDHHITEDIGIVIGQLLLELIKTQQSFTRYGCSYVPMDEALARTVVDISGRPYFSFNSKLSAQKVGTFDTELVEEFFRALIINARLTVHIDLLRGGNTHHEIEAIFKSFARALKISLAQNEDGRIPSSKGVIE

SEQ ID NO: 4674 - protein, 146 aa, Staphylococcus epidermidis
FYLAGAISDKILNTGQSRFVARGVIAIAGFVVFSISIFLAVHTDNLYVTIFWLSLCLGGVRISMGMSWAAATDLGRNFSGTVSGWMNLWGNVGALISPLLAGIVVDHLGWSMTLQLLIVPAIIAAILWFFVKPDKPLIVSEEHVNK

SEQ ID NO: 4675 - protein, 45 aa, Staphylococcus epidermidis
KGLAALIAQSNEFTFKIAFNLSKKRYSVYYSIQINKITKGPNTLD

SEQ ID NO: 4676 - protein, 48 aa, Staphylococcus epidermidis
ILMAVLWAIIAKDLAEQHKMVNDAEKRLLIKIVILSQLRNLYHRGNVF

SEQ ID NO: 4677 - protein, 95 aa, Staphylococcus epidermidis
TSMAAEIKQGDHKFYVGNDENNPKAVITFKEVDNNEIDIDHTGVSDELGGQGLGKKLVNRVVEHARENNLKIIASCPFAKNVLEKDDHAQDVYLG

SEQ ID NO: 4678 - protein, 287 aa, Staphylococcus epidermidis
MKEAKMKKQQNKVHMINISLCLIGTLLIAIAVNSFVIPGNLGEGGSIGLSLILNYTLGISPALSSFIINAILIIVGWKFLSRTTAIYTAITITASSIFLDLTHTFGLGIHDNFINSIFAGLMLGIGSGLVITAHSTLGGTSVIARIISKYSEMKTSQALLILDAIIVLSFIVVLPITNVLYTIVMLFIVEKSMSFVVEGFNPKKAVTVISKYNKEISADIYEMTGRGATLLSGKGAYQKSDTEVLYAVVSQNQVGAIKKIVNQYDENAFLVIHDVRDVLGNGFINIK

SEQ ID NO: 4679 - protein, 181 aa, Staphylococcus epidermidis
YTHLRSWRNMYQSMYDSPVGLLQLITNDGISLSHVLYPNQHLKGIKTNDTLDVFKDTKAWLREYFKGNYPEIKVPLAPKGTDFQQKVWNELQTIRYRELKTYGEIAKTVGRAMNKPAMSAQAVGGAVGSNPISILIPCHRVVGKDGNLTGYGGTLDNKIKLLKLEEIDMTHLYRPKKTTKP

SEQ ID NO: 4680 - protein, 43 aa, Staphylococcus epidermidis
YSHLYFVWYNHFKYENVVRDFMNLEKSYIEQQVTNRGKSTAVS

SEQ ID NO: 4681 - protein, 54 aa, Staphylococcus epidermidis
VINLIDGSIYHFINMIYLIHKKSVELLLNKLIEKDTLYFLFLQSSFLFSITKRM

SEQ ID NO: 4682 - protein, 454 aa, Staphylococcus epidermidis
QLFYRDNLKVGIKLICSNCGAHLEKDDKFCVNCGQSVFDNPKTKTEHNFNSQDRQCPKCHKVVNVDDKFCINCGHSLQQTLSNSNDNIASHTYSNTKPEIENETADHIRLTEEAKHLFNNTTKSIGRLAGNDESLKLNLRDMFSEVFKSHTKDEADDVFIAGTKRTTPHINEVSEEWGRPWVFSRVFLALGITFLALWILTNIFDNANAIPGMIFIGALLVPISGLIFFFESNAFKNISIFDVMRMFFIGGVLSLISTMILYQFVTFSTESQYYGIMTITDAFIVGFVEELGKATVVILFINYLKTNKILNGLLIGAAVGAGFAVFESAGYIFRFGFNLFDGANNITEITIQRGWTALGSHLVWAAIVGAAAVIVKETKHFEWANIIDKRFIFFFFVAVTLHGIWDTEITLLSSGYLKYILLIMIAWLFIFILMKAGLTQVNQLRDEYNRLEER

SEQ ID NO: 4683 - protein, 70 aa, Staphylococcus epidermidis
SIIYIKDEFVMFILVNTILFIAIFGYTAMTLVKFFKRSKEGDCGGCKSNCKCDTNTSSHKNKLNIPHIKS

SEQ ID NO: 4684 - protein, 158 aa, Staphylococcus epidermidis
MSIYDIEVENYDGSTYLLKRYKGKVLIIVNTATNCTLNDQFNKLEMLYKKYHKYGLEILSFPCNDFNNQEPGLIKDIYRVYKYKFGITFPIHAKINVNGEHEHPLYTLLKCKQPGLFGSQIKWNFTKFVVDQQGNIVKRFLPCDNPNQMEKLIRQLLK

SEQ ID NO: 4685 - protein, 403 aa, Staphylococcus epidermidis
IKVYNNLEERIKMNQTLVQHLREKEQRMKEIRRYLHENPELSFEENETSKYIANFYKDKDCLVETNVGPNGIKVTIAGKHPGKTIAIRADFDALPIKEETELPYASKNEGVMHACGHDAHTAYMLILGETLIEMKDQLRGNVVIIHQPAEEMPPGGAKGMIDDGVLEGVDHVLGAHVMSMMETGKIYYREGFVQTGRAYFRLVVKGQGGHGSSPHTSNDAIVAGAHFVTTAQTIVSRRLNPFETGVVTIGSFDGKGQFNVIKDTITIEGDVRALTDDTRDNIQNEMTRLVRGLEEMFGVICDFEFKKDYPALYNDPEFTSYVATTLKNAKLDDIKAIDICEPQPPSEDFAFYALERPSTFIYSGAAPEDGPMYPHHHPKFNINETSMLVVAEAVGTIVLDYLK

SEQ ID NO: 4686 - protein, 48 aa, Staphylococcus epidermidis
LIYYIDVHNLSTITCNLIIYHTNIKSKEMMVIYIYYKIKNIDLYKNKG

SEQ ID NO: 4687 - protein, 60 aa, Staphylococcus epidermidis
WLNLKCAEVNLYIINSLKRYTTVDILINYYFFDVLTLYLLINIWNSLYLIVSLYIEVGMA

SEQ ID NO: 4688 - protein, 48 aa, Staphylococcus epidermidis
NIHYTIFLVYVYFRKDKKFLTYFKTTYKILLKSHYKISGFKMHQYFYN

SEQ ID NO: 4689 - protein, 431 aa, Staphylococcus epidermidis
SCNYIDKVKVLQFMKGGIMMSVLSNEERVEILSDIVSIKTVNSNELEVAQYFERLFSQYGIRSYIDIVADGRANLIATVGSSHPVIGISGHMDVVSEGNHDDWTYDPFTLTEDQGYLYGRGAADMKSGLAALAIALIEIKESGKLTQGTIKFMATVGEEMEQSGSQQLFEKGYADDLDALLIAEPSFPSLVYAHKGSMDFRIKSKGRASHSSIPFLGQNAIKPLLEFIQNINQEYEKIMQTVKGESLDFSNMINKLENQLPNHITKEKAQELIQGLVMTNSIVQGGTQVNSVPDFATAEFNVRTIPEYNNNKVKALFNKYVEQANHNGASLTQELYLDLEPVVTTGQNRLVELGFDIAKSHFSNERDLIITPTVAVTDASNLLKGKDENFPFLMFGPGNGPHQINECVEKVNYLEFVEYYIEFITSYLNEK

SEQ ID NO: 4690 - protein, 290 aa, Staphylococcus epidermidis
KVNLLKFHNKIKGYTQNRQPGIEADMEPKPIAELEEYKAAGKLENKVALITGGDSGIGRAIAILYAKEGANVAIGYYDEHQDAEDTVNRLQEMGVKAKAYAHDLKDEKQSQKLIKDVINDFGSLNILVNNGGVQFPRDHFEDITPQQVKETFMTNIFGMMFLSQAAVPYLSEGDTIINTTSVTAYKGSGHLIDYSATKGAIVSFTRSLATTLMEKGIRVNAVAPGPIYSPLIPATFDEEKVEHQGDETPMGRRGQPAELAPSYVFLATHADSSYITGQVIHVNGGDFITS

SEQ ID NO: 4691 - protein, 40 aa, Staphylococcus epidermidis
SFRYTRFVEKCGSYGQNQSDIGFLHHIKFQPLQLHVLYLP

SEQ ID NO: 4692 - protein, 51 aa, Staphylococcus epidermidis
DIRYFTSVLNEIFLVYNSIILTMSNLKSTITCSFLYLCEISQHFSGRYIYC

SEQ ID NO: 4693 - protein, 65 aa, Staphylococcus epidermidis
QQFYGSSLNQTNLLLLVKNTLINNIFQTHAMTFISLRVFILLLCGIEHGSDKRIVFFISYKLLNL

SEQ ID NO: 4694 - protein, 40 aa, Staphylococcus epidermidis
DIYYKWLNLLLVVDYHFDIDSVLKTLNQCYVNVNLCKFIP

SEQ ID NO: 4695 - protein, 51 aa, Staphylococcus epidermidis
QKCYGNKDIAEKLFVSVKTVEAHKTHIMTKLNLKSKPELVEYALKKKLLEF

SEQ ID NO: 4696 - protein, 695 aa, Staphylococcus epidermidis
RNLFNHAYLVKKLNSKIKIVGEIHGPLEYINENIDLALDCIDCVRVSTARIKNEFIAKYDYHRVFNQYVNAQHIDLKSEPINTKRNFLIKARFEDEVKDISYIIKLFNYIIKNQIVDDAQLYLIGYGPSEMLYKNLINYYHLNEYIHINEKEPQSYIYVSSSPYETLGYSILETIAQGNKALVYYGDDNVLKDIYAPYEAIRFLTKDMIKDSKIIKDFLNYKYSHFDRQKYYRQLESTFKCINYGQEFLNNVETFSSSQHVKVKKIHRHLGSEKQIDIASRLKESRWMNLIRKNKYLFNKCKTYYEKRTHMSYIKNLNQIPVDDDSIFIESFHGKNFSGDPKYIALAIKRQYDHKKIYVSSTNSLVDMEIKRYGFTPVRFGSEKYIKTFRKCKYVFINGNSWDKVYKSSDQIFVQTWHGFPLKKMVNDLNEQHERQQQLEAFIPRMKKWDYILTSSDINTTLLESAFMLNKNPNLKVLEYGAPKNEYLINNNNLQERQQLQLKYMYKIDDDKKYILYCPTWRGNQRKEVTQINLKDLLKYLPENYEIIVKLHPNESHLRTRYNQIDNRIHCYFNELVDIQELYILSECMITDYSSTIFDYIHLNKPVFILQEDEQQYKQSVGFYFDLFEVGDFLKASLNEHMLAKQICSTDYINYSKVVHRLMKQDSSKSSEKLMAEILGEPEYPSSSNCKQQIS

SEQ ID NO: 4697 - protein, 46 aa, Staphylococcus epidermidis
VKLYSLYIRHLVNLVYWYLLNYTKGLIFLSILARLLREQDKLKTTG

SEQ ID NO: 4698 - protein, 626 aa, Staphylococcus epidermidis
YTLYIAKGDEMTTLETSLTRLITKDPTILNENANKDSNTFSTMRDLTAGTVSKSYALDHLLPKHVAHAHQSGDIHFHDLDYHPFQPLTNCCLIDAKDMLENGFEIGNANVTTLQSIQTASAQLVQIIANVSSSQYGGCTVDRVDELLSKYAQMNAQHHREVANDFVQPDKIENYVDTQVTKDIGDAIESLEYEINTLYTSNGQTPFVTLGFGLGTDQLSRKIQQAILHTRIKGLGKDRVTAIFPKLVFSIKKGINFGPEDPNYDIKQLALECSTKRMYPDILNYDKLVELLGDFKAPMGCRSFLPSWKNDEGQLENNGRCNLGVVTLNVPRIAIEADGNMQQFWDIFEKRMQLLHDALVYRIERLQDAIPDNAPILYKSGAFKNKLTSEDTVDSLFTKQRATISMGYIGLYEAATLFYGPNWEHNPEAKTFTLDILREMKRYQVEWTKQYDIWFSIYSTPSESLTDRFCRLDKEKFGSIPDVTDKGYYQNSFHYDVRKDVTPFEKLDFEKDYPYYASGGFIHYCEYPKLNHNLKALEAVWDYAYDKVGYLGTNIPIDHCYRCGYDGDFETTANGYRCPHCGNTDPKTVDVVKRTCGYLGNPVQRPVIEGRQKEICARVKHMKALRS

SEQ ID NO: 4699 - protein, 560 aa, Staphylococcus epidermidis
YNVYFNFNKEEFVNMKNNWIDVLDESLVKDFYNNQTSEEQQEGLNTTLSFGTAGIRGKFGLGEGRLNKFTVSKVALGFAHYLTSSIAHPVVVIHYDTRHLSPEFAQIIANILASLDIKVYLADTYRTTPDLSFAVRYLQADAGVMITASHNPKDYNGIKVYGEDGAQLSTDDSARLSTYIDKLGHPLHINLPSLTTEQQSLIHSVPSEVREDYFKNVQDLVGTIPQSDLKVVFTSLHGTSVPVVPDILSSLNFNQFELVASQCEPDSDFSSVASANPEDHKAFDQSIELANHIDADLLIGTDPDADRLGIVERDAEGNIHYYNGNQIGALLLNYRIKQTEGLSNRIMFQSIVSGGLAKSLAQYHNVNFKEVLTGFKYIAAEIRHLSPEQNFIFGYEESYGFLARPFVRDKDAIQIVPLMIKYAAELKNKGRMLKDELEDITRNVGNFNDKLFSHTFEGTQGKAKIENIMTQFRSETPSEMCGLKVIAIEDFETGKKTDLQNDEVSDITLPKANVIKIYFNEGFIALRPSGTEPKIKLYVSLSCDHFDVVAQKMNDAIFNS

SEQ ID NO: 4700 - protein, 41 aa, Staphylococcus epidermidis
TTPYLKCIYFINSNHHKHITKPRTQIHVLGFVNHIDNLYLN

SEQ ID NO: 4701 - protein, 383 aa, Staphylococcus epidermidis
MSPYKVIIAPDSFKESMSAKEAALAIKDGFQEVFDSSTIYDIIPMADGGEGTTEVLKEALNATSYCVEVKDPLNRNIMASYARSDEHQTAIIEMAAASGLALLSKDERDPSITTSYGTGQLINDALNHDVNKIILGIGGSATNDGGVGMLKALGVSFKDKNNQEIRDGGLALSQIEYIDITRINPRLKDVNIKVACDVTNPLLGDNGATIVYGPQKGAQQKMIPKLDSALRHYHDKIERELNMNVKDIPGAGAAGGMGTALIAFLNAELRPGIDVVLEETQFKQRIKDANLVVTGEGKMDKQTIYGKTPIGVAKVAKSYDIPVIAICGSLGKDYEVIYHHGIDSVFSIMERPCHLDEALKEGALHVKHTTTNFARLLQLKIEN

SEQ ID NO: 4702 - protein, 266 aa, Staphylococcus epidermidis
YWTYHFKEKGKMVIMDDLKQNQSSNEKPKGNKIINILIFIGMILLIQIPIGVSLIALPFSVKFSKLTSIALSMLITGTALLIIWLVRNYYLSHTYERQYQSMRGKDIFINIGFLVLSMVFSILSSVLMVIFTGNDTTANEKEINESLDLLLQKDHLPHISIVATVVLMICIIGPYLEELLFRGIFKETLFMKYRFWLPFIISSIIFSSQHLSTNIFSYAIYFLMGCVLYLAYNRRRNIKDSMMVHMLNNSVSTLPVFVGYLWIYFR

SEQ ID NO: 4703 - protein, 42 aa, Staphylococcus epidermidis
HFQYLNNITENFMTFHQSVMIYSNFFTFLWLGIRSRFISLLI

SEQ ID NO: 4704 - protein, 336 aa, Staphylococcus epidermidis
FQKYTYYTNIDMKGTVSRMKNLKFLVVLVLSVVIFAAACGNSSSLDNNKSSDSGSDSKSGSYTPKELTVQFVPSQNADTLEAKAKPLEKLLSDKLGIPVKVSVSTNYNTIVEAMKSKKVDVGFLPPTAYTLAHDQKAADLLLKAERYDVNEDGSPSKKLVDDYKSEILVKKDSGINNLKDLKGKKIALQDVTSTAGYTFPLVTLKKEAGIDATKDMKIVNVKGHDQAVISLLNGDVDAAAVFNDARTVVKKDQPNVFKDTKILKLTKPIPNDTISVRPDMDKKFQDKLKKAFKEISKTKKGHKIISEVYSHEGYVDTKDSDFDIVRQYEKAVHDMK

SEQ ID NO: 4705 - protein, 444 aa, Staphylococcus epidermidis
NMKYCSNCGQPLREGVKVCTNCGTPVRNDGPNYKHSEQRYSHQQPRSNKSNKKTWLIVTIVLAIIIALVVIFTIAKNQMSPEKQATHIAHAIKKDDAKSLSKQLTSNDHRLNEEEARAYLKYIKAESDLKHVADKVEENTKDIKNNHYNNLSVDANDNNILNISKDGKKYVFFDNYQFNVPQKTITIVSSDSGEITYEFNGDKHHISVEEDDDKELGTFPIGDYNLKASKDMEGKNFKGAITIDMSESDSIAYESFKQKRFNVDTEGGYILDNVKIYANGKEIGDGFSSETYGPYDPDEEVIVHAEGSYEGKTFKSNSVNVASASEKDGGVTDVTVKFDEEAIDQYVDKKLDEKYDDSDDESDNDSSSGEVTRENVIDKVESYEGHTLDTDTYTYKEPEKTGDGKWGFSFLDKDGDLAGSYTVDIDDGYVTEYDEDGEEVGSGY

SEQ ID NO: 4706 - protein, 514 aa, Staphylococcus epidermidis
NMKYMIGVDMGTTSTKAVLYDENGKFIMKHNIGYDLHTPNVDVSEENPDEIFDAVLMTVKYIVRESGIAKEDIKFISLSAQMHSLIAMNEDNQRLTENITWADNRANDYADLIEKSYGGFELYQRTGTPIHPMSPLSKIFWMRHEEPKIFKQTAMFADLKTYVLFQLYERFVIDYSLGSATGMMNLEQLDWDNKALELLGIERNQLPQLVPTTHVLTGMKKRYATLMGIDEQTPVIVGASDGVLSNLGVNSYQKGEVAVTIGTSGAIRTVINQPKTDEKGRIFCYILDKDQYVIGGPVNNGGVVLRWLRDEILASEVETAKRLGVDPYDVLTQIASRVKPGAEGLIFHPYLAGERAPLWNADARGSFFGLTLSHKKEHMIRAALEGVLYNLYTVYLALIEVMNETPTTIKATGGFAKSEIWRQMMADIFDTDLIVPESYESSCLGACVLGMKALGEIDDFSVIKDMVGTTHAHEPNQETVAIYQQLVTIFINISRSMTENYSDIANFQREHLSD

SEQ ID NO: 4707 - protein, 46 aa, Staphylococcus epidermidis
GFEYIVIYTYFYLLILKNEFSLIIYQLKKRYEIYFVLNFSLPYQRI

SEQ ID NO: 4708 - protein, 212 aa, Staphylococcus epidermidis
RREYVLIVLGKGETMKKLIGLLMILCMVLLYSCSGPMDSPKHSNNSKPVVVIYGDYKCPYCKKTEDRVMPKLKKKYIDTNKIKYQYVNLAFLGKDSIVGSRAQHAVNHYAPKKSLEFQKLMFNQQKDEHKQWITTRLVDKQIDKLSISDDKKKKIKTDYKTKGSISWKKAKEDQQIAKKNHIKQTPTAFVNDNKVEDPYDFSSYEMLLENEK

SEQ ID NO: 4709 - protein, 518 aa, Staphylococcus epidermidis
GRRYGHSFPINKEVLDMTIYNINFGIGWASSGVEYAQVYRAKLLRQLPYPTKFIFLDFIQSENIQTLTSNIGFKDDEVIWLYQYFTDVKIAPTTYTVDDLISELGNEVTRKEQNGKVLRLYLNNQQTFVTCYLKNANEHYVDRAEFVVNGMLIRKDFYSYVRTFSEYYAPFDNKAKIYMRQFYNENGSIAYREYIDEDEHVFVFDDARLYSKQALVAYFIRQLRLNSEDIIIIDRATDVGQAILENKGSSKVGVVVHAEHFSEGATDGTHILWNNYYEYQFENAQHIDFFITATDLQRQTLSEQFKQYKNDCPRIRTIPVGSIESLQYPEKERKPYSIMTASRLANEKHVDWIVEAVIKAKHQLPQLSFDIYGQGEEQEKIKNIITKHRAEDYIQIKGHRNLRTIYQQYELFIAASQSEGFGLTLMEAVGSGLGMIGFDVNYGSPTFIRHHQNGYLIPIDFEQASTDDITTQIAHMIIRYFEDGPIRAHEVSYDIAESFKTSHIVDLWRQLIEEVLYD

SEQ ID NO: 4710 - protein, 512 aa, Staphylococcus epidermidis
KLTLSQSLSSILDLSYILGGNLFMKFMNKMGKTTLASSIVAASVLSTVNVSYASGSSEQSAQTKQTQNDAIAFGNTKNPKNVIFMVGDGMGPSFNTAYRYYKNKPGAKKMTPTAFDKYLKGTNRTYSNDPKENVTDSAAGGTAFSTGHKTYNGAISVDTNKKPIKSVLEQAKEQGKSTGLVTTAELTDATPAVYAAHIDSRDKKDEIAQQFYNDKINGKHKVDVMLGGGAKYFGKENKNLAKKFKKDGYDIVSNKDELNQSQSKQVLGTFSEKDMPLQIDAPQSNPLLVDMQNSALNKLSKNNKGFFLMVEGASIDKAAHPNDITGVMSEMSGFETAFDNAINYAKTHKDTLVVATADHSTGGLSTAKGKDYKWNPEAIHKMKHSGMYMTKQIADGKDPEKVIKDGYGIDFPNKQLDKVKKAADELHKLQKEGKDDKDEKVVEQTTKLQNAIQKPINDASHTGWTTNGHTGVDVNTYAYGPGSNKFKGNMENTQSAKNLFDFFGDNVTSNQN

SEQ ID NO: 4711 - protein, 227 aa, Staphylococcus epidermidis
NVTYGYPKKWKENMTSGQVIAAELRLGIVSGEIESHIQLSENQVAQQFNVSRSPVRDAFKLLQTDQLIQLERMGAQVLPFGDQEKKEMYDLRLMLESFAFSKLSGTDTQHIVKEMKKQLEMMKVAVQFEDAEAFTQHDFEFHEVMIQATNHQYLKVFWNHLKPVMESLILISMRQRMTNDPKDFERIHSNHQVFIDAVENDDASILRKAFHLNFDDVGENIEAFWLR

SEQ ID NO: 4712 - protein, 51 aa, Staphylococcus epidermidis
LDKYMTTKSNFRLSLASLDMIQVINYLIIRVKKCLRNSNIKSYIKEYFLHA

SEQ ID NO: 4713 - protein, 73 aa, Staphylococcus epidermidis
YKDLLRHILNSAINFQYTKHLRQISMSQAQLFKYKHLLEKHTSIYVLVILIFKLWSENYWCTLMKFTCICTIH

SEQ ID NO: 4714 - protein, 41 aa, Staphylococcus epidermidis
FFHLNNTPFKDAVLEQTKCSIVSYYYTRFIVVFKNLNFKLS

SEQ ID NO: 4715 - protein, 398 aa, Staphylococcus epidermidis
KGHLVVMTVARTTTFILSVFIVGMVEMMVAGIMNLMSQDLHVSEAVVGQLVTLYALTFAICGPLLVKLTHRFSSRSVLLWTLIVFIFGNGMIAIAPHFGIIVVGRILSSAAASLIIVKVLALTAMLTSAKNRGKMIGIVYTGFSGANVFGVPIGTVIGDWVGWRFTFLFIIIVSVFVGVLMLIYLPKEDELSHPNQTPRSSSIESQTGSSVIRPREVFKYLMITFLVLVANSVTFVFINPLILSNGHEMSFVSLALLVNGVAGVIGTSLGGVLSDKFTSKRWLIISISIFIIMMIILNLLLPGTGLLLVGLFMWNLMQWSTNPAIQSGIIEHVEGDTSQVMSWNMSSLNAGIGVGGIVGGLVMTHLSVEYVTYTSALIGLISLIIVFTLKNRHYAKNL

SEQ ID NO: 4716 - protein, 42 aa, Staphylococcus epidermidis
LKDFYIWVVDSGLKYDFIKFVSIFMLLVRGDNVFKMFYETVV

SEQ ID NO: 4717 - protein, 40 aa, Staphylococcus epidermidis
VKNLLMVFIGALSIFILKLNESEAGTKRFKISKKRQFLLK

SEQ ID NO: 4718 - protein, 42 aa, Staphylococcus epidermidis
MLFHGKRHFLSFNFYKDIFNTRITRELYGCLNCLYYRILKRY

SEQ ID NO: 4719 - protein, 65 aa, Staphylococcus epidermidis
TFIHIVNIDENINDMNKRSSINCNNYFLSKLKSRCKVAISHLPHSRTLQRHVIYKLKHFRNNFLF

SEQ ID NO: 4720 - protein, 136 aa, Staphylococcus epidermidis
NHIHYQEAPNLTKVEYGDHYERRFMKPKKLKANIEYTTPHGHVYRTDHKGRIKEVYADDLSLLDGGRNSYAQRTVGREYRLPDDDGGHLIARGFGGSKDIDNLVPQSKYINRSFKENGEWYNMKKEWQKAIKKGEK

SEQ ID NO: 4721 - protein, 56 aa, Staphylococcus epidermidis
IKIHNHYIAVGFGIEAISNIVKTYSYIEIVFNIKNNYLCHSHYRLIYKINLLFSFI

SEQ ID NO: 4722 - protein, 78 aa, Staphylococcus epidermidis
LYSHFIKIYIKCHYSYTTTLLFIYENHHILYRSNDGFIGYLIESNSHFDTILKCLIFKLQSLSFFYINSNTFKLTKID

SEQ ID NO: 4723 - protein, 40 aa, Staphylococcus epidermidis
QHPQLCKIIFGDLQNSEKPEHDHGHAAEHHLMTEELTAHL

SEQ ID NO: 4724 - protein, 675 aa, Staphylococcus epidermidis
CTTHNIRGVVIMTQSYCILGNPNVGKTSLFNALTGSYEYIGNWSGVTVEKKVGKLKDNVGDLVDLPGIYDLSPISKDETVVTDYLMSTSFTGMINIIDACQLKRNLNLTIQLMELNKPMIIGLNMIDVATQRGIKINYQALMRKLKVPVFPIVARKAKGTHSLLGELNYLEPHQRRAFKINYGTEIETAIQQICSIIKQDNMYPTERLRFIAIQYLIDNVQIYQELDAMILEQLEPIKRKLSNATEQSTRQRIEAVRNDYINQLLEDIVEYPEEDKQFFTSKVDRLLLNRYLGIPIFLGIMWLIFQTTFTWIGTPLSDQLDAFISGPLSEWIKSVMNTLHITSFLQDLITDGIIAGVGSVLVFVPQIVVLFFFISLLEDSGYMARIAVLMDKTMESIGLSGKSFIPMIIGFGCNVPSIMAARSIENEKERLITILVAPFMSCSARLPVYALFVGAFFSAHQSLVVLSLYILGIVVALLVSTLLNKLILKDNQSVFIVELPTYRVPSFKTLWRSTWEKAKGFVKKAGTFIFGGSVVIWTLTYIGPHGVNVPINQSFMHMIGQGFANLIAPLGFGSWQAGATLIPGFLAKEVIISSMAILYSSSESGLTQVIQQQFTPLSAYAFMIFILLYVPCISTVATIRKETSSWKWTLLAVVYPIATAYILTFVFYQVSQLFI

SEQ ID NO: 4725 - protein, 360 aa, Staphylococcus epidermidis
LEHHEIHSLMLLNLIATYKMKGAHPMKNIKKPFDLKGKSLLKEYDLTGEEFEGLIDFAMTLKKYKQQGTPHRYLEGKNIALLFEKTSTRTRAAFTVASIDLGAHPEFLGKNDIQLGKKESVEDTAKVLGRMFDGIEFRGFSQKTVEQLAEFSGVPVWNGLTDDWHPTQMLADYMTIKENFGYLKGINLTYVGNGRNNVAHSLMVAGAMLGVNVRICTPSSLTPRDVYFNIAKDQASNYGGSVKMTDNIHTAVKDADVIYTDVWVSMGEESEFETRIHLLKDYQVNRKMLNLTGKVDTIFLHCLPAFHDTQTEYGQNIFEKYGLTEMEVTDEIFRSEHSRVFDQAENRMHTIKAVMAATLG

SEQ ID NO: 4726 - protein, 44 aa, Staphylococcus epidermidis
KSNQITQIKKEEYYQIGIDSFVNVMLVNEKMVNMYICHSITDCL

SEQ ID NO: 4727 - protein, 40 aa, Staphylococcus epidermidis
RLNQPRTTIDNYFFLYQIKRFRITSYRYQMYLPMLVGLTH

SEQ ID NO: 4728 - protein, 158 aa, Staphylococcus epidermidis
EVDHSMKKSKRQDLVTMIVKQNHIYKKADIIDYIDDHFGVRYSMTTIARDLRELHIYRLPVKANQYEYKLLTQQSQLDSRVRLNDYIETEIINTMIKESYILIKTTPGFAQSINYYIDQLQLKEIIGTISGNDTIMILTHSQSIAEYVYYKIFNHNYS

SEQ ID NO: 4729 - protein, 98 aa, Staphylococcus epidermidis
GMSQYPFYRRMFIIIKKCTLIYNSIKELYPMRKILKGIILSLIIIGLIKTFNEYDIIHCANHYFEQIKSGKIIEDIKIDHFNNYHNINFEDLNPSDFF

SEQ ID NO: 4730 - protein, 243 aa, Staphylococcus epidermidis
KRGHIVIEANQILAKMKNQKINYDKVLRKIISQWERDGERPKILLHSCCAPCSTYTLEFLTQYADIAIYFANPNIHPKSEYLRRAKVQEQFVNDFNNKTGANVKYIEAEYEPHKFMKMAKDKGLTEEPEGGLRCTACFEMRLEIVAKAALEHGYDYFGSAITLSPKKNAQLINELGMDVQNIYNVKYLPSDFKKNKGYERSIEMCNDYNIFRQCYCGCVFAAMKQGIDFKQINKDAQAFLQQF

SEQ ID NO: 4731 - protein, 44 aa, Staphylococcus epidermidis
ILLHNVLEIHILIFIFKQSSYKSITVMLHTKKPETTSYLRLLYE

SEQ ID NO: 4732 - protein, 55 aa, Staphylococcus epidermidis
IFIHFVTHLVNIILLSYTTDFSKSKSLYYKIILNPKSIFENISNYLYTLNKYFAS

SEQ ID NO: 4733 - protein, 45 aa, Staphylococcus epidermidis
VQIHNLVTQMYKLFQLQLLQKVVATAHQLLHTQHQAITTALTVVQ

SEQ ID NO: 4734 - protein, 62 aa, Staphylococcus epidermidis
CNSHLKLKSGISLMAWIWFSRMKLRPKLKYIINYFIIYVAIEITLYAVILNHKLFYNELHSL

SEQ ID NO: 4735 - protein, 660 aa, Staphylococcus epidermidis
GSTHKMKKNKFLVYLLSTALITPTFATQTAFAEDSSNKNTNSDKMEQHQSQKETSKQSEKDEFNNDDSKHDSDDKKSTSDSKDKDSNKPLSADSTHRNYKMKDDNLVDQLYDNFKSQSVDFSKYWEPNKYEDSFSLTSLIQNLFDFDSDITDYEQPQKTSHSSNDEKDQVDQADQAKQPSQHQEPSQSSAKQDQESSNDEKEKTTNHQADSDVSDLLGEMDKEDQEGEDVDTNKNQSSSEQQQTQANDDSSEHNKKYSSITDSALDSILDEYSQDAKKTEKDYNKSKNTSHTKTSQSDNADKNPQLPTDDELKHQSKPAQSFEDDIKRSNTRSTSLFQQLPELDNGDLSSDSFNVVDSQDTRDFIQSIAKDAHQIGKDQDIYASVMIAQAILESDSGKSSLAQSPNHNLFGIKGDYKGQSVTFNTLEADSSNHMFSIQAGFRKYPSTKQSLEDYADLIKHGIDGNPSIYKPTWKSEALSYKDATSHLSRSYATDPNYSKKLNSIIKHYHLTSFDKEKMPNMKKYNKSIGTDVSGNDFKPFTETSGTSPYPHGQCTWYVYHRMNQFDASISGDLGDAHNWNNRAESEGYTVTHTPKNHTAVVFEAGQLGADTQYGHVAFVEKVNDDGSIVISESNVKGLGVISFRTIDAEDAQDLDYIKGK

SEQ ID NO: 4736 - protein, 227 aa, Staphylococcus epidermidis
HKGLRRRKRQFLYLFNRNCLFYNCIKKTMRYAYGSEKVLPLSKKTSHHARIYIGQPTKIFNTRRCFFMSSDTNSLAHTKWNCKYHIVFAPKYRRQVIYGKIKRDIGVILRQLCERKGVEIIEAEASKNHIHMLVSIPPKLGVSSFVGYLKGKSSLMIFDRHANLKYRYGNRKFWCKGFYVDTVGRNKKVIENYIRNQLQEEIVADQISMEEYLDPFTGEEIKKRRKK

SEQ ID NO: 4737 - protein, 52 aa, Staphylococcus epidermidis
QFKHILISTLLNSIPYFDYFNIIKFKFVPVKLLYSITHLYYRCIHTYKCNHT

SEQ ID NO: 4738 - protein, 251 aa, Staphylococcus epidermidis
ITKQTNFKLYLEDLYIMKKTVIASTLAVSLGIAGYGLSGHEAHASETTNVDKAHLVDLAQHNPEELNAKPVQAGAYDIHFVDNGYQYNFTSNGSEWSWSYAVAGSDADYTESSSNQEVSANTQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNDQINAAYKAYKAQGLSAWGM

SEQ ID NO: 4739 - protein, 513 aa, Staphylococcus epidermidis
LFLHEFLNQRKVSKKMANKESKNVVIIGAGVLSTTFGSMIKELEPDWNIKLYERLDRPGIESSNERNNAGTGHAALCELNYTVQQPDGSIDIEKAKEINEQFEISKQFWGHLVKSGNISNPRDFINPLPHISFVRGKNNVKFLKNRYEAMRNFPMFDNIEYTEDIEEMRKWMPLMMTGRTGNEIMAASKIDEGTDVNYGELTRKMAKSIEKHPNADVQYNHEVINFNRRKDGIWEVKVKNRNSGDVETVLADYVFIGAGGGAIPLLQKTGIPESKHLGGFPISGQFLICTNPDVINEHDVKVYGKEPPGTPPMTVPHLDTRYIDGERTLLFGPFANIGPKFLRNGSNLDLFKSVKPYNITTLLASAVKNLPLIKYSIDQVLMTKEGCMNHLRTFYPEARDEDWQLYTAGKRVQVIKDTKEHGKGFIQFGTEVVNSKDHSVIALLGESPGASTSVSVALEVLEKNFAEYEKDWTPKLQKMIPSYGKSLIDDVKLMRATRKQTSKDLELNYYESK

SEQ ID NO: 4740 - protein, 46 aa, Staphylococcus epidermidis
INSQNRFNSLPKTFIYTNFIFYDSFKLLFLVNWFYLSTLNTVKVKS

SEQ ID NO: 4741 - protein, 75 aa, Staphylococcus epidermidis
LYFKYIGDRHPLKNTSYIFKMRASGIFLYTNKPINKINIIPDTEIIVSNNDHVKNVSLTVSPKYSLNIQNPASLT

SEQ ID NO: 4742 - protein, 49 aa, Staphylococcus epidermidis
TFCLFKNRIFERSVIKMKKLAVILALAGAAFYGFKKYQNHVNQAPNIEY

SEQ ID NO: 4743 - protein, 64 aa, Staphylococcus epidermidis
NEFKDNYCRVIKKSFNYDQTGKRRRIIREFVKKLTLFHEYSILFIKIKSIQSDIFKHMLYIKSS

SEQ ID NO: 4744 - protein, 366 aa, Staphylococcus epidermidis
RLINGGMTMPESKALLKSLTDVNGISGHEMQVKSLMKDYLTPVSDDIVEDQLGGIFGKKNATHGTKSLMISGHLDEIGFIVTQIDEQGYIYFTPIGGWWNQVMLSQKVTITTESGKEIRGIIGSKPPHALSSEERKKPVDIKNMYIDIGVRNKEEAKEAGIELGNMITPYSEFESLANDKYLTAKAFDNRYGCALAVEVLQQLKDENIDINLYAGATVQEEVGLRGAKVAANLIKPDLAIAVDVGVAYDVPGMTSEKNEGKLGDGPLAILMDATSIAHDGLRKHIKDVAEHHNIPVQWATTPGGGTDAGSIHVANEGIPTITIGVPLRYMHSNVSVLNIDDYTNSVRLITEIVRSLNDDSYQALMW

SEQ ID NO: 4745 - protein, 46 aa, Staphylococcus epidermidis
LIIKKIKFLTTMLAYLFKMLHYTLVHKCDLIIRNNDNTKGWDNYDR

SEQ ID NO: 4746 - protein, 52 aa, Staphylococcus epidermidis
LIIKFCFYDTSFFWKLKRYDKYSGESNNTSCGLFIVVKGSLKDTFGNVKIKI

SEQ ID NO: 4747 - protein, 62 aa, Staphylococcus epidermidis
VKIKVTNLILRCIMRKLISTIIVSTLLIGGCSTVHKEAKHTSQSIPEEVPASQYKGQGFHNQ

SEQ ID NO: 4748 - protein, 293 aa, Staphylococcus epidermidis
MEIKQIKYFVEVVRQGGMTQASEHLYIAQSTISKAIKNIENEYDITLFDRSQKQIKLTDIGQTFYDNSLEFLALFEKLSLEMNDIVNVQKGHIKIGLSPMMNVQMFTNALNQFHRLYPNVTYEVIEGGGKIVENLTSNDDVDIGITTLPVDHTEFHSTSLYNEELLLVVSNDHHLAHLNKVDMADLKDEEFVLFHDDYYLKDQIIENCKRLGYYPKTVANISQISFIANMIQQGIGISIVPESLVNLMGNNVTSIQLENVELSWHLGVIWRKDAYLNHVTRKWIEFISEMKPT

SEQ ID NO: 4749 - protein, 90 aa, Staphylococcus epidermidis
MKINIFGYNIFAKGGTSRSNINLVKSLLEIGHEVHYFNYQDYNKSDITKLIIYEGLSTKHLHIHQFNSGKELAHGDLLIITRETFLIMHI

SEQ ID NO: 4750 - protein, 303 aa, Staphylococcus epidermidis
RGINMFDSIRETIDYSVENNISFADMMINDEMEREGKSREEVRDLMRQNLNVMREAVEKGTTGDGVESVTGYTGHDAAKLRDYNENNHALSGHEMIDAVKGAVATNEVNAAMGIICATPTAGSSGTIPGVIFKLEKTHNITEDQMIDFLFTSALFGRVVANNASVAGATGGCQAEVGSASAMAAAAAVSIFNGSPEQSGHAMALAISNLLGLVCDPVAGLVEIPCVMRNAIGSGNALISADLALAGVESQIPVDEVIGAMDRVGRNLPASLRETGLGGLAGTPTGEEIKRKIFGEADNMVKNK

SEQ ID NO: 4751 - protein, 45 aa, Staphylococcus epidermidis
SPCLISAAIDVHSFKIVYIYIYHALTFSNIISLQFTFILITIAFL

SEQ ID NO: 4752 - protein, 41 aa, Staphylococcus epidermidis
FLTNHMINSAVPVISILNAMDVNLLNFTEKGKAISDTPIGI

SEQ ID NO: 4753 - protein, 100 aa, Staphylococcus epidermidis
ELTKMIIINAKLKIDANKREDYLKLMKELVINSRKEDGNLFYHHYEDVTEKNVFVVVENYKDEQAVQAHNQSDHFKVFSDNISQYLIEEPQIDVSQPIQL

SEQ ID NO: 4754 - protein, 313 aa, Staphylococcus epidermidis
LFYKVVYFVELNILECEGVFELKKLAVICAFTILILAGCGLGDSDNNGSSTINDDQQSGYKSNRDSKSSISRNQTEDNQQDTQQDTHSNRYYAQVWLTALDSYRGESDLPFDDLEIVHQNISNKVLDPYHPDESAKLPEGTELLTASVTAAGSVYYKSNGDGTITIYSVPSHFQGSWRDADYSKRESQRIIDDARTVKLYNASESEINKISQMMRTEFSVGDNLTDEDDTSESEDQSSSSDEVTVTRSNVIDIVEDYEGHQLDTDTYIYKEPEKDSDGSWGFSFTDKEGHLEGSYIIDKDGEVTKYDEDGEPE

SEQ ID NO: 4755 - protein, 40 aa, Staphylococcus epidermidis
NNYKLTIFKNVQQFNKFLKIRYLRSNTCRLFYCYIISNGL

SEQ ID NO: 4756 - protein, 43 aa, Staphylococcus epidermidis
KNYKKDNFYIISIEIVFIYLSWTFLSQPLHFYNITILFFINHI

SEQ ID NO: 4757 - protein, 413 aa, Staphylococcus epidermidis
NVYNRCYNFSRRIMMMTTSSKHLSKILIVILGVMTAFGPLTIDMYGPSLPKVQHAFGSSISEIQLTLSFAMIGLAIGQFVFGPLSDVLGRKKMALILLIGYLIASLLSVFTVHLTIFLIIRLIQGLAGGGAIVIAKASIGDNYDGNKLAKFLTSLMVINGIITIIAPLLGGLALSIASWKMIFIFLTIITLIVILGILLKMPVGLHQKQSQLNFKAIFKDFGLLLTKPTFVIPMLLQGLTYVMLFSYLSAAPFISQKMYHMTPLQYSAMFAINGVGLIVVSQITAIIVEKISRYAMLIYLTIIQMLGVVILIFTLTLHLPLYVLLIGFFINICPVTSIAPLCFSMAMAERTGGSGNASSLLGLFQFILGGLISPLVGLNGQHDMSPYLIIISATAVLLIALQIIYFKLFMKNT

SEQ ID NO: 4758 - protein, 79 aa, Staphylococcus epidermidis
IPYKGVYIFRHFFNSYILKLIYSNSMYFSSLLFRHLLQNNIIEIKKSLDIHLPCVQTLNHAHSILLIQSSSYLYLFKPF

SEQ ID NO: 4759 - protein, 228 aa, Staphylococcus epidermidis
CRYKDVFKLLLKVEHLTYKVDNRTILDDINLNINKGDTIAIVGPSGSGKSTLLKQLNHLISPTSGDLYLNDQSYFNYKPEEIRTRVSYLMQQSELIGYTIEDNMKFPAEARSEAFDRDKAKQLISQVGLGNYQLDAQIEHMSGGEQQRITIARQLMYEPEVLLLDEATSALDTHNKKKIEEIIFKLADKGIAILWITHSDDQSMRHFKRRITITDGKISSDEELNGNE

SEQ ID NO: 4760 - protein, 105 aa, Staphylococcus epidermidis
ITYKSLRMLLFIGGPIMDKINKEDTDTKKDSNNNYKHQNDHIDRQGLNGYQKTDLDLEIERELQEMMENGESNKETKSKHFKILSFVSMIVIVVIAIIRFIQKTI

SEQ ID NO: 4761 - protein, 45 aa, Staphylococcus epidermidis
IKHNVNPHLIFNIIKRNIFFIKNKSTYIGLFHIFIVYIKTRLNQL

SEQ ID NO: 4762 - protein, 45 aa, Staphylococcus epidermidis
SFNKGIELMSLLTKKTAINSYSFISYMNKQSITFFYRKPIPFMNG

SEQ ID NO: 4763 - protein, 98 aa, Staphylococcus epidermidis
QLNKAYKNNLMAKTNKSGTRIFYVPDLLYVYTDSYEMSPTQRISEEIPRTKQVGVGAPTERISEEIPRTKQVGVGEKTGDNEFYPSLAFILIRGILQS

SEQ ID NO: 4764 - protein, 47 aa, Staphylococcus epidermidis
LKNKSQTLGETVMSFYERVLKLGENNHRTAFEFRFEELFSNEEWCAL

SEQ ID NO: 4765 - protein, 270 aa, Staphylococcus epidermidis
GWNKVTTPTTHKYNRYLNKRMSLKTSFSIILITGLIIWSFIYTGFSIGDLMIGLPQIGVFFKQMIPPDWGYLDHITQPMLDTIRMAIVGTFLGSIVSIPIALLCASNIVQTKWIAIPSRFVLNIVRTIPDLLLAAVFVAIFGIGQIPGVLALFVLTICIIGKLLYESLETIDPGPMEAMTAVGANKVKWIAFGVVPQAISSFMSYVLFAFEINIRASAVLGLVGAGGIGLFYDQTLGLFQYKKTAMIILFTLIIVVIIDYVSSKVREKLA

SEQ ID NO: 4766 - protein, 76 aa, Staphylococcus epidermidis
RGDKVSFYHFIQNFVGDETPLGKLATCINQDEDLPMEETTAHNILNYFNQLNYFDDDCIEAVKRSLSLYEQSKVAL

SEQ ID NO: 4767 - protein, 878 aa, Staphylococcus epidermidis
KGDNSMSKSYAKFYKCALQVNPYSYIKYRGLEHEMTEEQYNESIYQYCKTNNISIIGLADHGNVDNSSKLRQYLVSKGILVFPGFEISTSEKVHIVCLFSENTEERELERYLGELGLSNLEEGNSPSTLSFHEITQKVLDRGGFWYAAHVTSDNGILKGKHNNLWQSDKLIAAQIPSKKNEVDPKYTSILKNKDPNYQKQTPFALINAKDISKPEDLALDTSSCLIKMSKLNFESFKLAFRDPDARVKLNSDINNKFPHSSIDKIKISMGYLDNLSLDLSSNLNTIIGGRGTGKSTLIELIRYALDIAPTSQNTNTSFENICKSNLGIGGKVELIVTSHAQYGKQFKIIKRYNEDPIIKDIDNNVSNYTVKDILPNIEVYSQNEIIDLTTNENAKLNILNRFLDKDDRSNDKKEEIKTNLHSNSKSLIKAKEDLENLQEKINQLPKLKEKLKHFNELGIGKKLEVQGKISREEQYIQNTKQIIEDNDISITNIILPFNENYNQQIKHVEIFDSIKNITDNHNKKLKEIKSMFTDLKDTTQNEIEKIYNVWKEKKKNIEKEINRAIKSLDDIEGKTKEDIAHEYTETQKQITSIEPLETQLSRVKTSIETLENERIQLKEDLKEIFDEQLKNLNRCVKKINNRYLKKQVNIKIQPYANVNNLIEFLKEENGLGDSTLKWIKNHQSFNFPKFIKLIKDRDSEAIYEEYKDSGLKKHTADILSNMLYERILKLESIELENIIDIRLNVGSDKDTKFRSLNHLSKGQQCTAILNLLTLSNNDPLLVDQPEDNLDNSFITNNLVENIRKLKINRQFIFATHNANIPVFGDAELIVTMENENGQGSVNNENLGSIDNTLVRNSVIQILEGGDVAFKMRKNKYGL

SEQ ID NO: 4768 - protein, 336 aa, Staphylococcus epidermidis
GSCKMSRYERQTRFAPFGEEGQQKLSSSQILIFGAGALGSHIVDQLARMGAHHIAIVDMDIVEISNLHRQTLFDEEDAHTLISKVEAIKHKVNQININVNLTTYDLEVTSSNIENLIKNVEPDIIIDGMDNFKIRYLINEVCHKYQIPWVYGAAVGSKGSVYGIDHQGPCLKCLLQTIPDTGESCAINGVIPPVISMIASYEVAEAVRYLSGKGFSKQLITIDAFNINYKSMNVDALKNKDCPVCEKHEYTLLESQQERTIEDLCGNAYLFRFPPKAFKHAAHFPGNMVKSTSFAKLIQYQTYEFTLFKDGRMNAYGIHNDEEAHHLYNTLLKSIR

SEQ ID NO: 4769 - protein, 315 aa, Staphylococcus epidermidis
LRCNISKERCIMIKIIATIIVSTLILGSCSTMNEEENYASQSIPASQYKGQGFQPVAEKSAIAHAKKHREEYEKLGEQFFKDNFSLNVKATNVVGSGDGVEVYVHCDDHDIVFNASILFDKEAIHEEGSMRSNDNGDTMSDMVGTVLSGFEYRANKEKMDNLEKYLKDKEDKYHYTGFTDEAITKTQNIGYQNNYFYITTSSTKLRDYRKHFEPLIKESNDDFRKHMKQLKSKKDTYLNTEITTTLFSTLDEYDEKIIRKNSISMAKEIRKEPSIPHNFTFHLLFSNNKLKINDPNINNNQINEYGVFHHDGFKN

SEQ ID NO: 4770 - protein, 52 aa, Staphylococcus epidermidis
QQSNATQNFFVIIILINIILYNKNKRFQQNKDKIITYANIKINDLFIFKKYK

SEQ ID NO: 4771 - protein, 51 aa, Staphylococcus epidermidis
VLFNLSISCTIKLNRDYFKRIVSIIGGKHGRKNWFDRHWFQHDSTCYIWLQ

SEQ ID NO: 4772 - protein, 46 aa, Staphylococcus epidermidis
ITIKLMSMGCSTMTDLKINDMDIAEINGFWVYQNTKNKKFTVNGKN

SEQ ID NO: 4773 - protein, 62 aa, Staphylococcus epidermidis
NLIKMEVILLNIKKHWLPIVVVILVVVIFLLVTFARANEGLDNYEQHELNNGEQQYLSKGAS

SEQ ID NO: 4774 - protein, 506 aa, Staphylococcus epidermidis
KFNKLNGGRLMELVDKLSNRQYIDGEWVESSNKNTRDIINPYNQETIFTVAEGTKEDVERAILAARRSFEDGEWSLETSEVRGKKVRAVADKIKENREELAKLETLDTGKTLEESYADMDDIHNVFMYFAGLADKDGGEIINSPIPNAESKVVKEPVGVVTQITPWNYPLLQASWKIAPALATGCSLVMKPSEITPLTTIRVFELMEEVGFPKGTINLVLGAGSEVGDVMSGHEEVDLVSFTGGIETGKHIMKQAANHVTDVALELGGKNPNIIFDDADFELAVDQALNGGYFHAGQVCSAGSRILVHNDIKDKFEKALIDRVSKIKLGNGFDQDTEMGPVISTAHRDKIEGYMEVAKKDGATIAIGGKRPEREDLQAGLFFEPTVITDCDTSMRIVQEEVFGPVVTVEGFADEEEAIRLANDSIYGLAGAIFTKDIGKAQRVANKLKLGTVWINDFHPYFAQAPWGGYKQSGIGRELGKEGLEEYLVSKHILTNTNPEPVDWFSK

SEQ ID NO: 4775 - protein, 51 aa, Staphylococcus epidermidis
LINKHPSFIKKSYETQAARGPQTFTFNPLAFLFIIHSIYFISYHEQLFHIV

SEQ ID NO: 4776 - protein, 462 aa, Staphylococcus epidermidis
IINKRKKGNAMFGEIWPLISVVLGIIILLTLIIGLKLNTFISLIITSMITALLLGMPLNKIMETIENGMGSTLGHIALIFGLGAILGKLLADGGGATRIADTLIAKFGQKHVQWAMLIAAFIVGIALFFEVGLVLLIPLVFTVAKRANVSILKLGLPMVTALSVTHGFLPPHPGPVVIAKELKANIGEVLLYGMIIAIPVTLIAGPIFNRFAQKMVPTAYTREGDISSLGTQKEFKEEEMPGFGISLLTAILPVILMLISTIVQLITGHEEATNVFEQIVYFIGTAGTALLIAVIFAIFTMGMKQQRKMEDIMKSVTHAIYPIGMMLLIIGGGGTFKQVLIDGGVGDTIAKMFEGTSMSPILLAWIVAAVLRISLGSATVAAVSTTGIVLPLLEHSDVNVALVVLAIGAGSVILSHVNDAGFWMFKEYFGLTVKETFLTWSLLETIISVSGIIFILFIGLFV

SEQ ID NO: 4777 - protein, 164 aa, Staphylococcus epidermidis
SQCKLLIFVSNLPPQVVHHFNFKLRRDLSMKLSIFHDGQFFVGVVEYQEGFIHKYLKVTFGNEPSDETVLRFITFKLIPLLNQTHCKKKPIQKHKKINPKRLQRKIAKEQKETNLTTFAQQAIKEEQELNKLKSKKLQRLEKERHRQYKRMLKRKKAHEKHKGH

SEQ ID NO: 4778 - protein, 300 aa, Staphylococcus epidermidis
YMRKVLIFAIAGFLAQLVDGSLGMGFGASSSSILLTYGIAPAVVSATVHFSEIATTAASGTSHWRFDNVHKPTMLKLAIPGSISAFIGAGVLTFIHGDYIKPFIALFLLSMGFYILYQFLFKRAHEHHHHVGNLSSFKVIPQGFVAGFLDAIGGGGWGPVNTPLLLSSKKIQPRYAIGTVSASEFFVTSSAALSFIIFLGVTQINWFAVIALSLGGMVAAPISAYLVKVLPINILAICVGGLIIFTNSNALLSYFVKDNTISNTVRFIIILAIIILLVFQVVRNKKLSFSYKKSRVNKYN

SEQ ID NO: 4779 - protein, 44 aa, Staphylococcus epidermidis
MNSNSSIINNNINIGSGTEFITSSLSYSLYFNLIYKSFIYFLGT

SEQ ID NO: 4780 - protein, 513 aa, Staphylococcus epidermidis
LESNMITTTQEVNIMAMSDKKDVVLIGAGVLSTTFGSMLKTIAPDWDIHLYERLDRPGIESSNERNNAGTGHAALCELNYTVQQPDGSIDIEKAKEINEQFEISKQFWGHLVKSGEIQNPKEFINPLPHISFVRGKNNVKFLKDRYEAMKQFPMFDNIEYTEDIEEMRKWIPLMMKGREDKGYMAASKIDEGTDVNYGELTRKMAQNLKNSPNVEVQYKHEVVDFERLSNGKWSVKIKNLNNGQVFEHQTDYVFIGAGGGAIPLLQKTGIPESKHLGGFPISGQFIACTNPQVIEQHDAKVYGKEPPGTPPMTVPHLDTRYIDGERTLLFGPFANVGPKFLKHGSNLDLFKSIKPYNITTLLASAVKNLPLIKYSFDQVIMTKEGCMNHLRTFYPEARDEDWQVYTAGKRVQVIKDTEENGKGFIQFGTEVVNSEDHSVIALLGESPGASTSVSVALEVLEKNFPEYAKDWEPKIKKMIPSYGESLIDDVQLMRKIRKQTSKDLELGFYNKAK

SEQ ID NO: 4781 - protein, 351 aa, Staphylococcus epidermidis
YNLKDYKIFIIGGFYMHCPNCGNPIEDDDLFCGECGHKISRHPQSVRNAESEITKAEKNDEEQNITSNNKENNAATHQNVDSTSHDETRSNENDVADSTLQSKQSHNDTQQSNLSTYHQRPQHREIPQNQHNHDQQQSQIGQQAKQVTNESKGFFKSAFTAPDKIIQTNHVFSFKLLLSLLIIGFIVLAILLASVIPVEIGIFGTTRGSLVTSIIFGIILFLVVIVGAIFGLTRLVVRQPIAFKKVLSDYVLINSVSLAILIISVILILAESYSFGGSIALLSLLLFIASGIYLIAKYSTGNQTRISSFYGVIIYIIILFLFIRIFGEAFFHQIFGDFIEELGDLFEGGTY

SEQ ID NO: 4782 - protein, 493 aa, Staphylococcus epidermidis
CNLNLKLIFQGILLMEVFNMTNQLFINNEFIESQSKETMDVINPATGEAFDTITLATEEEVNDAIEKSQQAQLEWERVPQPTRAEHVKLLIPLLEKNRDEIAQLYVKEQGKTLAQAYGEIDKSISFIDYMTSLSMSDKGRVLQNSIANETIQIINKPIGVTAGIVPWNAPILVLMRKVIPAIVTGCSVVIKPSEETTLLTLRLAELFRASTIPAGLFQIVPGTGETVGTQLASHKDIQLISLTGSMRAGKSVYENAAQTVKKVNLELGGNAPVIVTSNADLDKAVNYIVTARINNAGQVCTCPERIFVHEDVHDDFLNKVTSKMKSLTVGDPFDENTDYGAIINQKQLDSIHEKVQDAIKNGATLMTGGHQLKRHGFFYAPTVLDNVRKDYNVFKDEIFGPVLAITTYRDFEQVIEDANDTNAGLSSYIFSENLTEVMTATERLKFGEVYANCEAEEVVNGYHAGWRESGLGGADGIHGFEEYYNTTVSYIRY

SEQ ID NO: 4783 - protein, 47 aa, Staphylococcus epidermidis
NSLKKSLSQKSYNQMRCGYLMKDYNYVFPKIKRTLVINSIDNSNSLF

SEQ ID NO: 4784 - protein, 55 aa, Staphylococcus epidermidis
CLLNYTKGLIFLKYFNVKLHINTKYFGETLEGTGQAEDYRLKLSPKKASQQYEVF

SEQ ID NO: 4785 - protein, 46 aa, Staphylococcus epidermidis
CLLNYTKGSYFFSISHIKTKYFGESLREQDKLKLSPKKARQQYEVL

SEQ ID NO: 4786 - protein, 277 aa, Staphylococcus epidermidis
MKLKRGFQKNKTPGRLEMNKVIESDVTLSSMLWLGGEKSMSIYTSGDIAHKCHVSTRTIQYYDKQGILSPNYTSETNRRFYTDKEVEKLELILLLKEIGCTIKEIKVLLKDDSSMKSLYTFLQIKKHEIQQSITDKEHKVCKIEQIQRYVHQNSISPIHYLQDITTYMEESHRLKGVRKKLWLSIALIGSLQYGGLIISIVTRRKKPFLSMMPVVAMYSLWLTKKYKKNVSYVCPNCHHVFNPSVIHFVTASHTPKTRKLQCPDCHEMHYCIEIAKQ

SEQ ID NO: 4787 - protein, 237 aa, Staphylococcus epidermidis
ILIKRKEVKVTVESTLALIVKVVVLQFNQVKLDKKFIMKISMEGSSVINLEQLSLYQDSLGYLGQQMNFPEKMTFHPKIFEETISKSHPGYEDLLAYREVMMNYTLSEIKAIYTDTFDFSKKHPLYMTFNKFDTQKERGQMLAKLKVLYEMFGLKMVDNELSDFLPLMLQFLQVADFKNDSRAQENLQLVIMIIEDGTYEMANTLAENNNPYAYVVSALRKTLKACIVPLKEVENHA

SEQ ID NO: 4788 - protein, 42 aa, Staphylococcus epidermidis
LYINIWYWNIKSNKYIKLNYQLLKTNTLPETIIVVSGFFIYK

SEQ ID NO: 4789 - protein, 263 aa, Staphylococcus epidermidis
FHINLLRRNTLMKALIVDDEPLARNELQYLLNLNDAIDEIEEAENIEETLEKLLYNTFDLIFLDINLMDESGIDLAQKINKMKRSPHIIFATAHEKFAVKAFELNATDYILKPFEKERINQAVNKVDMAKDKPKNKDKTITPKYIDYSDDERAQTHVLPIEVDERIHILNFTDIIALSVNNGITTIDTTKQSYETTETLNHYEKKLPSSLFIKIHRATIVNKEHIQTIEHWFNYTYQLTLTHEFKYQVSRSYMKTFKQQLGLQ

SEQ ID NO: 4790 - protein, 40 aa, Staphylococcus epidermidis
YDINTYYHDLIYKTLNPNRHSMHVTYTYQHYLYILTDISW

SEQ ID NO: 4791 - protein, 590 aa, Staphylococcus epidermidis
KEIKDIKETCINRRDGGYMVNTNNHISEELDKNLDEMEFLKANSDFLRGTIEQSLANPITGSITQDDAKLLKFHGSYMQDDRDLRDERRKQKLEPAYSFMIRVRVPGGKATPEQWIAMDDISNQYANHTIKLTTRQAFQFHGILKRNLKQSMKNINHAVLDSIAACGDVNRNTMCNPNPYQSQVHKEINDYATRISNHLLPRTNAYHEIWLDGEKVLDSSEEKEPIYGNTYLPRKFKIGIAVPPSNDIDVYSQDIGLIAIVEQDELIGFNVTIGGGMGMTHGNTETYPQLGRLIGFIPKEKVVDVCEKILTIQRDYGNRENRKNARFKYTVDRLGETWVTEELNRRLGWEIKAPRDFEFEHNGDRLGWIEGINNWNFTLFIQNGRVKDTEDYLLKTALREIAEIHTGDFRLSPNQNLVIANVSPEKKEEIQAIIDKYKLTDGKNYTGLRRNSMACVAFPTCGLAMAESERYLPSLITKIEDLLDESGLKEEEITIRMTGCPNGCARPALAEIAFIGKAPGKYNMYLGGSFKGERLNKIYKENIDENEILESLRPLLLRYSKERLDGEHFGDFVIRDGVIAKVHDGRDFHS

SEQ ID NO: 4792 - protein, 208 aa, Staphylococcus epidermidis
KAVNLMRAKKLISHLTVSRITSTRNVIIVIKREGVIIMTKFNFDQVHSDIQFKIKHLMVSQVKGTFKQFDVQLDGDINDLTSLKATATIIPSSIDTQNEDRDNHLRSNDFFGTEDNDKMTFVTKEINENQVVGDLTIKGETHEETFDVEFNGVSKNPMNGQQVTGFIVSGTINREKYGINFNQALETGGVMLGKNVKFEASAEFSIDN

SEQ ID NO: 4793 - protein, 199 aa, Staphylococcus epidermidis
FKVKIHKLILGGSHLKKEKVMDWTTFIGVVIVLLFAVIPMMVFPKASEIIITDINSAISNSIGSVYLFMGLAIFCFVLYIAFGKYGNVTLGKATDKPEFNNFTWAAMLFCAGIGSDILYWGVIEWAFYYQVPPNGAKSMSDQALQYATQYGMFHWGPIAWAIYVLPALPIGYLVFVKKKPVYKISQACRPILKGHTDKL

SEQ ID NO: 4794 - protein, 42 aa, Staphylococcus epidermidis
KLVKSVNGIIIIMVPKQKIYKVIETILNTFSIYFFLIIVMII

SEQ ID NO: 4795 - protein, 54 aa, Staphylococcus epidermidis
FSSNTFSDFLLLSTSLKSFIRVNFSTPPFFKKLFYYQIKLIQIFDKFNLKQFEL

SEQ ID NO: 4796 - protein, 50 aa, Staphylococcus epidermidis
KASNQKEHNVECRIISILYLIVITSYVYKIYHLHDKGTVVMTTTVPFLLY

SEQ ID NO: 4797 - protein, 557 aa, Staphylococcus epidermidis
KKSKVELYMKQRVGQYLMDAVYSAGADKVFGVPGDFNLAFLDDIIAHNDIKWIGNTNELNASYAADGYARINGIGAMVTTFGVGELSAVNGIAGSYAERVPVIAITGAPTRAVEQEGKYVHHSLGEGTFDDYRKMFEPITTAQAYITPDNATTEIPRVINTALQQRRPVHIHLPIDVALTEIEISNPFKPEVEPQKNVQSYINMVQDKLESASQPVIITGHEINSFHLHKELEQFVNQTQIPVVQLSLGKGAFNEENPYYMGIFDGSIAEQDIQDYVNQSDAILNIGAKLTDSATAGFSYQFDINEVIMLNHNEFKINDTCIEAFSLPNILNGLNKYIHYKNTNDFPQYERPQSHNYELSDQPLTQETYFNMMQDFLQQDDILIAEQGTSFFGAYDLALYKDNTFIGQPLWGSIGYTLPATLGTQIANPYRRNILLIGDGSLQLTVQSLSTMIRQNLNPVIFVINNDGYTVERMIHGMKEPYNDIRMWDYKSLPSVFGGDNVLVHDVNTSEELMLTFENIKSNSDRMHFVEVKMAVEDAPVKLSNIAKAFASQNKSS

SEQ ID NO: 4798 - protein, 41 aa, Staphylococcus epidermidis
HRTKSISENTKTSNNHFHIRLIRCPPKYPNSTLCIITGQTT

SEQ ID NO: 4799 - protein, 370 aa, Staphylococcus epidermidis
RMTNQKTVGLVVAPGVTERLAENLIQEMPKMLSTHYDHQQEWIFDLVTDPLTGFAESVDEIFGKVADYHDKRQWDYVIAITDLPMFADKQVMALDINMENGAAIFSYPAFGWRPVKKRFKHAIYNIIQELNEAEQESRNYDNNKQIENSVKKQFPLSKIDKETIYMKETDSYHLRYLSSSRSRGMFRLVSGMTFANNPLNMMASLSNIVAIAFTTGAFGLVFTTMWQMAYNFSMWRLFGISIIAIIGMLIWIMMSHDLWEPVNKSNHKHITWLYNLTTIMTLIFAIIIYYIILYLLFLIAEIVLLPSGFLGQQVGLKGPAGIDLYLSIPWFAASISTVAGAIGAGLLNDELIKESTYGYRQRVRYEEQRR

SEQ ID NO: 4800 - protein, 629 aa, Staphylococcus epidermidis
TMTNIGITKYKRWIRLNLSVTNSPFTEGQAKQINELLHTLSPNQQVWLSGYLMANQQSNTSTDSVEQHNLDDNTEAMLHEKEPSVEPEARSITILYGSESGNAQGLAEIFEQRLSDIGNDVTLKSMDDFKPKNLKKVEDLFIITSTHGEGDPPDNAVELHEYIHGRKAPKLDGVRFSVLALGDQTYEFFCQTGKDFDNRLAELGAERLYHRTDCDVDYEEDAEKWMANVINTIDSTPAGTESEQVVSESIKSAKEKKYSKSNPYDAEVLTNINLNGRGSDKETRHIELLLDNFGEEYEPGDCVVVLPQNDPAIVDLLISTLGWSPETQVLINEDGDTLNLEEALTSHFEITKLTKPLIENAAIFFDNEELSEKIQDKEWIQNYVEGRDLIDLLNDFATTELQPENLHQLLRKLPPREYSISSSYKATPDEVHITVGAVRYQAHGRERSGVCSVQFAERIQEGDTIPIYLKRNPNFKFPQDESTPVIMIGPGTGVAPFRSYMQEREELGFEGNTWLFFGDQHFTTDFLYQTEWQEWLEDGTLSKLDVAFSRDTDKKVYVQHKIVENSEQFNRWIENGATIYVCGDESKMAKDVHQAIKNVLIKEQNLSETDAEEYLKQMKRDKRYQRDVY

SEQ ID NO: 4801 - protein, 198 aa, Staphylococcus epidermidis
RSTKRDMCKSETHEGTSFMNILNIKEGQHYIAKIESHSFVDGEGVRCSVYVSGCPFQCKGCYNVKAQNFKYGEPFELEMLEEILDYCAPSYIEGLSILGGEPFCNLFITLQLVEAFRQRFGHTKTIWVWTGFLFEYLKQQDDARKSLLEHIDVLVDGMFIQHLYRPNLPYKGSLNQRVWCIDVQSSLQKEQVIEYLTK

SEQ ID NO: 4802 - protein, 84 aa, Staphylococcus epidermidis
KKANEATNFKAKIEVVSTLFSTKSDFTKNNSKKDLLFLSDDLYHYKEKPENTNITLQLSEPKINSTRAFYDANNPLEYGVHKHE

SEQ ID NO: 4803 - protein, 231 aa, Staphylococcus epidermidis
CMAKVKEKVAVVTGASSGIGEAIANKLSQQGASIVLVGRNEQRLNEIVQQLNNPAKVVTADVTVKSNIDDMLKAVIDHFGHIDIVVNSAGQSLSSKITDYNVEQWDTMIDVNIKGTLHVLQATLPYLLKQSSGHIINLASVSGFEPTKTNAVYGATKAAIHAITQSLEKELARTGVKVTSISPGMVDTPMTEGTDFGERKKLEAQNIADAVVYALTQPSHVNVNEVTIRPV

SEQ ID NO: 4804 - protein, 802 aa, Staphylococcus epidermidis
SMAKQKLVMIGNGMAGLRTIEEILERSQSQFDITIIGKEPYPNYNRIMLSNILQKKMTVEDTIMNPYDWYQENNIELINNDPVEKVDKENKIVTTSKGIEVEYDICIFATGSKAFVLPIPGSNLPSVIGWRTIDDTNKMIEIAQTKKRAVVIGGGLLGLECARGLLDQGMEVTVLHLADWLMEMQLDRKAGEMLKADLEKQGMKIELQANSKEIIGDKDVEAIKLADGRVIETDLVVMAVGIRPYTEVAKDSGLDVNRGIVVNDYMQTSDSHIYAVGECAEHDGKVYGLVAPLYEQGKVLADYLTGKETKGYKGSTTFTSLKVSGCDLYSAGQIVEDEDIHGVEIFNSVDNIYKKVYLSHGQVVGAVLYGDTDDGSRFYNMMKKHETLEDYTLVSLLHKGDEDAGTSIADMSDDETICGCNGVDKGTIVNAITTKGLTSVDEVTKATKAGNSCGKCKGQIGELLQYTLGDDFIAAKPTGICPCTDLTRDQIVTQIRAKNLKSSKEVRHVLDFKDKDGCPKCRPAINYYLNMVYPFEHRDEKDSRFANERYHANIQNDGTFSVIPQMRGGVTDADQLIRLGEVAKKYNVPLVKVTGSQRVGLYGLKKEELPQVWKDLGMRSASAYGKKTRSVKSCVGKEFCRFGTQYTTRLGIRLEKTFEYIDTPHKFKMGVSGCPRSCVESGVKDFGVISVENGYQIFIGGNGGTDVTVGKLLTTVETEDEVIQLCGALMQYYRETGVYAERTAPWLERMGFENVKNVLLNQEKQKELYSRIMEAKKAVENEPWETIVENKEAQKIFEVEKV

SEQ ID NO: 4805 - protein, 112 aa, Staphylococcus epidermidis
SIKKKERWLCYMVKPRQRQYPTVTSYLNIVRESLFITISGVFWMYCIVVMIVYIGTLINSQMESVITIRIALNVENTEIYKLFGWMSLFVLIIFIFFTFSLAFQKYKKGRDI

SEQ ID NO: 4806 - protein, 148 aa, Staphylococcus epidermidis
MSKNKNDYEHMLFYFAYKTFITTADEIIEQYGMSRQHHRFLFFINKLPGITIKELLITLEISKQGSHATLRKLKEEGLIVEQTSKQDRRVKKLFTTEAGDDLIGKLNQAQDELIQQTLQKVGHDWYAMMEELANYREGFKTIEHLKED

SEQ ID NO: 4807 - protein, 308 aa, Staphylococcus epidermidis
NMKKFWGILLIVMSIALVGCSNSNDSDQSSNEKSSSKSSEKKTDVATEYTKEDEYKELEKEAKDLKQKPVLNEIDALITEKGFTNKTGLQGWEDYKKLVDKVTLADYKYTKESKGSSIEEVNKFFKDKKGVEIKRMKSKEKNIKHINYMYVDPDGKKTGENKQPMSYAQILATFKEGKLVATNIQPGFFALDKKKMVKAKDLEKVKTLEDLTRLKDPKATSYGILQTKYKGKPYTQVSILGSDSDEENDISSAILAYYLFSPTELDSDDNHKYVEVASAPFLSAQNDFSSYQLGVFKKIIESSMSFDE

SEQ ID NO: 4808 - protein, 182 aa, Staphylococcus epidermidis
GVKNMSNINIRVAHEQDAEELHSIMQIAFTPLRELGIDWPSVHADLEMVKDNLRQNTTFVLENEKEIISTITVCYAWSSVKPISGYPFVWWFATRPTYDGQGYGSQLLKYVEETFLRDTLKAAAVTLGTSARLHPWLLNIYEKRGYEIYAKHENDDGDLGVIMRKILIPEQFNDDILGRPPF

SEQ ID NO: 4809 - protein, 422 aa, Staphylococcus epidermidis
KFENLLFTLRRFFYNISLILIFDIKKREETLMKDNKMLFIIFMIGTFTVGMAEYVVTGLLTQIADDMKVSISSAGLLISVYAISVALIGPLMRIITLKVHAHRLLPILVAIFIISNLVGMLAPNFNVLLLSRLMSAAMHAPFFGVCMSVAATVAPPAKKTQAIALVQAGLTIAVMLGVPFGSFLGGFANWRVVFGFMIVLAIITMLGMIKFVPNVSLSAEANISKELTVFKNPHILIVIAIIVFGYSGVFTTYTFMEPMIRDFSPFKIVGLTVCLFMFGLGGVIGNLITGNVPEDKLTKNLYLTFLLLFVTIILFVTVIQNSILALIICFLFGFGTFGTTPLLNSKIILSAKEAPLLASTLAASIFNVANFLGAIIGSILLSIGLPYIQITLISGGIIVLGMLLNLVNQLYEKKHITFNEYS

SEQ ID NO: 4810 - protein, 310 aa, Staphylococcus epidermidis
DKEKCRIQGLRHMKFAYIQSIRNEISIILIILLFFALIFYVFSLPFDAYVLAISIILLLMCVRWWIKYLSFKKNEHLKDKVAYLEHELAHVKNQQIEYRNDVESYFLTWVHQIKTPITASQLLLERNEENVVNRVRQEIVHIDNYTSLALSYLKLLNEESDMTITKVTVDDLIRPLILKYRIQFIEQKTQIHYEKSEDIILTDAQWASIMIEQLLNNALKYAKGKDIWIDFDVANQTLQIKDNGIGISKADIPKIFDKGYSGFNGRLNEQSTGIGLFIVQHIANHLNIQVTVQSELNHGTVFFIHFTKEK

SEQ ID NO: 4811 - protein, 554 aa, Staphylococcus epidermidis
MAEKQYSAAQMVIDTLKNNGVEYVFGIPGAKIDYLFNALEDDDIELVVTRHEQNAAMIAQGIGRLTGKPGVAITTSGPGVSNLTTGLLTATSEGDPVLAIGGQVKRNDLLRLTHQSIDNASLLRSSTKYSAEVQDPESLSEVITNAMRTATSGKNGASFISIPQDVISSPVKADAISLCQKPHLGVPSEQEINEVIEAIKNSKFPVLLAGMRSSSQAETEAIRRLVQKTNLPVVETFQGAGVISRELENHFFGRVGLFRNQVGDELLRKSDLVITIGYDPIEYEASNWNKELDTKIINVDEEHAEITNYMQPVKELIGNIAGTIDMISEHVNEPFINQDHLDELEKLRGEITEATGIKATHKEGVMHPVEIIETMQKVLTDDTTVTVDVGSHYIWMARKYRSYNPRHLLFSNGMQTLGVALPWAISAALVRPNTQVVSVAGDGGFLFSGQELETAVRKNLNIIQLIWNDGRYNMVEFQEEMKYKRSSGVEFGPVDYVKYAESFGAKGLRVTNQEELEAALKEGYETDGPVLIDIPVNYADNVKLSTNMLPNALN

SEQ ID NO: 4812 - protein, 401 aa, Staphylococcus epidermidis
LIGKGDLIIMSNNETITNYTIKPHGGELINRVVEGNERERLIEEALKFKPITLNPWGISDLELIGIGGFSPLTGFMNKEDYTKVIEETHLSNGLVWSIPITLPVTESEADKLEIGDDIALYGEDGQLYGTLKLEEKYTYDKEKEARLVYGTTEEAHPGVKKVYEKGNIYLGGPIKLLNRPKHDAFSNYHLDPSETRQLFHDLGWKTVVGFQTRNPVHRAHEYIQKSALEIVDGLLLNPLVGETKSDDIPADVRMESYEVILKNYYPEDRARLVIYPAAMRYAGPREAILHATVRKNYGCTHFIVGRDHAGVGDYYGTYEAQELITQFEDELGIQILKFEHAFYCEACGNMATAKTCPHDASQHLHLSGTKVREKLRNGESLPTKFSRPEVAEVLIKGLREK

SEQ ID NO: 4813 - protein, 231 aa, Staphylococcus epidermidis
GECLMMAKSYDYQSAFDIIGPVMMGPSSSHTAGAVKIGNSARAVLGDMPKHIEIRYYESFAKTHQGHGTDVAIVGGAMGYSTFDSRIKSSLDIAKDENITIDIIEDEGESIGQHPNCAYIKANTKDGRYIEVIGISIGGGTIKLKGINVNGLNVELNHGLPMLVIDGNMNKAKINHLINDLSDMDLDLGEELIETNDNEGLVVFPLNKAISESALNIIKDKHSDLNVSYIK

SEQ ID NO: 4814 - protein, 357 aa, Staphylococcus epidermidis
RSLKLYGRDIDHNSPFYKGNKSVREGDIVKQDKLANTLTKIKDKGPDYFYEDIGKSVSKQLDNKLTERDFKEFKTEEKEAVSTDYKNNQVYSAPNPLGGTLMLQGLKIDEKENVDNMDRNNFITAMIKSRDVMYKNRDIVNGNEPSNEQHLTDDYLLGELNKVNIGENTDNGSDFDQIRTDNTSTTHFVVIDKNGKLASTTNTLSSYFGTGDYMKEGFYMNNSLGDFSKDKSSPNHGEPHKAPRSFISPSVIVGPNFYMGIGTPGGNKIPTILNEVIVDYLNSDGSLQESINKPRFYNDGGTIFYENAMTDEDINIFKSLGYGVEEKHNDPNFGSVQGAVYDKDKNTVDVGHDVGNR

SEQ ID NO: 4815 - protein, 80 aa, Staphylococcus epidermidis
FQLNPNKFFFFFFESLWGANKKGNKKGVISGAFFFYSIKPYLSNSTTEGDRWVFQLLIGAISRCRKPVGPLADKLGSSTV

SEQ ID NO: 4816 - protein, 274 aa, Staphylococcus epidermidis
NELKTLNHLNKMKASQQKISMVTAYDYPSAKQAQQAEIDMILVGDSLGMTVLGYDSTVQVTLNDMIHHGKAVKRGASDTFIVVDMPIGTVGLSDEEDLKNALKLYQNTNANAVKVEGAHLTSFIQKATKMGIPVVSHLGLTPQSVGVMGYKLQGDTKTAAMQLIKDAKAMETAGAVVLVLEAIPSDLAREISQQLTIPVIGIGAGKDTDGQVLVYHDMLNYGVDRHAKFVKQFADFSSGIDGLRQYNEEVKAGTFPSENHTYKKRIMDEVEQHD

SEQ ID NO: 4817 - protein, 172 aa, Staphylococcus epidermidis
YIMKRFAKAFVVSGITLGAVLGLNVTEHNGVSNEAKAQTAHSYWYKYNGYTASGGDFVLSNSFYQGLKAGNVTFNGIKVNQKYESKTATKKIYDQTFQQINGNKANNVQFKIASRTVTLDQVKQKYGKNYNYQPSLSKNKTSKTDGLYGYQVGKGNIVFHVKDGYVTSATLS

SEQ ID NO: 4818 - protein, 223 aa, Staphylococcus epidermidis
TYMKIFIVEDDLVIAESLANELSKWNYEVHVVDNFEKIMEDFRRVEPQLVLLDINLPTLNGFHWCQEMRKVSHVPIMFISSRTDNMDQILAIQMGGDDFIEKPFNLSLTVAKIQALLRRTYDLSIARDEIAVKGCKLIVDEAKLSKDNEHVQLSLTELQILKLLFQNENKYVSRTALIEKCWESENFIDDNTLAVNMTRLRKKLLSIGVDDLIETKKNVGYRV

SEQ ID NO: 4819 - protein, 231 aa, Staphylococcus epidermidis
SLMNEYLQAVLMILLTIVLYYVSKKIQDKYNNPLLNPALIASIAIIIVLLVCGVSYKGYMKGGTWINHVLNATVVCLAYPLYQNKKKIKKYLTIIFTSVLTGVVLNFVLVFTTLKIFGYSKDTIVTLLPRSITAAVGIEVSQELGGTDTITVLFIITTGLIGSILGSMLLRMGGFKSSIARGLTYGNASHAFGTAKALELDIESGAFSSIGMILTAVISSVLIPVLILLFY

SEQ ID NO: 4820 - protein, 449 aa, Staphylococcus epidermidis
ELMKQYDVVFLGSGHAAWHAALTLKQSGKQVAIVEKDTIAGTCTNYGCNAKILLEGPYEVLEEAKQYPNIIDSHNLEVNWKNLMRYKEKVINPMSETLTSMFEQQEIDVIMGKGKLVDAHTIEVNNTTLQSDYIVIATGQHSHQLDIEGKEYTHDSREFLSMQSLPDSITFIGAGIISIEFASIMIKSGVEVNVIHHTNQALEGFNESHVNKLIQKLKDEGVKFYFSENTKSVKPNAQRFIVETESGKMIETDYVLDATGRKPNVQQIGLEKVGIQFSDRGIEVDDYLRTNVKNIYASGDVINKMIPKLTPTATFESNYIAAHILGLNTDAIQYPPIPSVLYSLPRLSQIGVTVSEAKKDDTYMIKDIPFGRQMVFEYQNETEAEMSIVLDSHKRLVGAEIYGNDAGDLVNLLVFIINQKLTAQDLNKNIFAFPGASSGVIDLLKLAMM

SEQ ID NO: 4821 - protein, 381 aa, Staphylococcus epidermidis
IKMNMKKGVSQLTLQTLSLVAGFMAWSIISPLMPFISQDVDISPGQISVILAIPVILGSVLRVPFGYLTNIVGAKWVFFWSFIVLLLPIFLLGQAQSPGMLMLSGFFLGIGGAFFSVGVTSVPKYFSKDKVGLANGIYGVGNIGTAVSSFCAPVLAGAIGWQNTVRSYLIILSIFAILMFFLGDKNEPKVKIPLMAQVKDLSKNYKLYYLSLWYFITFGAFVAFGIFLPNFLVDHFSIDKVDAGIRSGIFIALATFLRPVGGVIGDKFNAVQALIIDFVIMIIGALILSLSSHIVLFTIGCLAISICAGIGNGLIFKLVPSYFSKETRFSEWYCIHDGRNRRFLPTTGDYFCNEYHWFKSSRFLLLGYIWCNCSYYNDSFK

SEQ ID NO: 4822 - protein, 155 aa, Staphylococcus epidermidis
IEMKGCLMLISDTNKTYIIEETSNSFTIEKNNDQQHYEVLESINSLSNDSFCVLNHLFVNGGNEEVFESRFLKRNQHLQDVPGFKALRFLRPVVKGRHYIIITLWNSRQAFYDWQNSQAYAQTHKKRGTQKGVDHRIVNRDLSYNIRIELESLNN

SEQ ID NO: 4823 - protein, 57 aa, Staphylococcus epidermidis
LEMKNYSHRKLAVEPIWGFMKVILGFTQVSARSINKVKGKKFLLMVLNIKKNSDSEI

SEQ ID NO: 4824 - protein, 538 aa, Staphylococcus epidermidis
KGMNKNIKMKNKRKINNTLVYTISVLIIVVITLIAGIFPKAFGMYAQSVYDWITNWFGWLFLIIVFILDVFLIFLAFSRYGRFKLGSDEEEPEFSMLSWIGMLFSAGLGVGIVFWGVAEPLTHYLHSPFPGKIADHSEESARVAMGYTFFHWGISQWSIFAISGLIVAYFQFRKQRNGLISTAMEPVFGEAYKRPFRNIIDILAIIATVMGIATSIGLGIMQIGGGLNHLFDVPNNNFTKILITILMVAIFLGSSLTGLNHGVKWLSNLNILLGAILLIFILIFGDLKFILESYTLAISDYLQHFIEYSLRVNPYSGDDSWIQQWTVFYWAWVISWSPFIGGFVARVSRGRTIREFVVGVLIIPPLISFTWIAGFGGTAIKLALNHNDKLVHIVDKDYTVALFELLSHFPLSEVTSSLAIVLIFIFIVTSADSTTHIVAGMATGGSINPTLKHKVLWGLLIGAISVAMTIAGGLKSLQTASVITGLPFSIILLLMIFSLMRALKREPIHHFKMTSIDDEKDYSISLEEREKQDEQDNK

SEQ ID NO: 4825 - protein, 497 aa, Staphylococcus epidermidis
TMVKEVVLGIDLGTSAIKIIAVDQLGNVIESVSETLKLYQEHPGYSEQDPNEWFEATKKGIKELIQSTEMSDKIVKGISFSGQMHGLVIVDDNGIPLRKAILWNDTRNSIQCRQIEDIYGERLNYNPILEGFTLPKMLWVQQHEPEIWNRVDVFMLPKDYLRYCLTQTIHMEYSDACSTLLFNPENYEWTRDVGDTFNIGDIYPPLVKSHSYVGNVTSSLAKELGLSSDVAVYAGGGDNACGAIGAGVIHDKSALCSIGTSGVVLNVEYQRVTSYDSNLHLFNHSVPDTYYAMGVTLAAGYSLNWLKQTFFENESFEEILNLAASSKIGANGLLFTPYLAGERTPHGDAQIRGSFIGISGQHTKADFARAVIEGITYSLYDSIKIMRRAGHEMNSITSIGGGAKSRFWLQLQADIFNVQIKRLKHEEGPSMGAAILAAYGLGWFKTIESCVEAFIKVDEVFEPNNENHDLYEQYYSVYEAIYKQTKQLTADLLTITN

SEQ ID NO: 4826 - protein, 45 aa, Staphylococcus epidermidis
TNTNKVSNHCNQDIIYHYFDLLNLYHYITISLGIVANKIKKTLLF

SEQ ID NO: 4827 - protein, 366 aa, Staphylococcus epidermidis
LITNKERVLMTKKKRLSPSEWLLKQSKRHKRKNTLYTAIVLLVALVLLIFAVKSIQVEPVKSDTRDKDSIRITYLGNVTLNKHIRQTNLNDVFKGIQDTLDHSDFSTGSLIVNDFSRNQKDNINKNIENIMFLRKHNVKSVNLINESMDNIQATAMMRKIDSQAGYNFLTGNGSNPINSKTVQQDIKGKKIANVSFTDIESNYTNSLKNTTSISLDPAIFYPLIKKLKENNDYVVVNVDWGIPNERNVTTRQKEYAHALANAGADVIIGHNTVIQKVENYKRTPIFYSLGNTTSDNFLSKNQKGMIVQQDWKGSHNQFHITPIQSKDGKISKDNMNKMDHIRFKNNIKDKSIDLKSDQNGGYTFEY

SEQ ID NO: 4828 - protein, 139 aa, Staphylococcus epidermidis
EGTNKMKKTAVLNSHISSAISTLGHYDLLTINDAGMPIPNDDKRIDLAVTKSLPCFIDVLETVLTEMEIQKIYLAEEIKTANAQQLKAIKKLINDDVEIKFIAHSEMKEMLKSPLNKGNIRTGEITPFSNIILESNVTF

SEQ ID NO: 4829 - protein, 299 aa, Staphylococcus epidermidis
CIKNKRMYMIKQNFTTKVYPLKQFEGEYSEVAYAGDSQADDVIVFIHGALLTYKIMTMFEPYFRDYKLIFINCPSRGKSSDLDRDTHTLDDYAARIYDVLTQIVKEQQIKELSIVGYSMGGMIATRLLKYNTLPVSHLIYLHSAAKITPDASMLARLFTSESKRAVLKDEIKAVKNLPQYILDKTIYAQKENALDLVQFIAPIKTIITDMIYTINTDYLPDIDEIKQFPKILFMSGKEDQIIPYTDSQATLEKFKALGGKTKEVIYPGIGHIDFPSVLETQSDGQTGVVDEIKAWISKK

SEQ ID NO: 4830 - protein, 70 aa, Staphylococcus epidermidis
FAKKEYKKSSNEVGSTSLEVSGVGVNFVSKFIYSNLILIKVLSIGRNILYLFIFSSSFLYFTGKVFYLDS

SEQ ID NO: 4831 - protein, 41 aa, Staphylococcus epidermidis
IFEKKLVEIKRLYRCNMTRRWVKRVLFLIDLILLDVYTIIE

SEQ ID NO: 4832 - protein, 289 aa, Staphylococcus epidermidis
EGEKMNEQWMSALPLDNVKDISPVSGGDVNEAFKVTTVEEDIFFLLVQRQRSEAFYAAEIAGLNEFENAGITAPRVIASGEINGDAYLLLSFLEEGSQGSQRELARLVARMHSQYQQDNKFGFRLPHEGADISFDNSWTETWKEIFINRRMDHLQDELLRVGLWKQEDKKMYERVRKVIVDELSNHTSKPSLLHGDLWGGNYMFLTNGQPALFDPAPLYGDREFDIGITTVFGGFTQEFYDEYNQQLPLAKGSQKRIEFYRLYLLMIHLLKFGGMYADSVQRSMKIILE

SEQ ID NO: 4833 - protein, 602 aa, Staphylococcus epidermidis
MNENNYRRLNKTYKPHYLPGLDGLRAIAVIGIIIYHLNTKWLSGGFLGVDTFFVISGYLITSLLLSEYYRNNSINLVNFWLRRFKRLIPAMMFVVTVVLIYTLLFKPELIISIKHDAIAALFYVSNWWYIIQDVDYFNQFAVAPLKHLWSLAIEEQFYLFFPFILLGLLKFFKKRTTMIILLIISLLSLTAMITIHMYTGNNSRVYFGTDTRLQTLLLGCLLAFIWPPFSFRKDISKGAKASISAIGIVGMAVLIYLFVVVSDQDKWIYSGGFYAISFLTLFVIASVVHPSSVLKKILSFKLFIYIGKRSYSLYLWHYPIIIFMNSYFVQGQIPWFVYICEVILMFVMAEVSYKFIETPIRKNGFKAFTVIPKNLTRFSRTIIVLILLVPSAFIVFGAYDSLGKEHDKQQAAKQKSFKTNQKAKPKKPDENNQDKSSQQHFNPKEASPLLLGDSVMVDIGQVFSEKVPNANIDGKVGRQLIEGKDLINQKYQDYTKKGQSVVIELGTNGEFTKDQMNELIDSLGEADIYLIKVRVPRDYESTNNKIMEQVAKKHKNVHIVDWYKTSEGHSEYFAYDGIHLEYSGVKALSNEIIKKMKEVNEK

SEQ ID NO: 4834 - protein, 230 aa, Staphylococcus epidermidis
KRWKIMLNQFVWVIYPYLCLAIFVIGHIARYKYDQFSWTAKSSEMIEKKRLKWGSLLFHLGIIPVFFGHVVGLLIPANWLEAIGVNNHIYHIGAVYIGSVFGIITLIGMLLLTLRRLSIKNVRRLSSFSDIFVNIVLLIILIMGCYSTLVTNAIQPEFDYRQTIAIWFRHLFMFSPNADLMLNVPWSFKLHILLGFTVFACWPFTRLVHVWSVPLSYMNRRYIVYRKNKI

SEQ ID NO: 4835 - protein, 77 aa, Staphylococcus epidermidis
VLRFFLGGFGAHRFYHGKVGSGVGLLVLTLLTVWFTFGIPTLIWAIIDAFLIPNWVKEDEERIRQQALSEVKLMKNK

SEQ ID NO: 4836 - protein, 71 aa, Staphylococcus epidermidis
LEYLIHEYVDLIELLLIVILLVSLTSFHPLYMLKLDVILLYFNIEKSLQRSKRRRDTKLYPINLKISFSYK

SEQ ID NO: 4837 - protein, 50 aa, Staphylococcus epidermidis
LIFLHHTPKINIYYIHFAFYSIQLCYSVHRLTSITRGAIQFAERKFTFNP

SEQ ID NO: 4838 - protein, 65 aa, Staphylococcus epidermidis
LKFDSLQSQYDLSFIYITHYLIILYISEYIKEISNVQDNSTLTLKKLKKATEFELRVFPHFNNKS

SEQ ID NO: 4839 - protein, 42 aa, Staphylococcus epidermidis
MALDYTHLSAILFNHTILKRAPYLYNSTYVANFTVYFFGKII

SEQ ID NO: 4840 - protein, 451 aa, Staphylococcus epidermidis
LKIDQTLTSRIRQLEAYIMKQFLNITQRKFIEWLIILSIFIVSIPNKWTLMISIALSLLLLKRGALGVVQLIILYMLRSQIYTPYDTQEMAHYIVSMKYILIYVIGVFFLFKYVKHWIRNEMILRFIKSTMILMLLYIIMSLVVSNDPIESILKLLNFFIPLILIVMYVSLIKKIKNLINWINQFITLVIAFTFLFIVIAPKSYLIDEESLRSVFKDAHSFAVILAMGLVLYMVTIIKQQDYDVFNLLLLNIGMIELYLSNSRHIFISVILCLMLLLPLSHIKKRIKHPIIGAMILMAIAIINQPYIYHLFIKLILKGKNSQEVFMPSDMNIKAIDYALTEHPFLGSGFGIPMIKASSEIQYFNVATSNIIFGMIIFTGIIGLTLCTIYMLHMVLLVTFPMSITILLFLITIFVNMDYIILFDSVGLGILCYIFWGIYLKEGMYQYNNGQW

SEQ ID NO: 4841 - protein, 234 aa, Staphylococcus epidermidis
AMIEHLGINTPYFGILVSLIPFVIATYFYKKTNGFFLLAPLFVSMVAGIAFLKLTGISYENYKIGGDIINFFLEPATICFAIPLYRKREVLKKYWLQIFGGIAVGTIIALLLIYLVAITFQFGNQIIASMLPQAATTAIALPVSDGIGGVKELTSLAVILNAVVISALGAKIVKLFKISNPIARGLALGTSGHTLGVAAAKELGETEESMGSIAVVIVGVIVVAVVPILAPILL

SEQ ID NO: 4842 - protein, 596 aa, Staphylococcus epidermidis
MRIDVMLNLFILLLERVGLIILLAYILMNINHFKTMMSERDKWRSKFQLIIIFGIFSMISNFTGIEIENGHIVSGDIYYHLSKDASMANTRVLTIGVSGLIGGPWVAIIVGIISGLCRLYIGGADAYTYLISSIVIAIISGYFGHQTIKQNTYPSIKKGAIIGAITEIIQMGCILLFTNNLHHAITLVSFIALPMIIINSLGTAIFLTIILSTIKQEEQMRAVQTHDVLQLANETLPYFRSGLNEKSAQQAAEIILKLMQVSAVAITNKKDILTHIGAGSDHHVARKEIITDLSKEVIQSGKLKVAHTREGIGCHHPNCPLEGAIVVPLYIHNEVAGTLKFYFTDNNIISTSDQQLAKGLANIFSSQLELGQAEMQGQLLKDAEIKSLQAQVNPHFFFNAINTISALVRIDSEKARRLLIQLSQFFRSNLNGARNNTITLQKELQQVAAYLSLEQARYPNRFNIHYRIDDQCQDALIPPFIIQILVENSIKHAFKNRKKNNHIDVDVSMKQDYLSISVQDNGQGIPADQLDTIGYTTVTSTTGTGNALVNLNKRLTGLFGTTSALNIQSSQSGTTVSCLIPYKSSKEEHFNESVNR

SEQ ID NO: 4843 - protein, 47 aa, Staphylococcus epidermidis
NKHDCRNEIIVFTFFHRFPYSFLNFIQYDYYDSLFQIPKEIFKLTKN

SEQ ID NO: 4844 - protein, 180 aa, Staphylococcus epidermidis
WFNEKILTVSIYIVNICESFYTIINRARLKRGGYVKQEQMRLANQLCFSAYNVSRLFAQFYEKKLKQFGITYSQYLVLLTLWEENPQTLNSIGRHLDLSSNTLTPLLKRLEQSGWVKRERQQSDKRQLIITLTDNGQQQQEAVFEAISSCLPQEFDTTEYDEMKYVFEELEQTLKHLIEK

SEQ ID NO: 4845 - protein, 458 aa, Staphylococcus epidermidis
KEDLIMKYIVVGTSHSGYEVIQTLLKEDENADIQVFESADQPSFLSCGIQSYLEDISSSLDDLHYASVDSYKAQGVNIHTNSTVTDLDTDNKTVVVEHQGQTATYSYDKLFLSPGGKPVTPPVDGIEKYKHVLFMRGRDWANQIKERMKDAKKAVVVGGGYIGIEAAEAFAKAGIDTTIVDVADRILNTYLDKEFTDILETNAQQHGLHFKGGETVKSISGNQNGEVTTVVTDKNEYDADTVLFAVGVEPATEWLKDKIDLGKKGIININHQQQTSAKDVYAGGDATLVPFAPVSEDRYIALATNSRRQGVVAAKNMLGKEMTMPRVSGTSGLQLFDYKFGQTGIHGTEIDNYDGNLGQTYVEELIRPQFMQDDTKIHMKIIYDKDTHRILGGQVMSKEDITASINTISVVISAGFTLEQLAVQDFFFQPDYDRPWHYLNVLAQQALGDTFGSDKMLF

SEQ ID NO: 4846 - protein, 44 aa, Staphylococcus epidermidis
LGNDVPITRIISNNKYTTIATITILIILFFAIIHCCFITSFITD

SEQ ID NO: 4847 - protein, 91 aa, Staphylococcus epidermidis
TKNEQVEQFLAKESQWQDCYKFLRNLIFNETELEENYKWMHPCYTINNKNAVLIHGFKGYVALLFQKGAILEEKYHTLIQQTERLQAEAVP

SEQ ID NO: 4848 - protein, 543 aa, Staphylococcus epidermidis
CLDESELKGSTLMNKSNLLAPENYNIVTEIEKYASEDHKKAIIYKDNEHENISVSYKELISNANKVGNVFLNHGLKKGDKVLIMMPRAIVTYELYIAALKLGIAIVPSSEMLRTKDLQYRITHGEIDAVISFDSLTKEFENVKEYDQLKKFIVAGHKEDWVSIEDEKEKVSDDLKGADTTRDDLAILSYTSGTTGNPKAVTHSHGWGYAHLQMAPKHWLCIQENDLVWATAAPGWQKWVWSPFLSVLGMGATAFVYNGRFHPETYLELLQNYQINVLCCTPTEYRMMAKLSHLEQYNLEYLHSAVSAGEPLNREVVEQFKRHFNITVRDGYGQTESTLLIGFLKDTEPRMGSMGKGIPGSFVTVIDDDGKEVGPNVKGNIAVPLDLPALFKGYFKDEARTKAASTGDYYVTGDQAHIDNDGYFWFEGRRDDIIISSGYTIGPFEVEDALTNHAAVKECAVVASPHDIRGNIVKAFIILQDDYEASDELIQELQVFCKNEVAPYKYPRAIEFVEHLPKTNSGKIRRVELRDAEIKKYKQQDSSH

SEQ ID NO: 4849 - protein, 48 aa, Staphylococcus epidermidis
FCCEILINSLFITSLYVLHLNSHKVLSSNTYSNYIRKSNMLLFNQTKG

SEQ ID NO: 4850 - protein, 101 aa, Staphylococcus epidermidis
IPSEVKLKKFLKIIQKTIHYINHHLESAIEIYSTYTQTDISNQLNKDTIEATAKCFTNDLSMSSDYYNDLQLWLKEVNDIKDTINPTLYFTNQLLFSRYTK

SEQ ID NO: 4851 - protein, 270 aa, Staphylococcus epidermidis
KEHETMTNFHSIDATQVTNVTLNVKDLNKLTDFYSNVLGFSIEKQTNQQTVFNIGNLGYTLTLNELNNGRQPEFREAGLFHVAYLLPTRSDLADFLYHANNLNIAMGGGDHLVSEALYFTDPEGNGIEVYHDRPSEDWVWRDGFVKMDTLEVNVNDLMAQRSNEGWQGWPEEGKIGHLHLKTHNLESAYEFYVEKLGFEHISNFPQALFMSTQKYHHHIATNTWQSNKIRTQNEQTYGLCHFDIYQPNANTTHVTSPEGFDITIHGNETK

SEQ ID NO: 4852 - protein, 46 aa, Staphylococcus epidermidis
MSNDTSLIVIVRSSISASQHDFEKSYFYYVTIFAKLNIRLFNEAYT

SEQ ID NO: 4853 - protein, 43 aa, Staphylococcus epidermidis
VDCDHVVSFLFLKFKIILIIYKVDKIPNIKYNIFREFYILKMK

SEQ ID NO: 4854 - protein, 605 aa, Staphylococcus epidermidis
IELEIKKVFNMSLELPVMLTIVLFLALGIFSQWLASRIKWPSIVVMAIVGLLVGPIFGLANPKEALGPEAFSSIVSLAVAIILFEGSSNLDFRELKGISKAVIRIITIGAGIAWILGAIALHVTMNFPLSISFVIGGLFLITGPTVIQPLLKQAKVKRNVDSVLRWESIILDPIGPIIALTAFYVFQIFEEGIGLVVIILFILKLLAAILIGFGAAFLFNWLISQDKIPQSLMPPIQLVFILLTFSICDEILSESGLLAVTIFGLMMARKKRHDLIFKESDHFIDNASSILVSTVFILITSSLTKDVLLNVLSWQLILFSLVMIVLVRPISVLLSTLGTEITKKERAVVALMAPRGIVVLTVAQFFSSLFMDDKIPMAQYITPVTFGLVFITVVIYGFGFTPLSKLFGVASTEPPGVIIVGESEFSFHLGINLRDHGIPVMMFNLFENTSEKAHEAGFEVFKGNLLSSNDRIYSDLLRYNKCILMTQSFIFNSLAFNELVPEFGLNNVDMMPVSFNDEQARNNLNGPIRNHILFDENHTPRWFNQFITQHNIVEVPAEDYEKITENDMLIYHINEDKEVTFKRSNRDIPEHETGVYGILKNAYLT

SEQ ID NO: 4855 - protein, 324 aa, Staphylococcus epidermidis
KYLDKWEELTLKKYLNYTLILIALSLIVLSGCSLPGLGDGNAKDDVKITTTETSETKIIGHMEKLLIEHETDGKIKPTLIGNLGSSIIQHNALQRGDANMSAVRYTGTELTSVLAAKPTKDPDKAMSETQRLFKKKYDEKYYHSLGFANTYAFMVTKETAKKYHLKKVSDLEKYKDELRLGMDTQWMNRAGDGYPAFVKDYGFKFDSARPMQIGLVYDALKNNKLDVAVGYSTDGRIAAYDLKILEDDRKFFPPYDGSPLANEQLIKDNPEIDKALKKLEGKISTEEMQKLNYEADGKGKEPAVIAEEYLKKHHYFEEKKGGHK

SEQ ID NO: 4856 - protein, 42 aa, Staphylococcus epidermidis
NYIDLFYNLNYDLFLYYFTTNYIYRKFIPHNHLNVVNIETLF

SEQ ID NO: 4857 - protein, 43 aa, Staphylococcus epidermidis
YQIELNEFLSLIHNYWYIKKLETIMIVPSFYYKYFIFYKLSSY

SEQ ID NO: 4858 - protein, 148 aa, Staphylococcus epidermidis
MYVENSYLSKQLCFLFYVSSKEIIKKYTDYLKEYGLTYTGYIVLMAIEDDEKLNIKKLGERVFLDSGTLTPLLKKLEKKNYVIRTREEQDERNLQISLTERGKDIQNVLSDISQSVFNEFNITQEETQNLVEDLQNFVTKNFDKTVEK

SEQ ID NO: 4859 - protein, 191 aa, Staphylococcus epidermidis
HMQEDRKFEVKWRLVNSSTFMYGTKLRFNQDNIYFENPLMPSGTIIHSWYMLTDFAEDRVSPKLPILKKGRQYQFQFNFEVEPEGAAYFKMKFYRKNKEILSHQILKNKKENIVYPREAYSYELELINAGMNHLSFHNIIVQELREDSNQAYEATQYIDPKKKLKVINQIITNIRTHHLDTSNYHRSDTNG

SEQ ID NO: 4860 - protein, 420 aa, Staphylococcus epidermidis
CSEEKEEMSMTNGPIQVNSEIGKLKTVLLKRPGKELENLVPDYLDGLLFDDIPFLKVAQQEHDHFAQVLQDEGIEVLYLEKLAAQSIEDSNVREQFIDDVLAESRKTILGHEKEIKKLFSTLSNQALINKIMAGVRKEEIQLESTHLVEYMDDKYPFYLDPMPNLYFTRDPQASIGRGMTVNRMFWRARRRESIFISYILKHHPRFKDENIPLWVDRDCPFNIEGGDELVLSKDVLAIGISERTSAQAIERLARRIFKNPLSTFKKVVAIEIPTSRTFMHLDTVCTMIDYDKFTTHSAILKSEGNMNIFIIEYDDKAEDIKIQRSSHLKQTLEKVLDVDEITLIPTGNGDIIDGAREQWNDGSNTLCIRPGVVVTYDRNYVSNQLLREHGIKVIEIPGSELVRGRGGPRCMSQPLIREDL

SEQ ID NO: 4861 - protein, 465 aa, Staphylococcus epidermidis
NGEEKIMADKLQRELSNRHIQLIAIGGAIGTGLFLGAGQSIHLAGPSILLTYIIVGFVLFMFMRAMGELLLSNLGFKSFGDIAHHHIGSMAGFMVGWTYWLTWIISGMAEVTAVAKYVSFWYPTIPNWLTAAATILVLVALNLFSAKLFGELEFWLSIIKVLTILALIAVGVVMIVFGMKTSYGPATVTNIWKDGGFFPNGAQGFFMSFQMAIFSFIGIELIGITAGETKDPHKTIPQAINNVPFRILLFYIGSLAVIMSVVPWQQLNPADSPYVKMFGLVGIPFAAGIINFVVLTAAASSCNSGIFANSRTMFGLAGRKQGPAFLHRTNKHGVPHYAILVTCGLLSISVVLNAIFKDATKVFVQITTFSTVLNIMIWTIIMIAYLGYLRHEPKQHKESNYKMWGGKYMAYSILGFFAFIFIILLINSATRYAVLSAPVWFVIMLLMYQKYKKESRKAKIKNEEE

SEQ ID NO: 4862 - protein, 478 aa, Staphylococcus epidermidis
VKEDGVVGSTVKYRKFILPIVVGLIIWALTPIKPDALNDQAWFMFAIFVSTIIACITQPMTIGAVSIIGFTIMILVGIVDTKTAVQGFGNSSIWLIAMAFFISRGFVKTGLGRRIALQFVKLFGKKTLGLAYSLVGVDLILAPATPSNTARAGGIMFPIIKSLSESFGSSPRDGSERKMGAFLIFTEFQGNLITSAMFLTAMAGNPIAQSLAEKTAHVQITWMNWFVAAIIPGLISLIVVPFIIYKLYPPTVKETPNAKKWATEQLEEMGHMSIAEKLMVGVFIIALALWVLGSFINVDATLTAFIALALLLLTGVLAWSDILNETGAWNTLVWFSVLVLMAEQLNKLGFIPWLSKLIAQGLNGFSWPIVLVLLILFYFYSHYLFASATAHVSAMYAALLGVAVASGAPPLFSALMLGFFGNLLASTTHYSSGPAPILYAAGYVTQKRWWTMNIVLGIVYFIIWIGVGSLWMKLIGMM

SEQ ID NO: 4863 - protein, 41 aa, Staphylococcus epidermidis
LERELKLKIKRYSLHYMRVWRRIRVKFRHRRATGLICSIFL

SEQ ID NO: 4864 - protein, 42 aa, Staphylococcus epidermidis
KGREVKNIKIEVKYSENSQRPNKFDVSCEINGEERLYSIENI

SEQ ID NO: 4865 - protein, 262 aa, Staphylococcus epidermidis
KLLEAVNMFKIGNLELQSRLLLGTGKFENEEVQSKAIEASETNVLTFAVRRMNLYDRNLPNPLANVNLKDFITFPNTAGAKTAQEAIRIAEIANHAGVCDMIKVEVIGDDETLLPDPFETYEACKVLLEKGYTVCPYISNDLVLAQRLEELGVHAVMPLASPIGTGRGINNPLNLSYIIENASVPVIVDAGIGSPKDACHAMELGADGILLNTAISAAKDPVKMAEAMKLGINAGRLSYEAGRIPVKYTAQASSPSEGLGFL

SEQ ID NO: 4866 - protein, 206 aa, Staphylococcus epidermidis
RCMEQIITDFISKWGYTAIFILILLENVLPVVPSEIILTFAGLLSVKSHLSIWTLLIIATIASFIGLLILYYICRLISEEKLYRFVDRHGKWMKLKSKDLKRANDWFKKYGAWAVFLCRFVPVLRVLITIPAGINRMNVIQFTTLSLIGTTIWNFALILLGRLLSDSFDALMNGIHTYSRIMYVIIIIAVIYFVIRYLMKRRRSVK

SEQ ID NO: 4867 - protein, 263 aa, Staphylococcus epidermidis
LVMDIQKFESYLKIKHSYYSNPSLEALNYYVRRFMITVPFENINVQNKIPISIDIKDLYNKIVIQRRGGFCYELNHLFATYLEHKGFHVTRAAATVHTPNGGRSPEGSHMSLYVNIEGTLYITDVGFGDLPTSIIEIGSKTQFIPTYDKNGVYCAVWINDNQYALQKLRQNKWMTLYEAHLKPQSIKDFKDKISYNEHHPHSIFVRHLLITQPQSFGRATMTYHSLTLSNDSTKHKYDVTTNNYKYFLKKYFNLNVSIIPFEP

SEQ ID NO: 4868 - protein, 274 aa, Staphylococcus epidermidis
LWMERLENKIAVITGASTGIGQASAVALAIEGAHVLALDISDQLEETVQSINDNGGKATAYRVDISDDKQVKQFSEKIAQEFGHVDVIFNNAGVDNGAGRIHEYPVEVFDKIMAVDMRGTFLVTKFLLPLMMKQGGSIINTASFSGQAADLYRSGYNAAKGGVINFTKSIAIEYGRENIRANAIAPGTIETPLVDNLAGTSDEEAGQTFRENQKWVTPLGRLGTPDEVGKLVAFLASDDSSFITGETIRIDGGVMAYTWPGEMLSDESWKNSTK

SEQ ID NO: 4869 - protein, 63 aa, Staphylococcus epidermidis
NSTDKASWGSGPQQREFHREIPRTRQVVGNLDNLFKIRCVFNYDKLSSLFCFVTMNCNVKAFR

SEQ ID NO: 4870 - protein, 149 aa, Staphylococcus epidermidis
IYSLLINNKEICPLDLTNQKILHLLEQNSKLSLSEIGKEVNLSTPSVRERIYKLIDSKIIERYTIDINYDALGFDINVLIEVTIKNNLYKDFKAFISVQNNVDFCYRISGDSCFIFKAHFKKMSEVETLINEIQYYGHTKTHFIFSETK

SEQ ID NO: 4871 - protein, 353 aa, Staphylococcus epidermidis
PHKEVFTMSEERKLTFMGAINEAIDQSMEKDEDVILIGTDVSGGAKVDHIKDDDTFGGVFGVTKGLAKKYSRKRVIDTPIAEHITLSTAVGAAATGLRPIAELMFNDFIGFGLDPILNQGAKMRYMFGGKAKIPLVVRTVHGAGASAAAQHSQSLYNMFAAIPGVKVVVPSNPYDAKGLLMSAIQENNLVVFSEDKTLLGQKGNVPEEPYTIEIGKANVTREGDDLTIVAIGKMVAVAEETAEKLAEDQVSVEVIDLRSVSPWDQETVLDSVKKTGRLIVIDESNPQCNIAGDVASVIGDVGFDYLDGPIKKVTAPDTPVPFAANLEAAYMPNADKVLDIASELIDDLKKANA

SEQ ID NO: 4872 - protein, 317 aa, Staphylococcus epidermidis
NCKEMEYMKIAIAGSGALGSGFGAKLFQHGYDVTLIDNWEPQVTTIQQDGLHIDINGEAHHFRLPMYRLTEIPKATSYDIVFLFPKSMQLEEVLSHIQPHLHDNTIVVCTMNGLKHERLIQQYVSIDRIVRGVTTWTAGIDQPGHTHLMGQGPVEIGCLVPEGKESVDIIVNLLQNAELKGVKSEHLHQSIWKKICVNGTANSLCTILECNLAALNNSDDAKNLIYKITQEIVHVATVDDVHLNVDEIFDYLIALNDKVGPHYPSMYQDLIKDNRTTEIDYINGAVSKLGKENHIATPVNDFVTNLVHAKENQRGAQ

SEQ ID NO: 4873 - protein, 425 aa, Staphylococcus epidermidis
MKSLDKGFRHLTRKDKLKKLVEYGWLDDENYEILLNHPLINEEVANSLIENVIGQGALPVGLLPRIIVDDKEYVVPMMVEEPSVVAAASYGAKLVNQSGGFKTISSERLMIGQIVFDDVEDTGTLANSIYQIESQIHQIADEAYPSIKARGGGYQRIEIDTFPNHRLLSLKVFVDTKDAMGANMLNTILEAITAHLKVKFSNQNVLMSILSNHATASVVKVQGEIDIEDLHRGERSGEEVAQRMERASVLAQVDIHRAATHNKGVMNGIHAVVLATGNDTRGVEASAHAYASKDGHYRGIATWEYDRSRNKLVGTIEVPMTLATVGGGTKVLPIAKASLNLLNVENAQELGQVVAAVGLAQNFSACRALVSEGIQQGHMSLQYKSLAIVVGAKGEEIAQVAEALKYESQANTAKAQEILMNIRKS

SEQ ID NO: 4874 - protein, 45 aa, Staphylococcus epidermidis
THLLVNKYKFKVNYSVKIECYVNFLGETDVSLNTIYTLLNSEKSA

SEQ ID NO: 4875 - protein, 308 aa, Staphylococcus epidermidis
LNLLLNYIKTRGICMDIKHMKYFVEVVKQGGMTNASKSLYIAQPTISKAIKDIEAEMAVPLFDRSKRSLVLTDAGKIFFKKCQEIIALYDNLPTEINSLYGLETGHITISMSAVMSMRKFIGVLGDFHQLYPNITYNLIESGGKTTENLILNDEVDIGVTTLPVDHQKFECISLNKEELTVVLNKEHPLAQKSSIKMEELADENFILFNEDFYLNDKIIENAKNAGFVPNMASQISQWNVIENLVINQLGISILPATIAQLLNDDVKIVHLENAHTTWELGVVWKKDKRLSHATNKWIEFLKERLSEE

SEQ ID NO: 4876 - protein, 479 aa, Staphylococcus epidermidis
QRLLGYLKFTRNYFSVLYIIIRLGGYNMFNFLKPARHIKSLPAEKVDDTYKRLRFQVFLGIFIGYAGYYLLRKNFSLAMPSLIEQGFIKGELGIALSAVSIAYGFSKFVMGTVSDRSNARMFLTLGLVLTAIINLLLGFIPFFTSSITIMFIMLFLVGWFQGMGWPPSGRVLVHGFSVSERGSKTSIWNVAHNVGGGLMAPIATWGISMTALYNFGYLKGFEGVFIYPALLAIIIAIFSYILIRDTPQSQGLPPIEQYKNDYATSTKQTIETELTTKEILFKYVLNNKWVWAIAFTNIFVYFVRYGVLDWAPTYLSEEKHFDLSASGWAYFLYEWAGIPGTLLCGYLSDKLFKGRRGPAGFFFMLGVTIFILIYWLNPPGHAWLDNLSLIGIGFLIYGPVMLIGLQALDYVPKKAAGTAAGLTGLFGYLFGAVMANIVLGFVVQHFGWHIGFVLLTVISILAMLCFILTWNKRGQEQID

SEQ ID NO: 4877 - protein, 62 aa, Staphylococcus epidermidis
SKLLHPLNIKMMIDTIINFFNISAPCYDQFIRLSLYLLHYKKAIVININVNCKLIMFENVKA

SEQ ID NO: 4878 - protein, 44 aa, Staphylococcus epidermidis
MCILDVNKIIACYWLCRHEQIRVSIFRDMKLIVLFVHAFFVARK

SEQ ID NO: 4879 - protein, 317 aa, Staphylococcus epidermidis
QMVLFLQPVFQERLWGGTNLTQFGYDIPNNSTGECWAISAHKNGPNTILNGKHKGKSLKQVWDEDKALFGNDSRKDFPLLTKILDAHDCLSVQVHPDDEYALKHEGEYGKTECWYILDAQPGAEIIYGVNATSKNELEHMIDHHQFDYLFKHVPVKPGDFFYVPAGTVHAIGSGILILETQQSSDTTYRIYDYDRKDKNGHTRELHLNQSKDVIDITTTEPNTTPKTEMINGNCHTQFVANHFFTVEEWSIKDILDFQKPHTYCLVSMINGHGQVSINNKVYKIDKGDHFILTSEDQYIKFVGNMDLIVSFSKDEAY

SEQ ID NO: 4880 - protein, 51 aa, Staphylococcus epidermidis
FNSLNKLLHRSFKFLNYTNYISELKRLEINYFSYFLKSYIICINRSKERKV

SEQ ID NO: 4881 - protein, 120 aa, Staphylococcus epidermidis
VASLLECIVTAPAGLIYVIYLWQQQHITFGLNISSFWLLFSGAITAIPLILFSAGAKRIPLSLTGFIQYVGPTIMFILGIFVFKEPFNTDQLITFIFIWIGIVLYSISQYVQIKKNPVVK

SEQ ID NO: 4882 - protein, 454 aa, Staphylococcus epidermidis
KESLLGGNSMSKVNHLIDEDERYFAHSGRIKYYPLVIDHGYGATLIDIDGKSYIDLLASASSQNVGHAPKPVVEAIKNQTEKFIHYTPAYMYHEPLVRLSKKLCDIAPGNYEKRVTFGLSGSDANDGIIKFARAYTGRPYIISFTNAYHGSTFGSLSMSSISLNMRKRYGPLLNGFYHIPFPDKYRGMFEQAKPNTVEEYLAPLKEMFTKYVPAEEVACIVVETIQGDGGLLEPVPGYFEALQELCHAHNILIAVDDIQQGLGRTGKWSSVDHYHFTPDLMTFGKSLAGGLPMSAIVGRKEIMESLEAPAHLFTTGANPVSCEAALATIKMIEDEDLLNASWKKGSYVRKRIDPWIERYQYVGDVRGIGLSIGIDIVSNKIEKTRDSEAALKICNYCFENGVIIIAVAGNVLRFQPPLVITYKQLDKALDTIEEALEKLERGELNQYDISGQGW

SEQ ID NO: 4883 - protein, 64 aa, Staphylococcus epidermidis
PMTLDAIYQALGKNVKDNNINPMTVKALPSNKGLLGPNDCNIISPTRIIINTAIRYVSEIYPVS

SEQ ID NO: 4884 - protein, 41 aa, Staphylococcus epidermidis
NETLYRMHAYACVLFFVEILLQLKAENIFDYYTKIYLSGEK

SEQ ID NO: 4885 - protein, 320 aa, Staphylococcus epidermidis
QGALILKKLIIVSIIILMLSGCSSFDHRKRESINDKNKMKVYTTVYAFQSLTQQIGGKYVDAQSIYPAGADLHSYEPTQKDMIDIAKSDLFVYSSHQLDPVAAKITNSMTNNSMKLALAEGLKQSDFIHSKDHDENHEHHSHHEESNQDPHVWLDPVLNQKFAFMIKEKLIEKDPKHQAYYNKNYKIVNKDIVHIDQQLQSITKHSKRDKVVISHDSLGYLAHRYGFKQQGVKGMNDEEPSQKEILNIVKDIQHSHAPYVLYEQNITSKITDVIKKETDTKPLSFHNLAVLTKEEQNDDSISYQSLMKKNIYVLNRALNN

SEQ ID NO: 4886 - protein, 45 aa, Staphylococcus epidermidis
IQFCRRKVQKLKNCLLKMISKNLIIKMNIDIDLNYTFNIGIIFKI

SEQ ID NO: 4887 - protein, 254 aa, Staphylococcus epidermidis
KGVCIVLLEVKNVKKVYGRGMNTTMALNQMNLEIDENEFVAIMGESGSGKSTLLNLIATFDRTTEGLIKLDGLPLNQLKNKDIARFRREMMGFVFQDFNVLNTMSNKDNILMPLVLANERPKIMQKRLMEISEQLGIEDLLEKYPSEISGGQKQRIAIARALIARPKLLLADEPTGALDSKTSKNLMCLFRKINQKHQTILMVTHSNIDASYANRVIFIKDGRLYHEIYRGEESQTDYQKRIADSLAILNGVGD

SEQ ID NO: 4888 - protein, 44 aa, Staphylococcus epidermidis
TISCVILYIKFLASSLLFSAAKLHSSIVHNELAVPLTHIFFQID

SEQ ID NO: 4889 - protein, 138 aa, Staphylococcus epidermidis
TMPWTMEDYPQSWKNFEELERKKAIDIGNAMLKDGYKESDVIPIATNQAEKWYQHASKEELETLKNKHITQHQEDESANPKLNEENVHVYYEDQLWKVKSTEAKRASDTFDTKSEAVNRAHHIAENKGTKVVEHRKDE

SEQ ID NO: 4890 - protein, 54 aa, Staphylococcus epidermidis
MLNCSSDVTYVSQSIINNRNHSITPLDDGIRPSSFCAREIFNALAKDLNIASIS

SEQ ID NO: 4891 - protein, 41 aa, Staphylococcus epidermidis
VIDWYLSILRSVDAKLTKDLLLSVLEVVGVENCFALVVVLT

SEQ ID NO: 4892 - protein, 80 aa, Staphylococcus epidermidis
MNCCHRLLKQKQVQQCKVKVFSFNQTPYSYYSNRNKNILSRYYIIVNKELLANKCSESSNSINYYFKLFTNRNNYYLQIT

SEQ ID NO: 4893 - protein, 249 aa, Staphylococcus epidermidis
MKFCPHCGNPIKKEQSFCNKCGKHLKTSTQRKSENQIEHMREQQSYISREERQHHDSTFYKEQKHTGWLIVLSIIFVLLIAALLYGAYYAYNHYISDEQSHQTTESQQSNESDQNRDQSTGPSIDVFSDDFDQGYMKSASTSGYRGVYNGMTREEVEDKFGTSNGSVESLKWSYETYGDLAVAYDDNEVVSVGVAPNHISEDQFLSMYNEPDDRNSSQLIYDSNKDNDFSVLVNVKNGDVTVIENVNQI

SEQ ID NO: 4894 - protein, 42 aa, Staphylococcus epidermidis
VCSCFILVKINSYVITLKGASSCYDCRTHNNIYIKCFHRRYG

SEQ ID NO: 4895 - protein, 262 aa, Staphylococcus epidermidis
MKRLLLCIVALVFVLAACGNNSSNNKDNQSSSKDKDTLRVGTEGTYAPFTYHNKKDQLTGYDIDVIKAVAKEENLKLKFNETSWDSMFAGLDAGRFDVIANQVGVNKDREKKYKFSEPYTYSSAVLVVRENEKDITSFNDVKGKKLAQTFTSNYGQLAKDKGADITKVDGFNQSMDLLLSKRVDGTFNDSLSYLDYRKQKPNAKIKAIKGHAEQNKSAFAFSKKVDEKTIEKFNKGLEKIRDNGELAKIGKKWFGQDVSKPE

SEQ ID NO: 4896 - protein, 54 aa, Staphylococcus epidermidis
VILCNDSEVYFFDIQRQKRYFISIQISESLFFLILSTINKNFFPLTLFIDRADT

SEQ ID NO: 4897 - protein, 176 aa, Staphylococcus epidermidis
TLRLKVKGSMKMKSSVRLLNHIIKIMNLQQSLIIRDEQWNQSYEAYNFNINGYVFKSRLAKKTTKKKGYFLSLWEKDKTKKNRAFDYESFPGKLIVHVLDDSQVGQFIFPKHVLFHKGILRNHASKGKMAFRVYPTWEKDLNRVAHKTQEWQKQYFIDMSQTIDVPSIKRAYFNED

SEQ ID NO: 4898 - protein, 44 aa, Staphylococcus epidermidis
HYLCLNISFNLCLSREFFKLIASLTYSYVIIIERKNLFDYCIDV

SEQ ID NO: 4899 - protein, 396 aa, Staphylococcus epidermidis
KGVWKSMEESKNYNLITTIMFISGIIVMASLYTALPLTATFAEDFHVPKSIATLNGVLFSLTYSISCLFYGTISEKYGRIKTILVGMSALVIICLMIGIVHSFTVLLILRALQGVFAASFSPVVMTYTTETYPRVKRVTAISFISTSFMLSGVLGQNMSELVVSYLNWQWVYFILTILYLILVLVIYKNVPESPHKNPDIQLIKFFNNFKDFKDNLKVFYCLFISLTLLIMFISMYDILNEYVTSHQVGGDMSVSSMMKLFGVIGMLLSLLAGRVSSRIGMKRLLTIALTTCIVSIILMGVTTNIILITTFSVLFVAGIAFAIPTVISKIGVVVKNNQGFFLSVNTFVLFLGTAIAPILMLFVGELSNFFLQFLMIAIVGLIALVVSIFMPGDQRS

SEQ ID NO: 4900 - protein, 53 aa, Staphylococcus epidermidis
IIFLVSSDYLLVTHLIFCYPSYIYSSQLAINLYTYILHVVYHFLKLLIIIVSN

SEQ ID NO: 4901 - protein, 213 aa, Staphylococcus epidermidis
LNGWRNFFMDKLTVGLEWFLNPDHMPLILGIEKGWFKEESLEIEMIEPKEHFDALDEIENGSMDIAITEPIHLVQDRAKEQKVIGFARYLHTNGGIMYNKDKNIARPKDLIGKRLQYPGAPGPGGIAMAKTMIEADGGTFEEGDITPVNHSFYHTDALLTDKADAATLIFENFEILEARNQGLNVDYFPLKNYNVPDFCQLIFITTPEVLNTE

SEQ ID NO: 4902 - protein, 510 aa, Staphylococcus epidermidis
SRGCSMKIKLFVIVVIFLMTILSIISITTREIAHSKNETILTHASQKHIDKMVETAMKKGDIPGLAILIIKDNKIFLNKGYGYANIEKKAKVNPHTQFEIASNTKAFTGYAILQLAQEGKINLNDKVSTFIPGFKMKYEDKERDITIEQLLAQTSGIPGDITEENRYSKQYDSIENIVNFAKGKRLNHVPGETFEYSNMNYDILGLIIQNVTHQSYTSYIQKHVLAPLKMKHTTFKVNNTKSNNEALGYIWEDNENKVAQPEFNIGDTPAAYMMSSTSDLAKWVQLQIHPTSKSQAKLIRQSHQVLSNSLNSEPNADSYGSGWFINTDDHLVFHTGVLDNFSSQILLNIRKSYGIVVLANTNSNQVTRLAEHLNTQIMNNRHYTTIEEKVNQTKDMQLIISTLADIFMVIFSILVFSKILKLREGHIFIRKCLRTSIMFSIILLGFVAMNILFYLLPLIILGDATWGFVLSWLPLHSKYLVVSVYLAITMLLVWLSLISITYRSDKKKKH

SEQ ID NO: 4903 - protein, 650 aa, Staphylococcus epidermidis
LNLWDVRERKIGMQQIINSLIHFDRSKIDIAKGIRQGFLMILPALIGYLLGFPMFGILISTGTLAHVYVFSGSPQSMLKTVITCSLSFTICMILGTLTVSQPILFGLLLLIVVTIPYYTFNALKIAGPSSTFFLVTFCLSINLPIAPEEALLRGSAILIGGILATITVILTIIFAKEKAEDRAIHADFKTLHNLLHHFDEPEDFKAYARNAVTEFRNSEKLLITSTSGGNGKLSKRFQKLILLHTSAQGIYSELLELNENHIRPLPSDLVEMMDHIIKNVQQPKQQYRPWSKVVDVAPEFQNLMDHILKIDEMIHANDNQIKYEADIRKPLYSKRIYQNLTFDSIVFRNALQYTVIMAVAIFIALAFNIQKAYWVPLSAHTIMLGNVTTIRTLDRSLARGIGTIIGTIVLSGILAFHIDPIFAIIIMGFSAMMTEAFVASNYAFAVIFITTQVIMLNGLASQNLNIEIAYTRIIDVLIGIAIAVIGIFILARKTASSMLSDAIAELVRKEGILFHYLFSKNKQETNERDRVESLNLNVKISNVTQIYNSANGELFSNKEAVRYYYPSIFALEEISFMLERAMNNKHRQTINDDLMGEYLVVFENIAKHFQFQADLNIRDMQPLPQYNYIRASLMNIQRNCAEQRQAITKD

SEQ ID NO: 4904 - protein, 203 aa, Staphylococcus epidermidis
MKQWMNRLITLIGVLLIILAIYLFSKPYIDNYLHEKDNDHKIENYDKKEKEQTKTSKSTPKIPSDKSKMAGYIEVPDAQIKEPVYPGPATPEQLNRGVSFAEGDESLNQQNISIAGHTFTDRSHYQFTNLKSAKIGSKVYFKTGNQTRKYKITKIRDVKPTEVKVLDEHPNKKNQLTLITCDDYNEETGVWETRKIFIATQIN

SEQ ID NO: 4905 - protein, 46 aa, Staphylococcus epidermidis
KLCRTSYPFFYNKFLLITEKSYYKFKYTLFLKFSINLMFKNLTKAR

SEQ ID NO: 4906 - protein, 42 aa, Staphylococcus epidermidis
KCSRVAIMTFNINFYKMRIKSLNKERDSIDGKSKITNIKIYW

SEQ ID NO: 4907 - protein, 57 aa, Staphylococcus epidermidis
KPMLYVPFLINTHENHYKAFYEKKKSNFLNKNYFLNIDKFDCKIQTFLKKLTLFHQL

SEQ ID NO: 4908 - protein, 232 aa, Staphylococcus epidermidis
GVIFMTGNQMFCRENELDESFKQLASYINIPVGVLLPFKSQCFVRHYNKGQIVYYSSDETTHIYLLLKGNIMRENFNLNGDVYRYLNREKVLFPLNNLFQDKVPNEMCTALTDCEMIGIPRDLIEYLCKNHEEIFVKLFSLLSETQCQHIEYNMALTSKLAKERVTKILRYLCQTVGYDHDEFYEIKHFMTIQLLSDMAGISRETTSHIINELKEEKILFKNSKNWLVSKDL

SEQ ID NO: 4909 - protein, 191 aa, Staphylococcus epidermidis
RSSRKSIQRSRFPQPVAEKSAIAHAKKHREEYEKLGEQFFKDNFSLNVKATNVVGSGDGVEVYVHCDDHDIVFNASIPFDKEAIHEEGSMRSNDNGDTMSNMVGTVLSGFEYKAQKEKYDNLTKFFKNNEEKYQYTGFTKEAIHKTQNVGYQNEYYYLAGNVTNINNYRKYYEPLIKKDSKSFKEGMKKSK

SEQ ID NO: 4910 - protein, 325 aa, Staphylococcus epidermidis
NCTRQEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 4911 - protein, 693 aa, Staphylococcus epidermidis
IEVLIVKTRQNKYSIRKFSVGASSILIAALLFMGGGSAQAAEQQQDKGTVENSTTQSIGDENEKLSEQQSTQNKNVNEKSNVDSITENESLHNETPKNEDLIQQQKDSQNDNKSESVVEQNKENEAFVKKHSEEKPQQEQVELEKHASENNQTLHSKAAQSNEDVKTKPSQLDNTTAQQEDSQKENLSKQDTQSSKTTDLLRATGQNQSKDSQSTEEVNKEVKNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 4912 - protein, 55 aa, Staphylococcus epidermidis
GRQRSSNASSAIVFIIGGTYSLLHQPNLALFNYWAVLIIAFNQWGGSMFSGTCFI

SEQ ID NO: 4913 - protein, 40 aa, Staphylococcus epidermidis
MHKRIVSFLTTSYFLLCHTIYLQVCHNKKRITTFLRKGFH

SEQ ID NO: 4914 - protein, 156 aa, Staphylococcus epidermidis
NGKRCREKIINQNRDIVATEKSLPPWKRFLSHFSFYAIALQYFVVQFVIALFLIWLPTYLTEQYHVNFKEMTISALPWLFMFFLILFGWSYFRQDFEYRSITFCCTWRNCDCGICGILNFNFLSSTYRQLICNHFLVITLFRWRTYFYGNELGCSH

SEQ ID NO: 4915 - protein, 49 aa, Staphylococcus epidermidis
VNKRDDIRIPFSSENDVKNKLFNIVYAYNAVKKNFKQAEDSRNPRGQNL

SEQ ID NO: 4916 - protein, 208 aa, Staphylococcus epidermidis
GKWRFFIVEIGGIFIFIAITYHKQLTKDDLQHYKHIEEAIDGLLFRTSMNNEENKEMIQSLLQLGFSKDKIIIHSDVTLLEDLHLKRIHFKENDTTAFTYKEAHPDICVSMSTHDVETVKRCYENGLDSVFFGHIFPTSSHPNVPPRSKEAIQQALNVPIPIYAIGGINEHSLQKMPPGFKGICAISYFNNASLEEIKQLRKEWSTHA

SEQ ID NO: 4917 - protein, 198 aa, Staphylococcus epidermidis
YIFRKLNKGEILELKDKIIDNAITLFSEKGYDGTTLDDISKSVNIKKASLYYHYDNKEEIYRKSVENCFNYFIDFLLRNHDDNYSIDGLYQFLFKFIFDVDERYIKLYVQLSSAPEALNSEIKHHLQEINTTLHDELIKYYDPTHIALDKEDFINLILLFLETWYFRASFSQKFGIIEDSKNRFKDQVYSLLNVFLKK

SEQ ID NO: 4918 - protein, 40 aa, Staphylococcus epidermidis
TIFRQSEFIENSSKPHIKECAGLFVYLEFLTWKLKQILKL

SEQ ID NO: 4919 - protein, 156 aa, Staphylococcus epidermidis
REFRIKCFTEEINMNWLKIFYHLLCATTISVILLIITILMDVLLQNTHLTQLLLNIDFLINPDEVPTIIEVLIHLSIGILIYLAFLIIYHYSKSLYHLAYLPLVLIFTLMYPLLVFLAQRPFFSFSWNEFAWWLVAHLFFIILMATCLPIISKKIL

SEQ ID NO: 4920 - protein, 124 aa, Staphylococcus epidermidis
TILRERLSISLCLSARLSNLIRSRPSIIKNEIIISVNITIKGTLASNDAVFNTSNARSPPTSIKENGSKHNANAQNKRLARNGSPITFFCDAAAKIYEPESNVVAKNKKADIKNKIIVIVENGS

SEQ ID NO: 4921 - protein, 518 aa, Staphylococcus epidermidis
GVIRMVVPFKNEPGIDFSVQTNVERFNEELRKVKAQLGQDIPLVINGEKLTKTDTFNSVNPANTSQLIAKVSKATQDDIEKAFESANHAYQSWKKWSHKDRAELLLRVAAIIRRRKEEISAIMVYEAGKPWDEAVGDAAEGIDFIEYYARSMMELADGKPVLDREGEHNRYFYKPIGTGVTIPPWNFPFAIMAGTTLAPVVAGNTVLLKPAEDTVLTAYKLMEILEEAGLPQGVVNFVPGDPKEIGDYLVDHKDTHFVTFTGSRATGTRIYERSAVVQEGQQFLKRVIAEMGGKDAIVVDNNVDTDLAAEAIVTSAFGFSGQKCSACSRAIVHQDVHDEILEKAIQLTQKLTLGNTEENTFMGPVINQKQFDKIKNYIEIGKKEGKLETGGGTDDSTGYFIEPTIFSGLQSADRIMQEEIFGPVVGFIKVKDFDEAIEVANDTDYGLTGAVITNHREHWIKAVNEFDVGNLYLNRGCTAAVVGYHPFGGFKMSGTDAKTGSPDYLLNFLEQKVVSEMF

SEQ ID NO: 4922 - protein, 956 aa, Staphylococcus epidermidis
RRIRLSNLIQDIKQSLYKGFIDKDSSHKGNFVPRLLVNNKEENVLSTIIDQLHNCQSFCISVAFITESGLASLKSHFYDLSKKGVKGRIITSNYLGFNSPKMFEELLKLENVEVKLTNIEGFHAKGYIFEHHNHTSFIIGSSNLTSNALKLNYEHNLFLSTHKNGDLVNNIKHKFDELWDSSFSLTNEWINEYKQSFEYQTLQKVFDNTVVQNSEIKKFNESKLIKPNLMQEHALKSLESLRNVGGEKGLIISATGTGKTILCALDVRAYSPDKFLFIVHNEGILNRAIEEFKKVFPYEDESDFGLLTGKRKDHDAKFLFATIQTLSKKENYKFFNSNHFDYIVFDEAHRTAASSYQKIFNYFKPNFLLGMTATPERTDELNIFELFNYNIAYEIRLQEALESNILCPFHYFGVTDYIQNEMSQEDAFNLKYLASNERVEHIIKKTNYYGYSGDVVKGLIFVSSRGEAYQLANQLSKRGISSVGLTGKDSIAYRTETIQQLKEGSINYIITVDLFNEGIDIPEINQVVMLRPTKSSIIFIQQLGRGLRKSTNKEFVTVIDFIGNYKTNYMIPIALSGNKSQNKDNYRKFLTDTTVLNGVSTINFEEVAKNKIYNSLDSVKLNQPKLIKEAFNNVKDRIGKLPLLMDFINNDSIDPSVIFSRFKNYYEFLIKNKIIENELSINEFKNLTFLSRQLSPGLKKVDIDVLKEVIQNDVTYENLTKKMLNINNDISEYDINTSLSILDFTFFKKTIGKTYGLPLIQYKDNLICLANEFKEALNKPLFNTFVHDLIDLANYNNDRYQNKKNSLILYNKYSREDFVKLLNWDKDESGTINGYRMKHRTLPLFITYDKHENISDNTKYDDEFLSQDELKWYTRSNRKLTSPEVQNILKHEENNTDMYIFVKKRDDEGKYFYYLGKAKYIKGTEKQDYMPNGNSVVTMHLSMNTSIRDDIYRYIT

SEQ ID NO: 4923 - protein, 51 aa, Staphylococcus epidermidis
NIVSYMLSLRYLQTSFNEITLCKHYKMITPHTNVHFSDKVMLVVKKERNQG

SEQ ID NO: 4924 - protein, 42 aa, Staphylococcus epidermidis
TTPSAPLLRSNKDKAIDIINVHLLGMLTIKMDKIINHSINLR

SEQ ID NO: 4925 - protein, 69 aa, Staphylococcus epidermidis
PFYSCFKVKFFKKYEIDLKKDILFMKSKLNERLEMKNRDCGSMKVYKKSRTEFNLNSLFYSLILYRNIC

SEQ ID NO: 4926 - protein, 287 aa, Staphylococcus epidermidis
KSNRKTLKLLYGYIKMKINVLCEKRDNMDIKQSSEKQGRPHHLSDSRTVLKRNFILIPTYILLQSIIPIIVVFGSLGITAMITQQAPPQWLYHCSLSLSFVIAQGLILIIFYKIHQSVINDVMKQQWIIAKNKIIKIVIVAIVVYLLLLIIRVIGTSLPNHLSYHLTQSEQRTLGLFKSPYVLLVTFISMVFLRPMVEQIIYRYLIIHELGKVWNRQFVIGLSIVIETIVHVYDMASIFEIFPYIVIASAATILYIKSRDNLIVAYIFQVILQCILFIEILCKYTNF

SEQ ID NO: 4927 - protein, 46 aa, Staphylococcus epidermidis
KYFRVCVDVLNFETKSKGEYEDEVFSSIVESHHKDNELTTIINYKR

SEQ ID NO: 4928 - protein, 285 aa, Staphylococcus epidermidis
LQLRVKRRKASDKVKDNNEVLKLFIVSDSIGETAQRMIHATLTQFPDLTQVEIKKFPYIKDEQEFLNVLQLAKEQNAIVATTLVSESFNALGHQFANEHQIPYVDYMSELISIIKQHTHAKPLMESGALRKLNDEYFKRIEAIEYSVKYDDGKHFTDIGEADALIVGVSRTSKTPLSMYLANKGYKIANIPLVPEVAIPDNVFQQKNLKVFGLTASPNYIANIRRNRAETLGLSSESNYNSLERIKKELSYAEEVFRKLNATVINTEYKSIEESAFYIEKFLAKR

SEQ ID NO: 4929 - protein, 42 aa, Staphylococcus epidermidis
RMCRLICIFGIFNLEVKTNSKTIAMAKDMIKFIKKGVLRMIY

SEQ ID NO: 4930 - protein, 50 aa, Staphylococcus epidermidis
TSLSKWGTSSAEYIGIASTIATTIEPNQQIRRALLPRNFSVCCPGCIPSK

SEQ ID NO: 4931 - protein, 219 aa, Staphylococcus epidermidis
VYLRSVCMEILVTAFEPFGDEKINSALEAVSHLETKIGCHKIDRLILPTVFHDSADMIAKVLKSKNYDVALAIGQAGGRSEITPERVGINIDDARIKDNQGHQPIDQVIRHDGAPAYFSNLPIKRMTMAIQKAGLPSRLSNSAGTFVCNHILYQLGYMADHFYPDLLFGFIHVPLIPEQTINHSQQSSMSVEDIVKGLTEAIKAIDFVEDNKIALGEIQ

SEQ ID NO: 4932 - protein, 460 aa, Staphylococcus epidermidis
KYISKGLCLLFNFSHYLFNNCIRGLFLGHGTRHSLYRKGKTIMLSIKNLTKIYSGNKKAVDNISLDIQSGEFIAFIGTSGSGKTTALRMINRMIEATDGQIMMNGKDVRNMNPVELRRSIGYVIQQIGLMPHMTIRENIVLVPKLLKWSKEKKDEKAKELIKLVDLPEEYLDRYPAELSGGQQQRIGVVRALAAEQDIILMDEPFGALDPITRDTLQDLVKELQQKLGKTFIFVTHDMDEAIKLADKICIMSKGKVVQYDTPDNILRYPANDFVRDFIGQNRLIQDRPNMKSVESAMIKPVTVKADDSLNDAVNIMRTRRVDTIFVVNNQNKLLGFLDIEDINQGLRARKELIDTMQRDVYKVHINSKLQDSVRTILKRNVRNVPVVDNDEHLIGLITRANLVDIVYDSIWGEEDSDSYEIPNESLDENNHDLPQNQTDTRTNINEDVNDYHDAQHRGED

SEQ ID NO: 4933 - protein, 40 aa, Staphylococcus epidermidis
NLISNKTKVYVKDVYQRDHVHFLTMNKVDLKIRKEEQRRC

SEQ ID NO: 4934 - protein, 586 aa, Staphylococcus epidermidis
KGRLFVKMAQIKANEALVKALQTWNIDHLYGIPGDSVDAVVDSLRTVRDQFKFYHVRHEQVASLAAASYTKMTGKIGVALSIGGPGIVHLLNGMYDAKMDNVPQLIIAGQTNSTLLGTKFFQQTNISKMVDDVAVYHHQIQKGDNVFEITNEAIRTAYEKKGVSVIICPNDLLTQKIKDTTNRAVDTTKPKPASPKFKSIKKAAKLIDKAKKPVMLIGLGTQHAKDELREFIEAAKIPVIHTLPAKTILPDDHPYSIGNLGKIGTKTSYQTIQDADLLIMAGTNYPYVNYLPKKNIKAIQIDTNEENIGARFKINVGILGDSKVAFHQLTENIKHVAKRPFLDKTLERKAVWDKWMKQDLNNDNSPLRPERLMKAINANLKDDAIISADVGTSTVWSTRYLNLSVNNKFIISSWLGTMGCGLPGAMAAKIAYPNRQAVAITGDGAFQMVMQDFATAVQYNLPMTIFVLNNKQLSFIKYEQQAAGELEYAIDFSDMDHAKFAEAAGGKGYVVKDVSRLDNIVEEAMAQDVPTIVDVHVDPNAAPLPGKIVNEEAFGYSKWAYRSITEDKNLDFDQIPPISVAAKRFL

SEQ ID NO: 4935 - protein, 108 aa, Staphylococcus epidermidis
EGVRMKGKEKVKVTTMNEMIPQIGKKVVVNEKEIGIFLTDNGDLYAIGNICPHKEGPLSEGTVSGDYVYCPLHDQKIALKTGEVQQPDTGCVETYEVEVIDGDIYLCL

SEQ ID NO: 4936 - protein, 51 aa, Staphylococcus epidermidis
HVTSYLTSIFRKILSFIMKSFYVLNYQFSIKIKTSCKVTNTLQEAYIIDQY

SEQ ID NO: 4937 - protein, 48 aa, Staphylococcus epidermidis
TNQSINLCSPKDYLIIAIARFHIISRFESNYFSERIPVVINIDHFLIS

SEQ ID NO: 4938 - protein, 236 aa, Staphylococcus epidermidis
IIERKFLFMPKLILCRHGQSEWNAKNLFTGWADVKLSKQGIEEAQSAGKKIYDNQIEIDIAFTSLLTRALETTQYILAGSDQQWIPVYKSWRLNERHYGGLQGLNKDDARKKWGEDQVHQWRRSYDVRPPRESEEQREAYLKNRRYQHIDHRMMPYCESLKDTLERVVPFWTDHISQHLLDDKTVLVSAHGNSIRALIKYLEGLSEEDIVGYEIKTGAPLVYELTDDLVVKDKYYL

SEQ ID NO: 4939 - protein, 300 aa, Staphylococcus epidermidis
GVESMNKEQLEKMTHGKGFIAALDQSGGSTPKALKEYGVNEDQYSNEDEMFQLVHDMRTRVVTSPSFSPDKILGAILFEQTMDREVEGKYTGDYLADKGVVPFLKVDKGLAEEKNGVQLMKPIDDLDETLDRANERHIFGTKMRSNILELNEQGIKDVVEQQFEFAKKIIAKGLVPIIEPEVNINAKDKSEIEKVLKAEIKKGLDSLNDDQLVMLKLTIPTEANLYKDLADHPNVVRVVVLSGGYSRDEANKLLKDNDELIASFSRALASDLRASQSQEEFDKALGDAVDSIYDASVNKN

SEQ ID NO: 4940 - protein, 284 aa, Staphylococcus epidermidis
QKGSITMHKRLFITLLGFIILLAGCDYSKEENQTGIFYNVFVKSMDGFLHFLGRVFQDNYGFAIISIVLIVRFILLPFMLIQVKNMHMMREKTKVVQPELDAIRDKMKHATSQEERNAANQLLMKKYQSYGINPLKNMLGCLPVLIQMPILMGLYMSLKYPSSHGITEYPHFLWFDLTQPDLIMTIIAAIMYFVQPLVNSIHYPKDQRKTYYFMMVFSPIFITYASLHSAAALGLYWSISAAFLIVQMHFAHSHYKKVALHEAKKLKQKLEQNKDNSELLTEES

SEQ ID NO: 4941 - protein, 453 aa, Staphylococcus epidermidis
NSLRVYKYNHAKCIYIYYIITFLNISNNSYLERISFMKKLITLIVMISFVLASCGGTSSTDKDTLNVEIPLKTKSIAPYETDIPVKTGALESLFKMSKNGKVKPLLVKNYHQVSDNQLELTLKDNIKFQNGHHLTGEAVKRSLEEGMKKSDLLKGSLPIKSINAHGQKVTITTKEPYPELMSELASPFAAIYDTKAKNKVTDQPVGTGPYKIDQYKRSQKIVLKQFKDYWQGTPKLKRINVTYHEDGNTRVDHLLSGKSDLTTDVPIERVDDVKKSNKANIQSTSGFRTHLMLYNHDSKKVNKKVREALDMIINRKDIAKNVSKNYAEPASGPFNHRLKSLEKEEIQSQDIKRAKELLAQEGYSKSHPLKLNMVTYDGRPELPKIGQVIQSEAKKANVDIQLRNVDDIEGYLKNKQSWDVSMYSYLSVPRGDTGYFFNTAYLPDGALNKGNYR

SEQ ID NO: 4942 - protein, 476 aa, Staphylococcus epidermidis
GHMRYRMTLQNHLKHRILLIYGDNSLKRCYMINLFENYNQETQELHQSLKRAGYNHFTIVINDDGFLPDDVTSPYRFFTAYQIYEDDTPAFFNDIDTPPFWEIKGDATMATITDMGELRGKIFYKEHYKTRVVSHVEWLDSKQRLRSVDYYTKEGFKFAETVYDLLGNAILKKYMTREGKEVIYENYVTNDVVVEYEGKSYFFESYTEWIKFYLSEMGIEIKEVIFNTLSTPFLAIYHLPTLKKGILFWQEQSQGYVPGNMKVMLSPNLQSRFAVIVPNQNEYKLIKEQLSREEQQAVYASGYLYDTYKRNHYSKNVLTLTNSDQIPHVETLVRLHKDYQFHIGAKTEMSSKLLSLSQYENVKLYPIIKEQTVQTLYQQCDIYLDINEGNEIGNAVRSAYNHQLLIMGYKEVVHNQDFVAIENQFLVNDISQLSNALKEIGNHRGQFETRLALQQRHANAVPVSTFKYALVQALSG

SEQ ID NO: 4943 - protein, 260 aa, Staphylococcus epidermidis
MVMSNTALCLTALLLLIPIFISYKEGLHIIKDLVIATIRATIQLLILGFLLHYIFEINEKWLLVLCVLVIIINASWNTISRASPVMHHVFWISFVAIFVGTALPLAATVATGAIKFTANEVIPIGGMLANNGLIAINLAYQNLEKAFVQDVSDIESKLTLAATPKLASKSSIRESIRLAIVPTIDSVKTYGLVSIPGMMTGLIIGGVDPLQAIKFQLLVVFIHTTATIMSALIATYMSYGQFFNARHQLIARTQRTRQSS

SEQ ID NO: 4944 - protein, 276 aa, Staphylococcus epidermidis
REMRIEKMKIGTISDLHIDRHPHLNPEIYLEKLCQVIKQRSIELLIIAGDISNDYRISYDFIQSIQELSGIPTYFVPGNHDLWSDQADKTSTEILSFFRSKEECLIGNPIIINDQYAIVGHVGWYDYSYADHRFSQQKIASGKHYGATWQDKVRTDWSLSDPKLSLLAAQEVEKDINNVSPRQIILVTHVVTHPQFVVPTPHRIFDFFNAFIGTHDFDTIYRNYPIRFSIMGHVHFRKKLVENNILYICPCLGYQRQWMTDDIAYEINHALVDFDI

SEQ ID NO: 4945 - protein, 124 aa, Staphylococcus epidermidis
VGVSMLKKLLVGVSVLTLLLAGCMSHEYADKIDKAVKLQEKKQQKIAKNDSGDEVKHFDKKDANIYVFDKGKYVVLEYKPLSDDAEARYYTYEFKDKKAYYNKDFNAKAYYQSHEPDYKEENMY

SEQ ID NO: 4946 - protein, 157 aa, Staphylococcus epidermidis
RKQRGMVILEQTHLVKNKTVDNKKSMKYSIFQQALTIAVILLISKIIESFMPIPMPASVIGLVLLFIALCTGIVKLGQVETVGTALTNNIGFLFVPAGISVINSLPILKQSPILIILLIIISTLLLLICTGFASQLLVTKSLFPSKEKNEETSHVGG

SEQ ID NO: 4947 - protein, 496 aa, Staphylococcus epidermidis
RTERSTMNYLKQYESFFWLIGIFIFYLIMAILTPLSTTDWHAYKVNLSQYLTQENGRYLGHLFEWVAVHNIIIRALIYAITSFLVIYLVAYMVQLHTNRFYFILSFVLMVTVPNTIYSETYGWFTGFFSYIPATVLSLFILFTVVKMIESHDTVSEMQLWVFLLVSLFGQFFLENLSIANSLIILIGMVVYFFVKKRLSYFLIVGFMLSCIGNIIMFLNFNYFLIKDGLNTHYSISDSHGMIHKAGVTLFKLVPEYMFINQMIILTVISIVSIVLLKQNKSLKHMRVYIKIPLLLGLITLPIYKIFVYNQFHFELYKASFSIAVLNTTICFIYMISVIYVVFKMIQQRYIRMIVMGSFIAMASSVLPLLFVTPISYRNFYFIYTLWIVILLCLIQQCDVLFKQLEHIIKIFAIIISIIMMIGFTFIHISSVHRIDFIKEQITQHHRYQKITLERLPFERYTHMTTPKSKEQLQDFKHYYDLPKDITFKVVPYGTKQ

SEQ ID NO: 4948 - protein, 174 aa, Staphylococcus epidermidis
KGWRIYALKKFSATIVVIILICALGFSLYAAINHHTNSNKNDKKIEHNRKNKQNDTSNQNRDTNQHQDQTQPTNNDYNNDNQSDTEQPAQQPNYHQYPNNNQQSGSNKNNSSENNKQKPNQNKTNQSDYQPSQSTPQQSSQPNNNQSDSQQNGNSNNNSNNQNHGTNDNQNKNR

SEQ ID NO: 4949 - protein, 451 aa, Staphylococcus epidermidis
FIRRIDMKVKSISRFFSMKKVTLSFVTLFIGVGTIGSYNQYADASMKTQQTHVTKSSPTQKTTSNFKRSVKDTSVKSRATSIKRATSTKQAISPKTSSTKKTTIAKKSTTVNKTRTTTKTQPTIRKSSTTSTRSKTMPTSVKRTTSHKATTVSPTSKAKISTKTQQSTKSHTTSVKKNTTQLSKTKSPSTSTKSKTVQSSTTKAQPTLSTQVSTTTKAKQFSTPTTSKTDSSKSLVSLASTERKIDKYQSMTQLEKETTEGVHWRKDTKNTGNQVLIVAPHGGSIEQSTTELTKTLADKGNYDYYALESIRPKNNSELHVTSTHYDDPTLNQMIKNRTATISIHGASGTEEIIYLGGPRSDLRNAIEKQLVGCGFTVKVPPEYLGGQNNKNFINKEDNNTGVQLELTTALRKAFFKNGDTSTKNRTNKENWTPTMEAFINALYEGINQTYS

SEQ ID NO: 4950 - protein, 162 aa, Staphylococcus epidermidis
LLIGRNKCMKGSKKLNELLEDNQKKLKKLFKYDHKKALAFTPEDREKVKDKFGVYVIFDEKKPVFVGQTGGYSSTHQPINSDLYTKLGQYNSRSETGTTKFRKAYAQNKDLNPNHLKDITADKYGFTFQYIKVKDEPAFINVLEILALEYAKNKGYELYNFQ

SEQ ID NO: 4951 - protein, 2137 aa, Staphylococcus epidermidis
ENYGEFIMTKKEKDYKKSLEQQKTRVKIYKSGKSWVKASINEIELLKTMGLPFLSKNEIQENVTEKTKGHKLKKSAAKTTALVGGAFTFNMLNNHQAFAASETPITSEISSNSETVANQNSTTIKNSQKETVNSTSLESNHSNSTNKQMSSEVTNTDQSSEKAGISQQSSETSNQSSELNTYASTDHVESTTTNNDNTAQQDQNKSSNVTSKSTQSNTSSSEKNISSNLTQSIETKATDSLATSEARTSTNQISNLTSTSTSNQSSPTSFANLRTFSRFTVLNTMAAPTTTSTTTTSSLTSNSVVVNKDNFNEHMNLSGSATYDPKTGIATLTPDAYSQKGAISLNTRLDSNRSFRFTGKVNLGNRYEGYSPDGVTGGDGIGFAFSPGPLGQIGKEGAAVGIGGLNNAFGFKLDTYHNTSTPKSDAKAKADPRNVGGGGAFGAFVSTDRNGMATTEASSAAKLNVQPTDNSFQDFVIDYNGDTKVMTVTYAGQTFTRNLTDWIKNSGGTTFSLSMTASTGGAKNLQQVQFGTFEYTESAVAKVRYVDANTGKDIIPPKTIAGEVDATVNIDKQLNNLKNSGYSYVSTDALQNSNYSETSGTPTLKLTNSSQTVIYKFKDVQGPQISVDSQTREVGKTINPITITTTDNSKDVLTTTVTGLPSGLSFDQTTNTITGTPSEVGTTTVTVNTTDATGNVTSKQFTITIQDTISPVVNVTPSQASEVFTPINPITITATDNSGKVVTHTVTGLPQGLKFDASTNSIVGTPTQIGTNTITIESTDASGNKTTTKINYEVTRNSASDSTSTSIVNSVSTSISNSTSLSDSVKASQSLSTSKSLSESLSASTSNSTSIQASESASTSKQLSESASTSTSDSASESARKSESTSKSTSLSESTSTSVSDSASVSTSESASTSTSVSGSTSTSISDSTSTSTSDSASIKASESASTSKLLSESVSTSTSDSASTSTSVSDSNSASTSLSKSTSTSVSDSTSTSTSDSASTSTSESESDSASTSLSESTSTSVSDSTSTSTSDSASMSASESESNSKSTSLSESTSTSLSGSTSASTSDSASTSTSESESDSTSTSLSESTSTSLSGSTSASTSDSASTSTSESDSTSESTSLSESLSTSVSDSTSASTSESASTSTSESESNSASTSLSGSLSTSISDSTSTSTSDSASTSTSESESDSTSTSLSESTSTSLSDSTSTSTSESASTSTSESDSTSESTSLSESTSTSVSDSTSASTSDSASTSTSVSDSESASTSISESLSTSVSDSTSTSTSDSASTSTSESDSTSESTSLSESISTSVSDSTSASTSDSASTSTSESESDSASTSLSGSTSTSLSDSTSTSTSDSASTSTSESDSERASTSLSGSTSTSLSDSTSTSTSDSASTSTSVSDSNSASTSLSGSLSTSVSDSTSTSTSDSASASTSESDSERASTSLSGSTSTSISDSTSTSTSDSASTSTSVSESNSTSTSISESLSTSVSDSTSTSTSDSASTSTSVSDSDSASTSSSESVSTSDSESTSTSTSDSASTSTSVSESNSTSTSLSGSTSTSVSDSTSTSTSDSASASTSESDSDSASTSSSESVSTSVSDSTSASTSESASTSTSVSDSNSASTSLSESTSTSLSDSTSMSTSDSASTSTSESDSDSASTSLSDSTSTSVSESTSTSTSTSVSASNSTSTSLSDSRSTSLSDSTSTSTSESGSTSTSESDSDSASTSLSESTSTSISDSTSTSTSDSASTSMSVSDSNRASTSLSDSTSTSVSDSTSASTSESASTSTRESESTSASTSLSESTSTSVSDSTSTSTSDSASTSTSESDSNSESTSLSESTSTSVSDSTSASTSASASTSTSVSDSNSASTSLSGSTSTSVSDSTSTSTSASASTSTSESDSDSASTSLSGSTSTSISDSTSTSTSDSASTSTSESASTSTSVSESDSESTSVSESSSTSVSDSTSTSTSESASTSTSESESTSESTSVSESSSTSISDSSSTSTSMSTSETFTSQSPINSESQFIGDSLSEDTIVTQSKNTNMLNKTGKDYDLQEQRGYTDSEQHNETQSNQADNHSNNLDLLHQNRLQDKVVKQPTKGEDGVVSNGFIVAVAIVLAIFGLAKKSRKDDDDQDGSK

SEQ ID NO: 4952 - protein, 378 aa, Staphylococcus epidermidis
ERSGLLMHDVLIIGSGVIGMSIARHLSATHLDVAVIDRDVPGKHASYKAGGMLGAQNEFTEDSDLFQLAIESRAMFPQLSKSLLDETGIDIQFKNSGLIKIANEHDDISSIKRQYQFLNSQDRSVKQLSDDDLLQLTHGEVKPSYAAIHIPHDGQINAHHYTLALLESMKLRDIKRYESTEVTSIERHNGYYSVKTDQSSTIEAHKIIVAGGAWSSQLLTQYHLQRQVIGVKGEVILLENNDLSLTETLFMTNGCYIVPKQPNRFLIGATSEFNNYSVGTTDEGMDWLLRHAYHRVPQLKDSHILKKWSGVRPYTEKEMPVMDQIDDGLYVISGHYRNGILLSPIIGRDIANWLLSGIKPSRYSSFTVTRRNNHEVYH

SEQ ID NO: 4953 - protein, 276 aa, Staphylococcus epidermidis
GRGGLSMNNTIISMKEKELRFLKFFHQQKYNVVDFNLIEELDWQRLTHEDLQQMDERSFWQQNKSIYALRNDFTDQLFRYYSNYPTHFKKVAYAGDIIRDNRVIKQVGIENYEPQFDNITQNFLDFQYFIQNVLHDDIQFIILGHYQLIDALLEKNHQTREVMEMIEERNLSGLIQTLTFNHPIIQILKENTLNQLKILSHYLPERHPAMVAIQSWSQWFTDHGITEIHLDVTAQAPRSYYKGIFIKCHLKNTAHSVLTGGYYHGSLEGFGLGLTL

SEQ ID NO: 4954 - protein, 53 aa, Staphylococcus epidermidis
KYILDYVYIDYYCCSTAQMTNLPKVKIILLLFYVSQHNIYRMTQNICEALLFE

SEQ ID NO: 4955 - protein, 51 aa, Staphylococcus epidermidis
NNSGNSLINLIKELPLLLCYLSMKNKGIQFISLDEYDNDYFLYLLSNAGGT

SEQ ID NO: 4956 - protein, 527 aa, Staphylococcus epidermidis
ILVGRRFWNMKRFIPAWYSRNRWWESTSRPFYLKKQYTDFDDMISLMTMHSSNNVDYQLIVLNFSPYLRTFLHRYDLYESHYWSVFDEIQGVGHQTPQAIDYRDLSWPEGTEFIFTPFQIQAITGDNTFSKIHFSQEGYLMWVEDYKYSTIQRRFVFDDRGFISAVRTYTPDGDNNKKHYFSKDGEEIFVEDLNVNTVTINKNFQSKFKRVTYSSMAELIEEKFQSYVERELNEDDSVIVASDERHNSMMARTIDASSLCFSIFTERNKVVTQDLYDSISRAYYCLVDTQANQNMIEHYAGLNMNDINLLRVTPFDAKSLPNQSSQLYDTYIGLWIDGLDEIEIREIVNSLFQYIQHKDGYKLKILTKSRDNLTENLIDEVAHLNDLYHQEKKEISDVIEDVIQNKKETIIDIETVPFEEDLVSVISKLRVVVDLSLEPKLFLQICCIGAGIPQINKKRTDYVKHMHNGYIIDDISQTVESLDYFLAHLKNWNYSYAYSMRLTDDFSSINIIHQINQLFKGDVSSGT

SEQ ID NO: 4957 - protein, 418 aa, Staphylococcus epidermidis
RKVGEKMHVFNFLLFYPIFMSIYWIVGSIYYFFIKEKPFNRSLLVKSEHQQVEGISFLLACYNESETVQDTLSSVLSLEYPEKEIIIINDGSSDNTAEIIYDFKKNHDFKFVDLEVNRGKANALNEGIKQASYEYVMCLDADTVIDDDAPFYMIEDFKKNPKLGAVTGNPRIRNKSSILGKIQTIEYASIIGCIKRSQSLAGAINTISGVFTLFKKSALKDVGYWDTDMITEDIAVSWKLHLFDYEIKYEPRALCWMLVPETIGGLWKQRVRWAQGGHEVLLRDFWPTIKTKKLSLYILMFEQIASITWVYIVLCYLSFLVITANILDYTYLKYSFSIFFFSSFTMTFINIIQFTVALFIDSRYEKKNIVGLIFLSWYPTLYWVINAAVVIMAFPKALKRKKGGYATWSSPDRGNIQR

SEQ ID NO: 4958 - protein, 295 aa, Staphylococcus epidermidis
IGKGVYRLKKIKKAIIPAAGLGTRFLPATKAMPKEMLPILDKPTIQYIVEEASKAGIEDIIIVTGKHKRAIEDHFDNQKELEMVLENKGKADLLEKVQYSTDLANIFYVRQKEQKGLGHAIHTAKQFIGNEPFAVLLGDDIVESDTPAIKQLMDVYEETGHSVIGVQEVPESDTHRYGVIDPSAKGGSRYEVRQFVEKPKQGTAPSNLAIMGRYVLTPEIFDYLETQQEGAGNEIQLTDAIERMNSKQKVYAYDFEGNRYDVGEKLGFVKTTIEYALKDPEMSHDLKAFIKQLDI

SEQ ID NO: 4959 - protein, 232 aa, Staphylococcus epidermidis
VMKGNLLHSIIEYYSLNWAFLLELFFKHLLMSVYGVLFACIIGIPIGIFIAKYKRLSWPVITIANIIQTVPAIAMLAILMLAMGLGPTTVVVTVFLYSLLPIIKNTYTGIVEVDENIKDAGKGMGMTGNQILRMIELPLSLSVIIGGVRIALVVAIGIVAIGSFIGAPTLGDIIIRGTNSTDGTTFILAGAIPIALIAIIIDIGLRYLEKRLDPTRKNKKDSMQKHQVQKLH

SEQ ID NO: 4960 - protein, 43 aa, Staphylococcus epidermidis
YCEGYQIIDDIVRQNEQSNQVDNMEPDTSIIGTGSFLILIVIE

SEQ ID NO: 4961 - protein, 226 aa, Staphylococcus epidermidis
REEGMIMNQMNQTIIDAFHFRHATKEFDPTKKISDEDFNTILETGRLSPSSLGLEPWHFVVVQNKELREKLKAYSWGAQKQLDTASHFVLIFARKNVTAHTDYVQHLLRGVKKYEESTIPAVENKFDDFQESFHIADNERTLYDWASKQTYIALANMMTSAALLGIDSCPIEGFDLDKVTEILSDEGVLDTEQFGISVMVGFGYRAQEPKHGKVRQNEDDIISWIE

SEQ ID NO: 4962 - protein, 259 aa, Staphylococcus epidermidis
YSRGVTYMALITMNYNSPTIGMHQNLTIILPEDVTFFGSSTTAKHLKSMLLLHGLSSDETTYIRYTSIERYANEHQLAIIMPNVDHSGYANMVYGHSYYDYILEIYEYVHQILPLSRKREDNFIAGHSMGGYGTIKFALTQSDKFAKAAPLSAVFEAQRFIDLDWTDFSPQSITGNNTQIKGTELDTYYLLDQAIDANVDIPELFIMCGKEDFLYHDNLQFIETLNKKGVSYKFEDGPGDHDYAYWDRAIKRAIKWFVQ

SEQ ID NO: 4963 - protein, 332 aa, Staphylococcus epidermidis
IKRGIQSMANQKLPTLKYTGKSESAVPIVSESELQTVTAEPWVKISDKGLQLEGLNFNREGQLFLLDVFEGNIFKVNPATKEVTTKFQSVKDNPAAIKVHKDGRLFICYLGDFKTTGGIFATTEKGEQIEEIISDLNTEYCIDDMVFDSKGGFYFTDFRGYSTQPLGGVYYVDPDFKTVTPIIQNISVANGIALSTDEKVLWVTETTTNRLHRIALEDDGVTIAPFGATIPYYFTGHEGPDSCCIDSNDNLYVAMYGQGRVLVFNKRGYPIGQILMPGRDDGKMLRTTHPQFIPGTNQLIICTNDIENHSEGGSMLYTVNGFAKGYESYQFQ

SEQ ID NO: 4964 - protein, 513 aa, Staphylococcus epidermidis
FIGGNKMKNFSKFALTSIAALTVASPLVNTEVDAKDKVSATQNIDAKVTQESQATDALKELPKSENIKKHYKDYKVTDTEKDNKGFTHYTLQPKVGNTYAPDKEVKVHTNKEGKVVLVNGDTDAKKVQPTNKVSISKESATDKAFEAIKIDRQKAKNLKSDVIKTNKVEIDGEKNKYVYNIEIITTSPKISHWNVKIDAETGQVVDKLNMIKEAATTGTGKGVLGDTKQININSVSGGYALQDLTQQGTLSAYNYDANTGQAYLMQDKDRNFDDDEQRAGVDANYYAKETYDYYKNTFGRESYDNQGSPIISLAHVNNFQGQDNRNNAAWIGDKMIYGDGDGRTFTALSGANDVVAHEITHGVTQQTANLVYRSQSGALNESFSDVFGYFVDDEDFLMGEDVYTPGVGGDALRSMSNPERFGQPSHMNDFVYTNSDNGGVHTNSGIPNKAAYNTIRSIGKQRSEQIYYRALTVYLTSNSDFQDAKASLQQAALDLYGDGIAQQVGQAWDSVGV

SEQ ID NO: 4965 - protein, 258 aa, Staphylococcus epidermidis
ILGGIILIKKRVIPCLDVKDGRVVKGIQFQSLRDIGNPVDLALYYNEAGADELVFLDISKTEAGHDLMIEVIEATAKQLFIPLTVGGGIQNLDDITQLLNHGADKISLNSSALKHPELIRQASEKFGRQCICIAIDSFYDKDREDYFCTTHGGKKLTDVSVYDWVQEVEHLGAGELLITSMHHDGMKQGFDIEHLAKIKQLVNIPIIASGGGGNAQHFVELFQQTDVSAGLAASILHDQETTVAEIKDKMREGGILVR

SEQ ID NO: 4966 - protein, 256 aa, Staphylococcus epidermidis
LSMGWNESHFLIIYIEGGLMVSSEYKKGIFLALGAYILWGILPIYWRLIDEIGAFEILAFRIIFSVIFMIFVLIIGKNQRNAFLRDVNQLVSHPVQLIAIIVAGYVITVNWGTFIWAVSNGHVLQSSLGYYINPLVSIVLALIFLKERFNKFEWLAIIFALIGVLYMTIKIGEFPFISLLLAFSFGIYGLLKKIVHIDAISSITIRMYCYCTSRFNLCYLPMAATTHNIWIKYIIILATIFRCNYSNTIDSVLSRC

SEQ ID NO: 4967 - protein, 266 aa, Staphylococcus epidermidis
TRGGVVHMGKVYLVGAGPGDPELITLKGLKAIKEADVILYDRLVNKEILNYASPSTKFFYCGKDPHRHSLPQEETNKMMVTLAKKGHIVTRLKGGDPFVFGRGGEEAEELACHNIHFEIIPGITSGIAAPAYAGIPVTHRDYSSSVAFVTAVNKPGMDKGKYWQHLANGPETLCIYMGVKRLSEICELLIQYGRSSETPVALVHMGTSKQQMTVTGTLDTIQERAHHIQNPAMIIVGEVVKMREKINWFVEQATVQNETLTEMSST

SEQ ID NO: 4968 - protein, 48 aa, Staphylococcus epidermidis
LQIFILSHLHLPPLFFANISMNYQFHNDNVFLFLHFLYSSSNYFIRYA

SEQ ID NO: 4969 - protein, 354 aa, Staphylococcus epidermidis
GVFIMKAAVWYGQKDVRVEDREPKAIKDNEVQVKVSWAGICGTDLHEYLEGPIFISTDQPDPLLGQTAPVTLGHEFSGVVENVGKNVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELDNIVESGFNQLVNDKSQAKILVRLNGDQK

SEQ ID NO: 4970 - protein, 131 aa, Staphylococcus epidermidis
LFFIKEGCLLMSQIEFKDVSKVYPNGHVGLKDINLNIEKGDFAVIVGLSGAGKSTLLRSVNRLHDISKGDITIEGQSITKARGKKLLEMRRSIGMIFQHFNLVKRSTVLRNVLSGQGRIPSYLENDTGSFS

SEQ ID NO: 4971 - protein, 77 aa, Staphylococcus epidermidis
LYFIILLLKIIRIFMSFVTKYVNIHSNLKLIYLFNYHFIYISFLLLVGFISLLLCGHTYARQTVALPQGAIRSFVFF

SEQ ID NO: 4972 - protein, 296 aa, Staphylococcus epidermidis
RCLMDFIAILIGLGPLLGWGLFPTIASKFGGRPVNQIFGATVGTLIFAIVLALFKGIGLPGGMALVFSLISGAGWAFGQIITFKAFELVGSSRAMPITTAFQLLGASLWGVFALGNWPGITNKIIGFLALLVILIGARMTVWTETKQQEYSKNLRSAVILLLVGEIGYWIYSAAPQATDIGGFKAFLPQAIGMVIVAVIYALMNMSKGNAFKEKVSWQQIISGFFFAFAALTYLISAQPNMNGLATGFVLSQTSVVLATLTGIFFLNQKKTSKELMITIVGLVLILVAASITVFIK

SEQ ID NO: 4973 - protein, 46 aa, Staphylococcus epidermidis
NLLIYKESILVLVAERTTNAVSLFLIILLDLDYIPQADKPCALYAL

SEQ ID NO: 4974 - protein, 40 aa, Staphylococcus epidermidis
RILIYMELIISYLSEITFYLNVVSLFFTQTIITIKICIFH

SEQ ID NO: 4975 - protein, 41 aa, Staphylococcus epidermidis
IWLIHFYTLITLNTHNQIDILGKLVIIKYDLFSKKIYLFYK

SEQ ID NO: 4976 - protein, 107 aa, Staphylococcus epidermidis
VVIIETEYYCHLLSVVTLPIGYFLVLNHHVIQVLQLQGGIIMKCIINGDLFTFDQNQSIQEVLHSLELDPKRVIVELNKELIKQDKYEEYTVREDDRLELLEIVGGG

SEQ ID NO: 4977 - protein, 49 aa, Staphylococcus epidermidis
QPIIKIINKTIFTNISENELNRLTFLMDSRLKVSNNIPINVIIPKTLPI

SEQ ID NO: 4978 - protein, 64 aa, Staphylococcus epidermidis
FIVIKAIYVTPLLYYLLFYLFFSLIYRKNATLTIDYINFYTFQCGTKILFSILNKLIQYRLSNL

SEQ ID NO: 4979 - protein, 66 aa, Staphylococcus epidermidis
GNPIDNNIDPMIAPRKLATLKIEAANVLARSGASFALKIILLLSNGVVPNVPKPNKKQMINANIEF

SEQ ID NO: 4980 - protein, 159 aa, Staphylococcus epidermidis
GTYMTIEKKKNKIIFTRTFSAPINKVFDAYTKRELFEQWFHPQDASVTVYDFNATKGGNAFYAIQAPQMTSYTIAEYLQVDAPYYIEYLDYFATSKGEKDTSMPGMHITLNFEEVKGKTTVTSTSTFPTESAAQQAIDMGVETGMNSTLNQLEKLLNQK

SEQ ID NO: 4981 - protein, 209 aa, Staphylococcus epidermidis
IHHISSIRNGVINVKKISLIATTVLTGLLLFPSVNDTTTHAAEVTSHDAQAVAIQAMKNSGGNPDLQNFKKVKDKGDYFTIDINNKSGAGVGTYKVYKNGVVLYKSGNYGEYSQLNTRQCYVAQDIATTSSQVKRHSTQQTQAVDSTRELNSYYVGQVQSSDLPQQSSSDMLPNTGMKDKNFNTNGIISLFLLTAGFITLYHQPLRKMS

SEQ ID NO: 4982 - protein, 63 aa, Staphylococcus epidermidis
LNHIFFFHIREASIITTVPVSIAIKSVTVKFRINKNGYPPFVKVNNRFLIYLSKIRTIQHVFL

SEQ ID NO: 4983 - protein, 46 aa, Staphylococcus epidermidis
YIHIAHRQFYILIIIQFTYDFHFNYQDFFSLISFLDRININQLFRK

SEQ ID NO: 4984 - protein, 206 aa, Staphylococcus epidermidis
  MOD_RES (170)..(170): Variable amino acid
RIHIMKIILPVKPISQLFPIPFVMGCEGVSAAMLLQFNNYDIKATQIMSHWPKHPTNPYKGYVGHPLLVKFGHHQTIFPDAFAPFLKQYDSRIVDGTGTSLNQLEKFIDKGQPVIIYHTSLGSKPLRRVFHFDNQPTKLVSNIHVTLLIGYDDDYYYYIDPLWSRLSKFXIFPSIIPNSKQFIKIKKHTLENSYNAPGKKCIYIDN

SEQ ID NO: 4985 - protein, 44 aa, Staphylococcus epidermidis
TLNIIFISFVKFNFLTHCSSQSSTILFTLLLAHISSKYNFSCYS

SEQ ID NO: 4986 - protein, 673 aa, Staphylococcus epidermidis
VTNMTFKILWKMIKQNFVNQRHIIVPFISVISILFGIEYILLSLTTNIYFNEHHPELKISAIIGIVFMTMLLFIFLIYANHFVMNHRKKEFALNMVLGMEKKHLRLIILIELFIQFIISAILSIVGGYLFGELFFMLFNKLVNTHQPQLSDYPFDVLSMKITLTMLLSLMIILFVINNFKISFKNSLQLLLKNKSKTHEKSRVRLIIFLILGLIFIGIGYYLAIKPNTAIGSLGIIFFAILSTLIGTYLLFVSLGSIVLEMLQKLDYYYYKPNHFFFIAGLKSRVKSSAIGLATISFMCTFLIVTLSMTVSTYRNMDHRFEFAFKNDYAGYYIGDFHKDSKLQRKIENLKKDIRQEVPTGQFKIYARGMVGAELQGGLKHKKLKRQTVSSGLFNFGNKQKFNSFISIYNKSDYNKNNKKIKLDDDEIAISTSVSLFKKMKTLNIFGKTYRVKYIESTNIDNLLYADGITLIVNQQQLMDRIVNEYRNHNDENLIITPNQVQTAVEFNVLKEKDKLNHRIKKIGVQHDIEFQVKKQNLLMWKQVNSSLVFVGSVVSLVLLIGIFLMMYYKQVSEGHEDRDAYITMKQLGLDEILIKKTINKQVIWVFLIPVIVAIIHTLAAFRIIYSVLGIVGQYDLGLYATSYVGVIVVFIIFYSIMYWITSRIYYTMINGKH

SEQ ID NO: 4987 - protein, 541 aa, Staphylococcus epidermidis
RMILVQLILFIKLISYLKVMFQVARKFRVLQVGGHDLGSLFNQKSNVEWDYFDVGLFDFESGYQDVVVHILDEKGQFDFVFVREKYSDSLMKLLSLVSTPYNTVIDNEYWDNQYQQDKTIQRNFIKPLIYENEEQLQQKLEAVTFPGQYGDKVKPIHCRVSIHFDGSYQFNGNESIEVSGRFGESYQPLITWSQNIIADANKVNQIWPEFKVEGDAKIQYTLRLTPVYSTDQPVEKLIYEQDDLDTPIELPARPYQTYVSVSIKAKGKGTLFIGAIHKRWSRLELGQFILGGKRYSDENKQEFIHYFHPGDLKPPLNVYFSGYRTAEGFEGYFMMKRMNAPFILIADPRIEGGAFYLGSENYEQAIRKVIQNALDYLGFANNQLILSGLSMGSFGALYYATKLNPAAVIVGKPLINLGTIANNMKLVRPNDFGTSLDILRLNQNGITNKDVVQLDNHFWKQIQHSDLSMTTFAIAYMEHDDYDKYAFQDLLPVLTKQHARVISKRIPGRHNDDSATVTHWFINFYHLIMEERFGRVTHARR

SEQ ID NO: 4988 - protein, 236 aa, Staphylococcus epidermidis
GDNMKRTDKYRDSYKYDDQYQNHRKRSEEDMYRQHQESQQRANSNRATQSENDREYENHPERYYNGRDYRREQQLEEENEKSSKTKKWLIAIIVILLIIVAIFITRAIINHNNDKVSNDPNVSQNYKKEVENQNDDINRQVDSAKSDIKNKKDTQSQIDKLQNQIDQLKQNEETNADSKFTKFYQNQIDKLKNANNAQLNNENQSKVNNMLEDINTKFDSIKAKLENILNGSNSGN

SEQ ID NO: 4989 - protein, 347 aa, Staphylococcus epidermidis
VVNMLEQTDLSLEQLLKNYYETTNEKIVFVNRQGKIIAMNDAAKDILTEEDNYNAMTNAICHRCEGYSNEYDVQSCKDCFLETTQLQHSNFQVFMKTKDNEIKPFTAMYQNIDEQRGISAFTLQNVAPQIERQEKMYQQKMLHRSIQAQENERKRISRELHDSVIQDMLNIDVELRLLKYKHRDKVLAETSQRIEGLLSQLIDDIRNMSVELRPSSLDDLGIEAAFKSYFKQFEENYGMHIKYDSNIKGMRFDNEIETVVYRVVQEGVFNALKYAEVNEIEVSTHSDGKQLVAEVVDRGKGFSLDHHPKGSGLGLYGMRERAELVNGHVNIETHINRGTIITLDIPI

SEQ ID NO: 4990 - protein, 177 aa, Staphylococcus epidermidis
ETNMKEKRSNVRWYFAIGFFFIGVIAYMDRSNISYIAVPMMKDLGLTKTQFGLLASFFSLGYALMQVPSGMLAEKFGPRKMITVALVWWSAFTILTGMIKHHGLLYFIRFLFGVGEAPMYPSNAVFNSFWFAKNEKGRASSALLAGSYFGPVLAPIITIAIVNAFNWQAVFYIFGVV

SEQ ID NO: 4991 - protein, 196 aa, Staphylococcus epidermidis
KYDINEMGDKMYKYLKRNRFSTQTSIIKNDAQQPVGMISKVYKNFIQKCIGYLTLGLKLNQYEICDVNNNSVAYIKVSRYMEKKHFKVEYHDSKGRQCEALFDKQSNGYEETYGILKIDGIILNIHANEKHHTTIKDIKRDTQIASWKQIGDYAYAEGNDGLFKEHQLLYILIMHAFANTYVSKRQTSLMFPGPPV

SEQ ID NO: 4992 - protein, 47 aa, Staphylococcus epidermidis
IFDIKCRLSLYIHLSQPPISLQTHYSELKFNIETLCHITVVSYIIYR

SEQ ID NO: 4993 - protein, 46 aa, Staphylococcus epidermidis
DIDICLRCFVYWKLMAEFKMCRSKSLYYKFFKKVYDGRYFNQLLFF

SEQ ID NO: 4994 - protein, 382 aa, Staphylococcus epidermidis
VKCIFSQKLYISIQQTWYNYCEKFHIINGGIDMKAYEYLKPGHAQLTDKEKPTITSSTDAIIRIVKTTICGTDLHIIKGDTPEVKSHTTLGHEGIGIIEEIGDNVNNFKVGDKVIISCISSCGKCYYCKKGIYAHCENGGGWILGHLVNGTQAEYVKVPFADNSLYHAPSNLKDDALVMLSDILPTGYEIGVLKGKVKPGCTVAIVGAGPVGLAALLTAQFYSPSKIIMIDLDDNRLETAKELGATHLINSKETETAIKKVKSLNPRGVDVAIEAVGIPQTFDLCQNLIGVDGTIANVGVHGLPVQLDIDKLWIKNINVTTGLVSGNTTEELLEALKSKIIQPEQLVTHYSKLSEIESAYDLFRNATDHKAIKLIIENDITI

SEQ ID NO: 4995 - protein, 53 aa, Staphylococcus epidermidis
LKRMIWVYINYGVKINVGYARVLSMDQNLKRQLDNLKTFGVKNIYRKTVWGIY

SEQ ID NO: 4996 - protein, 66 aa, Staphylococcus epidermidis
RRRIMFSTGNKAKKTIFGAMTCSKCGKTLNNDENITIKINTKELKGYTHLSSWADAQYKLCENCSE

SEQ ID NO: 4997 - protein, 41 aa, Staphylococcus epidermidis
YKSIAYCACLTVFLQFLTIYYKKFIILIKIKYPSLIRYANL

SEQ ID NO: 4998 - protein, 89 aa, Staphylococcus epidermidis
IIFIFKLFLSLNLKTNKYVYKIYNLIHTKKHLKCFHYSFKVLIKLNIYFNGYLHHDRHLQYFYLYHKQHLGHCQSLDHYAFLQHHNQDF

SEQ ID NO: 4999 - protein, 111 aa, Staphylococcus epidermidis
VYIMYENIQNIEDFYRFINAHALAVVHIMRDNCTVCHAVLPQIQDLLKDYPKAQLGVINQSNVEAIAGELSIFTVPVDLIFLKGKEMHRQARFIDMQSFEKQLYMMQNAID

SEQ ID NO: 5000 - protein, 521 aa, Staphylococcus epidermidis
GVIIEMKIFKTLSSILVTSVLSVTVIPSTFASTESTATNQTQQTVLFDNSHAQTAGAADWVIDGAFSDYADSMRKQGYQVKELEGESNISDQSLQQAHVLVIPEANNPFKENEQKAIINFVKNGGSVIFISDHYNADRNLNRIDSSESMNGYRRGAYENITKDMNNEEKNSNVMHNVKSSDWLSQNFGVRFRYNALGDINTQNIVSSKDSFGITKGVQSVSMHAGSTLAITDPNKAKGIIYMPEHLTHSQKWSHAVDQGIYNGGGINEGPYVAISKIGKGKAAFIGDSSLVEDRSPKYLREDNGKPKKTYDGFKEQDNGKLLNNLTTWLGKKESQPSMKDMGIKLDNKTPLLNFEQPENSIEPQKEPWTTPIEGYKWYDRSTFKKGSYGSNQRGADDGVDDKSSSHQNQNAKVELTLPQNIQPHHPFQFTIKLTGYEPNSTINDVRVGLYKDGGKQIGSFSSNRNQFNTPGYSPSQSIKTNGAGEASFTLTAKVTDEIKDANIRVKQGKKILLTQKMNENF

SEQ ID NO: 5001 - protein, 207 aa, Staphylococcus epidermidis
EEIIMNMPLMIDLSNKKVVIVGGGKVATRRAKTLLAYTKHIHVVSPTITDTLQKYLETKQITYEKKHFEPQDVENADVVIAATNQSDVNNDVGAALSKNVLFNHAGQADLGNITFPNFLKRDKLTISVSTDGASPKLGQRIIKDLKDTYNKDYSMYIQFLYESRQYIKSLKIEPSDKQALLEQILSDKYLDEKKQQDFIRWLKSQVK

SEQ ID NO: 5002 - protein, 40 aa, Staphylococcus epidermidis
DDSMYSNAKSHVCKKLVTIKKGAELNSSKNSMSRSIALID

SEQ ID NO: 5003 - protein, 144 aa, Staphylococcus epidermidis
SSPIWYKTITVQRRNIMKLTRIHYEIIKFIIVGGINTFNYYITYLFLLKVLHVNYMVSHIVGFIVSFIISYYLNCYFVYKVKPTIEKFLRFPITQIVNMVMQTLLLYIFVKWLNIASEIAPFAGLIITIPVTFILSKWLLRDKV

SEQ ID NO: 5004 - protein, 68 aa, Staphylococcus epidermidis
FLYIRHLVNLVYWYLLNYTKGPYFSKYFNIKLHICTKYFGETLEGTGQAEDYRLKLSDKKASQQYEVL

SEQ ID NO: 5005 - protein, 568 aa, Staphylococcus epidermidis
LFNIYKGVFMKNNSKSKSNKISLSQLVLLGLGSLIGSGWLFGAWEASSMAGPAAIISWVIGFLVIGTIAYNYIEIGTMFPQSGGMSNYAQYTHGSLLGFIAAWANWVSLVTIIPIEAVSAVQYMSSWPWDWAKPMGSLMKDGSISTYGLIAVYIIIAIFSLLNYWSVKLLTSFTSLISVFKLGVPILTIIMLLVSGFDTGNYGHSIGTFMPYGSAPIFAATTTSGIIFSFNAFQTIINMGSEIKNPEKNIARGIVISLTLSAILYIVLQSTFITSMPSSMLHEHGWSGINFNSPFADMAILLGLNWLAILLYMEAVVSPFGTGVSFVAVTGRVLRAMEENGHIPKFLGKINKKYNIPRVAIAFNAIISMVMVTLFRDWGTLAAVISTATLVAYLTGPTTVISLRKMAPKMTRPFKANILKFMAPLSFVLASLAIYWAMWPTTAEVILIIILGLPIYFFYEYKMNWKNTKKQIGGSLWIIIYLIVLAFLSFIGSKEFKGLNWIHYPWDFLVIVIVALIFYQLGTTSYFESIYFKRANKLNKKMGDKLRKTRKKARHKDWKERDRQEQNQ

SEQ ID NO: 5006 - protein, 513 aa, Staphylococcus epidermidis
EANMEERIGLIDIGSNTIRLVIFGYNKKTGLNEILNIKTPARLSQYLTKSNEMNDEGIHVLKETLSSFRKVADKFNVDALYPIATAAIRQSKNREAIIKEIKQDIHIEIQIVPEEDEAFYGYYAITHTTDIENGISVDIGGGSTEVTLFKDKQLKEAHSFPFGVVSLKRQFFGDKAHNDKTAIKNMEQFLREQFSQLDWLSNQHIALVGVGGSARNVARIHQSAHAYPIGGVHNYKMTSKDINNVYDLIRKSSRDELTNLDGLSRDRVDIILPAISVFKTLFKKIDATQFTFSRKGIREGFIMNHISKRYPDEFNKSNVRKDALRHLANEYHIEETSANRRVKLAQSLLNQIISERSLNISAMEKELFIEGSYIYYLGSFIDSDSSSPHTYYLIANSMINGFSHKDRVKLALLASFKNKSLLKFYCKETQWFSNKEIDTIQALGGIIKFANTLNISHTSFVEEVKLKAKKDDKYDLLVYYKGSPIAEEYQANRQKKHIEKILKGKVSIIFTKS

SEQ ID NO: 5007 - protein, 57 aa, Staphylococcus epidermidis
RLRIFKLIEDIDNEPNVEPWYALVKLMMYGRPVYARANFIIPSLASEPLNPKVTLFS

SEQ ID NO: 5008 - protein, 359 aa, Staphylococcus epidermidis
NRSIYMYKLVKPLLFKLDPERAHGLTINALKCVQKCSPILPIVNKLFTYNNPILTQHIHGISFDNPIGLAAGFDKSCEVPKALENIGFGAIELGGITPKPQPGNPKPRMYRLLEDDALINRMGFNNKGMNKALSNLRNHSCSIPVGLNVGVNKTTSYENRYQDYIKVIDTFKNDVSFFTVNISSPNTENLQNFHDEDEFSMLCDALNSFKAKNNINVPIFLKLTSDMELDGFKKILPSITDTFDGVMLANTTRQRDGLNSKNKIQKGGLSGRPLFQRNLQLVKYAYQQTRGNFLIIGTGGIFSSEDAIKMLRNGASLLQIYSSLVIEGPGLTKKMNKEIAHYLTRHGYANVSDIIGLDA

SEQ ID NO: 5009 - protein, 105 aa, Staphylococcus epidermidis
NNFFPKFFHFNELLHNKVTQITVLAYLYNISIKITRILLQFRYKKFILMTIFQHFSEAINSATNFITFIIIVRDKVLIKYIITMLTIHKRNRFPIEKCNTLFIHI

SEQ ID NO: 5010 - protein, 46 aa, Staphylococcus epidermidis
SLLMMMQTDNFALFTKEVKIGITLSKRLHFIRDKRLLQISLKKDGF

SEQ ID NO: 5011 - protein, 394 aa, Staphylococcus epidermidis
IILMRRHSMEMSERLASIPDSYFGKTMGRIVEHGPLPLINMAVGIPDGETPKGIINHFSEALCIPENQKYGPFHGKDAFKQAIVNFYQRHYDVELDKEDEVCILYGTKNGLVALPTCVVNPGEIVLLPDPGYTDYLAGVMLADAKPLPLKLSPPNYLPNWNTISAKVLEKTKLIYLTYPNNPTGSTATQDDFDEAIHRFKGTQTKIVHDFAYSAFGFDAKNPSILASKNAKDVAIEIFSLSKGYNMSGFRVGFAVGNKKMIQALKKYQTHTNAGMFGALQDAATYALNHYDKFLEKQNEIFRRRRDNFESQLKHAHLPFVHSKGGIYIWLHTPPGYDSEAFEQLLLKEKSILVAPGKPFGENGNQYVRVSLALDDKQLEEAANRLTQLRYLYER

SEQ ID NO: 5012 - protein, 48 aa, Staphylococcus epidermidis
CCLMLFLFLISLVSISFVIAVYQMLEFLKNGTQYYAVWTTDTFFDMVH

SEQ ID NO: 5013 - protein, 47 aa, Staphylococcus epidermidis
DVLILNKNLGSETMDEALFIGLTLFFNIMNEMFMNENDVFLLLYSLK

SEQ ID NO: 5014 - protein, 44 aa, Staphylococcus epidermidis
ITLMSYSLTKRYDKVVQNNSMIRSNDVWQKLKRKLQSLQVRVAV

SEQ ID NO: 5015 - protein, 44 aa, Staphylococcus epidermidis
LELIKKVPYSSYGLCMCLNKGFYLTIVSHYENKFFNILYKEPNN

SEQ ID NO: 5016 - protein, 59 aa, Staphylococcus epidermidis
VKLILENLTFLELTFLSIKYNNLPSCKNNLSYLRCFNLLENGQYLLQQVYAQKNSYSQI

SEQ ID NO: 5017 - protein, 40 aa, Staphylococcus epidermidis
MCLINDHIVSKILQNGIGSIINMYFCYIAYRLIIGISAII

SEQ ID NO: 5018 - protein, 148 aa, Staphylococcus epidermidis
ITLITIIIAYHSWVIINLLIIYIRLKQRCYIIYERYYDFRRRGMEKSVKLAVGIYLAIILIICSIYLAFILIGSLNGKDMSNSVLDTDHSRINNTSRNSNEDVTSSNNESNNTKAHSFANSEYKAININEAFKNNKQIKKANSSYQYY

SEQ ID NO: 5019 - protein, 247 aa, Staphylococcus epidermidis
FAIMGLKRNRRLRKMYVERKPALYIEDLRDEFKNSLKHFKDDDEAFNTLVGFVELDHLYSSALKEISTKLSILDDNFNYQYKHNPIHHMERRVKEMHSLVKKLNRKGFEVSAQSAKDNIMDIAGIRVVCNYLDDVYVIEKMLLRQEDVKLLKRKDYITHPKENGYRSLHIVVSIPVFLADSVEVTPVEIQIRTIGMDMWASLEHKIRYKNDTDTEKYKGLLEQCASEITNVESKMQQIHSEISNREK

SEQ ID NO: 5020 - protein, 138 aa, Staphylococcus epidermidis
MAIINLSHRGDTSFDKLLGHLPSVQEKWNALEDILKNEGQLSVDLKEEIRKILAQNSGCLYCKSKGKPNKKFTDEKSLVCIGFVDVYVSQNGRVPQSTIQVLTKTLTDIEIVELLAFISFTHCQQEFGAMMNLQPSNN

SEQ ID NO: 5021 - protein, 418 aa, Staphylococcus epidermidis
RNIMKFVNLTSEEFEQFTSENFSHYTQSSIHYNNRSKTKGDVHLVGVKDGQEDVIAACLLTEARSLKFFKYFYTHRGPVMDFNNLVLVRFFFKSLTAYLKKHNCLYVLVDPYVLENLRQPNGEIIESFDNRALIKTMEELGYKHQGYTVGYDTMSQIRWLSVLNLKDKSEDQLLKEMDYQTRRNIKKTYEMGVKVKTLPIEETNTFFELFKMAEEKHGFKFREEPYFVEMQKTYEDHAMLKLAYIDLQDYLDTLQTKHQNLNQQLKDVEKTLEENPNSKKNKTKHTQVKQQFDSNARKIRQTKEKIAEEGQVLHLAAALYIYNDHEVYYLSSGSNPKYNAYMGAYRLQWDMIQFAKEHNIDRYNFYGVTGDFSENAEDAGVQKFKEGFNAKIYEYIGDFIKPIKPLFYKVKQELESRR

SEQ ID NO: 5022 - protein, 886 aa, Staphylococcus epidermidis
YDIIKNKRWSRMTQFVYAFNEGNIAMKDLLGGKGANLSEMKRLGLPVPDGFTITTEACITYLKQNEELPTEVKTQLIDHLAAFSKRTGKAFSSDDNLLLVSVRSGAKISMPGMMDTILNLGLNDDNVKKLVDKTNDARFAYDCYRRLLQMFGEVVYGIPMTAFDTYFNDFKTKHRYQNDAEIPAEGLQTICEKYKEIYVEEAYKPFPQEPLKQLEEAIEAVFKSWDNDRARVYRDLNDIPHDIGTAVNIQEMVFGNSGENSGTGVAFTRNPVTGENHLFGEYLLNAQGEDVVAGIRTPKDIDTLKQQMPDVHQEFVDVTKQLEKHYKDMQDIEFTIENGKLYLLQTRNGKRTAKAAIKIAVDLVHEQLITREEAVSKVEVKSIDQLLHPNFNEESLKQATVVSKMGLPASPGAATGKVVFSAEEAKLQAENGNKVVLMRPETSPEDIEGMVASEAIVTTHGGMTSHAAVVARGMGKCCVTGCSNVEIDTVNKTVYYPEGELHEGDIVSVDGSAGDLYLGAIETVNAEHSEEFDQFMTWSEEIARLQVRMNAETPQDIKAGYNFGSKGIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGITCLPEIMIPLVSTVEEFTTLKERLVNTITHLEKESQQDIQYMIGTMIETPRACLIANDLAKHCDFFSFGTNDLTQLTFGFSRDDAGKFINVYTENNILQLDPFQTLDREGVGRLIQLAVEQAKNTNPEIKIGVCGELGGDAKSIRKFNQWEIDYVSCSPFRVPGAILATAQSQAEESER

SEQ ID NO: 5023 - protein, 214 aa, Staphylococcus epidermidis
GLIMKAFLQEYGSQLLSKAVEHFYISMFALLLAIVVAVPLGILLSKTQRTANVVLTVAGVLQTIPTLAVLAIMIPIFGVGKTPAIVALFIYVLLPILNNTVLGVKNIDKNVIQAGQSMGMTKFQLMKDVEMPLALPLIISGIRLSSVYVISWATLASYVGAGGLGDLVFNGLNLYQPPMIISAAIVVTLLALVIDFILSLVEKWVVPKGLKVSR

SEQ ID NO: 5024 - protein, 45 aa, Staphylococcus epidermidis
HEIMSQTFFTYKEGISKFYNCLNNVKGPIKRDYRKIEQIKPVARR

SEQ ID NO: 5025 - protein, 962 aa, Staphylococcus epidermidis
KRIMIIRSVKMKNALKLFITDLKRVAKTPGVWVILAGLAILPSFYAWFNLWAMWDPYGHTGHIKVAVVNEDQGEKVRGKNINVGNKMVKTLKKNDSFDWQFVSREKADHEIKMGKYYAGIYIPKKFTHEITGTLRKHPQKADIDFKVNQKINAVAAKLTDTGSSFVIDKANKQFNKTVATALLSEANKVGLSIEDNVPTINKIKSAVYQANNSLPKINQFADKIIELNKHQDDLDAYANQFRSLGKYKGNVLDAQEKLNAVNSSIPALNERAKLILALDSYMPNIERILNVAANDVPAQFPRINRGVDIASEGIDAASGQLNDAKGYLTQAKARVGDYQEAAGRAQDVNNQANQNLRNQTSTTPQSAIKSSHSEGKSHSSIKTVPVSQSGENQPVYGDNILSNSDVKSMNTALTEALLSLSNQTDQQAQATQQDIKSLKNIAYGVIASDKPSEFKEPLKNIKSRLENASKYNQQFIDILSELEKSEHVDLSNEIKQVKEANNSINDNLKSTNQLIDALSNGSSGQLEAVNVLRDLPNLNKRLDTLRNYIKKELNRNLLAVSNEITDQLNKGQNTLSTIQSKLNTINRVINAGQDILNSGKKRIDTIQTALPAIENAYINAMRTAQAYFPTAKKDVAKAADFVRNDLPGLERELANVTQSVNQKIPSLFSRYDNAVDLLNEKQPQAKEALASLADFSENKLPDVEKDLKKANKIFKKLDKDDAVDKLIDTLKNDLKKQADIVANPINKKTTDVFPVKDYGSGMTPFYTALSIWVGGLLMVSLLSVDNKHEHLQPIMTKRQVYLGKSGFFFLLGIIQALIVSIGDLVILKASIESPILFVSIAVFSSLVFNSIIYTSVSLLGNPGKAVAIILLVLQIAGGGGTFPIQTTPEFFQAISPYLPFTYSIDALRETVGGIVPEILITKVIILGLFGIGFMVVGYCLKPVTDPIIRKIAEKADESKVTE

SEQ ID NO: 5026 - protein, 77 aa, Staphylococcus epidermidis
KLIIKNVERFHYKRKNFPKNTCQITCNMLVYYYIFTLMYYRTKEFGVREGWLKYEQYHHFNERKGITFFKVFSSTKI

SEQ ID NO: 5027 - protein, 45 aa, Staphylococcus epidermidis
KNVILCLFIYEINEYELIAVFFVNKDINSMPLLKDYLLGHTHLYV

SEQ ID NO: 5028 - protein, 252 aa, Staphylococcus epidermidis
LFVIMIIQKGGIIMIGNILVAHGMRKGNQNEALEEFIGTLLKDEQYYYELAFLESETQNLEIIMEKMIKQGITKFRIVPLLIFSAMHYISDIPQILKEMKARYPQIDSKMSAPLGTHPYMKTLVENRIADEKVSEGSTKATIVIAHGNGSGRFTKAHDELKAFVKTLDSHHPVYARALYGTLAFKNDLDKISEQYDELVIVPLFLFDGRLVNKVKRLLGEMTLHSQLHITPSINFDPILRLIIRERLEALDI

SEQ ID NO: 5029 - protein, 522 aa, Staphylococcus epidermidis
RRSIGLKIKAQVAMVLNLDKCIGCHTCSVTCKNTWTNRPGAEYMWFNNVETKPGVGYPKRWEDQGQYKGGWVLNKKGKLELKSGNRWSKIALGKIFYNPDMPLIQDYYEPWTYNYEHLTNAKQGQHSPVATAHSLISGDRLNLKWGPNWEDDLAGGHITGPEDPNIQKIEEDIKFQFDETFMMYLPRLCEHCLNPSCVASCPSGAMYKRDEDGIVLVDQEACRGWRYCMTGCPYKKVYFNWKTNKAEKCTFCFPRIEAGMPTVCSETCTGRMRYLGVLLYDADRVQEAASAKDEKDLYEKQLDLFLDPFDEEVIAQAEKDGINQEWITAAQNSPVYKLAIEYKMAFPLHPEFRTMPMVWYCPPLSPIMSYFEGENAGQNPDMIFPAIEEMRLPIQYLANLLTAGDTKPVKEGLQKMAMMRSYMRSQITNQPFDTSKLERLGLTERQMTEMYRLLGIAKYEDRFVVPSSHKETYLDTYKAQGSQGYGGEYFGSNCEGCGVAVQSGKTGQEIYNENFYGGIFRD

SEQ ID NO: 5030 - protein, 69 aa, Staphylococcus epidermidis
TIPIILPLFFADVSIAVSAKTFTIMSEAAAEDKIRPTTIIPKCGAMAIIPFPKIKTINVHNNTDREENR

SEQ ID NO: 5031 - protein, 66 aa, Staphylococcus epidermidis
TSAMACVFLAGGATVAATLIHTPKNGACIAADMSLDNNNTLKFGANIPTKLLIIKIATKIGNRRWA

SEQ ID NO: 5032 - protein, 76 aa, Staphylococcus epidermidis
TRQIVRFISFVETSIIVLVHSITLRLIFKILALNIITITSSIALTCHLFTLILYFNKLNRYTFIRASSYKLCRQAI

SEQ ID NO: 5033 - protein, 46 aa, Staphylococcus epidermidis
RIKILKTYRSLLMAMSLFIIVNYKEMKKIIIFINSKYNFVEEKFKN

SEQ ID NO: 5034 - protein, 44 aa, Staphylococcus epidermidis
YPKMVLITNPVMTDTVITKNPGIIKLVGLVLPVSSSSTANNSVG

SEQ ID NO: 5035 - protein, 61 aa, Staphylococcus epidermidis
NHKIFFEMIGRQVAIKMMKKRCATNHHANSFQLKEKNGRCARKTRSGYIKVNINTKGKYAR

SEQ ID NO: 5036 - protein, 82 aa, Staphylococcus epidermidis
TCKIIYNRYHNYWGLETLREGETMIFVMLSPILIILFIVLSVLEEKRRKKNSKEQNSNHVDQQQYDYTDKEQQQNKNSNDDK

SEQ ID NO: 5037 - protein, 46 aa, Staphylococcus epidermidis
KLKILEVEWNRRNKKALTNVKFLIPHANEIGMAQRTIGERRHLLYE

SEQ ID NO: 5038 - protein, 402 aa, Staphylococcus epidermidis
GEKMFKKFEYKILYKRIFFTCLILVIYIIGSNISIVSNENLRTHKDSFFKLAITNVGGDLHTLNIFSLGLGPWLSSMIILTLINHKSNDKVKTQTRRERHFKERALTLIISAAQGFYIIHSYINKHAIKDSNMLILLLVLITGTLLMVWLADQNTTYGISGPMPIVLMSLVKSIFNTPFPKLNSSASLITMIIVLLVLDLFILFFIELTEYRIEYNDIMNISAKDIPSYLSWKLNPAGSISIMVSLSLFMLTNNIVNFIGRFIVNHNFETHVFNFTNPVGITIYLLLQMILGYFLSRLLINTKRKSKEFLKNGNYFEGIQPGQQTEKFLGSKARRICWFGSIVVAIVLAIPMYSALLVPHLLKEVYFTTQMIVFVYIGINIAETIRAYLYFDSYKQILNKYW

SEQ ID NO: 5039 - protein, 371 aa, Staphylococcus epidermidis
IVEIAFFRVYDNYGLKIKKEGFGEMDIILGVGTLVLVLIIMTLFLNFAPYGKQGLQALSGAACATFLPQAFLSYAIGGVFHVKFFQEIGDLAGSLSGIAVGILTCLKLEVSPVFAVIVGLVLHDSKLLPAFIAAYVVAFGIKFVEKKVPEGLDLIVVILLAPAVTFGLANLISPGVIAVLKQIGSAITSVGDNNPYALAVILGLVIPVTGMTPLSSMVLTSLLGLTGIPMAIGALTCTGASFVNGILFSKLKIGNKGNAFAVFVEPLTQIDLIAKYPLQLFGANAIIGVVNACIVTYSGLIIDIKGMATPIAGAIVLYGFNDAVRSTITIIAVAIASVILAYVISAIINKFNLMNVGFKLPRRKNQVKESV

SEQ ID NO: 5040 - protein, 178 aa, Staphylococcus epidermidis
VGGIEVKIVIADDHAVVRTGFSMILNYQEDMEVVATAADGVEAYQKVLEHRPDVLILDLSMPPGESGLIATSKISESFPDTKILILTMFDDEEYLFHVLKSGAKGYILKNSPDEQLILAVRTVYQGETYVDMKLTTSLVNEFVNQSQTDEVSSSSDPFKILSKRELEILPLIAKVLWQ

SEQ ID NO: 5041 - protein, 152 aa, Staphylococcus epidermidis
NKMIGSELYFSLFVGVVLSLIFAEKFGINPAGLVVPGYLALIFDQPIMLLSVLIISCLTYFIVSNGISKWVILYGRRKFAAMILTGMVIKFIFDLLYPLTPFEMVEVSGIGVVIPGIIANTIQKQGVVITLSTTMLLTCITYIILFLYSFIN

SEQ ID NO: 5042 - protein, 625 aa, Staphylococcus epidermidis
LIVIDRQIKLIKLLLNYTDTYISGHDIAKQLNVSNRTIRNDIKTIHTTFLNELILSVQSKGYMLNTCLYTPDEIQSALESVIVKENKLLITIAYRLFMEKHTFTIKELSSTYHLTKSKVIDYVTRIQTWAIKFDIYLSIKKKQGIMIDASTTSISNAVLHINQLTDDDFKVENLILQELPQAHTRKIKQIISKHIDNHQLSTSENKIQQLLVHLILIIKHSQPEEEDWSTDTESLTIAKKCIKDINETLGYQLNNKTSECFSFFISYHFNKFDLGIQQLFIQSYIDRLIELMEQHIGFPFSQDTILKDNMNVHFSRTYLRLMSHVYLNNPLTSQIKRLYPFVFNTLYDSIRQLSQDTNIQLSEDEIAFLTIHFQSSIERHKSSHIHVVIACYYGLGISTLLAEKIKQLNHAIQIVDTLKLEDINNYHFEGIDLLITTHDFDTSQLLQIPKVIQVSPLFSDEDAKKIEFFVKDMQNPLSKDDILSKIQLSVESNFKMNHSNHILPIFEKSKEILDYHHATLDGYIESAIDREKQSSTYIGKGIALPHGNPEKVLKSHMIIFKPSQPITWKQHEVKLVFFLAMSKKDLNINRKIIQTIAQLEEDDIHQLCLLDDLQLKNTLYARFKE

SEQ ID NO: 5043 - protein, 73 aa, Staphylococcus epidermidis
KGVIIMTQKIIKVEGMSCEHCRNAVESALAKLNGVSSAEVNLDENHVRVEYNDSKVTFENMKEAIEEQGYDVK

SEQ ID NO: 5044 - protein, 121 aa, Staphylococcus epidermidis
IEVINCMENFDKSYHDKTGDVLGALSYLSVFFAPVLFPLIVWIVGQPPASTYSRNALFNHILSWVCLVLGLISFAAGLSLIDSTNGVAVLVIGVIIGGILLIASLVLFIINIVKGIKLLMI

SEQ ID NO: 5045 - protein, 192 aa, Staphylococcus epidermidis
MIAIIDYGLGNISNVTRAIQHLGYDVILTCDDKDVQKAEAIVLPGVGHFQDAMHSIEEKSIKDMLKNIHDKPIIGICLGMQLLFQHSAEGDVSGLELVPGNIVPIQSSHPIPHLGWNELKSTHPLLQSDVYFVHSYQAEMSEYVVAYADYGTKIPGVIQYRNYIGIQFHPEKSGTYGLEILNQALKGGFIND

SEQ ID NO: 5046 - protein, 167 aa, Staphylococcus epidermidis
GIEMIRFARLEDLQGILTIYNDAILNTTAVYTYKPQQLDERLQWYQSKAKINEPIWVYEKEGKVVGFATYGSFRQWPAYLYTIEHSIYVHQQYRGLGIASQLLENLIRYAKEQGYRTIVAGIDASNMDSIALHKKFDFSHAGTIKNVGYKFDRWLDLSFYQYDLSDS

SEQ ID NO: 5047 - protein, 134 aa, Staphylococcus epidermidis
LLEMTILIRTFMNSKIHRARVTESNLNYVGSITIDANILDAVDILPNEKVAIVNNNNGARFETYVIAGERGSGKMCLNGAASRLVEVGDVIIIMTYAQLNEDEMVDHSPKVAVLNENNEIIEMINEKENTISNV

SEQ ID NO: 5048 - protein, 530 aa, Staphylococcus epidermidis
MNWISIILFIMVVGGISFYAYLQSRKIKTSSSDGYFMGGNSLTGFTVASTIIMTNLSTEQIVGQNGQSYAQGMEVMAWEVTAAVAVVLLAWVFLPKYLKYGVNTISEFLELRYDTFTKRFVSILFIFTYVVSFLPVVLYSGSLVFNKMFKVDEYLGVSSSTAVIIISSIIGIIGIIYLFIGGLSLSAFSDSIYGMALIIGGLAITILGLGQLGDGNFLHGFDKIVQDTPEKLNGFGKVDSDVVPWPTLFFGMFFNNLFFWCANQMIVQKALAAKNLKESQKGAIYLSLFKVFGPLITVLPGVVAFNYFNGSIDKSDNAYPALVTSVLPEWAFGLFGAVIFGAILSSFVGSLNSTTTLLTLDFYKPIFGKNKSDKHIARVGHIATVVIGVIVVALAPVISLFPSGLYAVVQQFNGVYSMPVLALILVAFFSKRTSKLGAKVTLFTHIILYAIISFVFTEINYLYTFSVLFFVDLIIILIFNKVKPSSEFDLSTHQPKVDMTPWKYRYVAGIIVLALVVVSYIIFSPLVLAK

SEQ ID NO: 5049 - protein, 533 aa, Staphylococcus epidermidis
DIVFNLYIIKLCLFPVLEEVNSMSQIAFYILSDVHGFIFPTDFSSREKDLPMGLLKANHLIEQDCVHYDGSVKIDNGDFLQGSPLCNYLVSKLKSSLPLTSIYNRLGFDFGTVGNHEFNYDLPYLKQAINQLHYPVLCANIIENTQPFTGQGIHYFKVNGLTIGTIGLTTQYIPHWEQPDYIKTLNFNSAIHTLKSELPTLREKSDIVVVSYHGGFERDLDSGLPTEALTGENEGYDILRQFSDSIDVLITGHQHRDIATIKNQTAIIQPGSKGTKVGKIVIEYTHDKKVLIKECNLMNVHNSTSFKPNDEDIALRNQLEDWLDTQIAELPYAMRINNSFEARKSPHAFVNLLNYILLEKSGADIACTALFDSANGFDEKVTMRDIINNYPFPNTFKVIELSGKDIKLAIERSASYFDIVNHKITVNKEFLEPKPQHFNYDIFAGIQYTIHVSHPYGERVSDLLINDAPLQSDQIYTICVNNYRAVGGGNYDMYVNKPVIKDIQIEGAQLLIDYLSHNDLSQIPQVIDFNVVK

SEQ ID NO: 5050 - protein, 502 aa, Staphylococcus epidermidis
KVGIKTMIYTVTSTLPLVHGGRTKSLLTRIRFLDKEMGIHNKILTTNYNANYNEVYQKFEENQLITKNTQIENIYDWLSDFKLLSIPKSRFKKKTLYSEKDRDIEGLTSKAFNDGNVMRYYDQETYVLYRKFYEDTNIIEFEDVMSPISKKKIERREYNHFGQLHRKIYFSSRTYHKILEEYFDTEGSIYCKKFFNSQKANELDFIQIFKNQRIMKAFKNEKDLFKYYFEHRFKQNDIVFNDARLLDKPLLNNCMNTKNVLVFHNSHIDGDNIKSSYKIALENSDKVAQYLLLTHMQKDDIQHAYGISDEKISIVPHFIKSYGQKDTHHKEDRFVFIGRLGKQKQVDHLIKSYNQFLKNGHQTKLAIYGADEQNQKQVILDLVKEYQIEDKVDLNDFTKHPLEEFKKSKASLLTSEYEGFGLTVMESIEVGCPVISYDVRYGPGEIIEHGENGYLVEPDNIEAFAAYMDKIIKNPLKHVKTKETLKYEQAKNNYQKLFERVK

SEQ ID NO: 5051 - protein, 45 aa, Staphylococcus epidermidis
TAVFVSTIPTKIMIVKPMIDTAPIVIGWVIQAMMVDTKIANINQA

SEQ ID NO: 5052 - protein, 263 aa, Staphylococcus epidermidis
GVVLLSNSKKVAVVTGAAQGIGLKIAERLFEDGYSIALVDFNEAVAKESAEKLSKEGQEAVAFKADVSNRDQVFSVLNQVVEHFGDLNVLVNNAGLGPMTPIESVTPEQFNQVVGVNVGGVFWGIQAAIEQFDKLGHGGKIINATSQAGVEGNAGLSLYSSTKFAVRGLTQVAARDLAEKNITVNAFAPGIVETPMMKGIAEKLAEENNQPMEWGWKQFTDQIALKRLSKPEDVANVVSFLAGSDSDYITGQTIIVDGGMRFH

SEQ ID NO: 5053 - protein, 58 aa, Staphylococcus epidermidis
NFNFINVITTSILQCISCIYINTITILIYNSLLKSSLIFNYYNKHNGSVMTSCLDVKR

SEQ ID NO: 5054 - protein, 41 aa, Staphylococcus epidermidis
NEFVIGTLFIILFYIINFDLLLSSHKVPIHLIIKSDEGELK

SEQ ID NO: 5055 - protein, 43 aa, Staphylococcus epidermidis
LVIVSLLDIIIKSPFPINYICLLGFSYKKKTISCFERLEKQAK

SEQ ID NO: 5056 - protein, 45 aa, Staphylococcus epidermidis
ITVVNYIFNLKKYVIQILLKSRICYILVTKIIFLKIHLTVNILGL

SEQ ID NO: 5057 - protein, 60 aa, Staphylococcus epidermidis
VLVVVRVLFTVVDFFAIVVFLVDDVLGDIACLVDVALFIDVALDLTDVSLTERLKLDVVF

SEQ ID NO: 5058 - protein, 1259 aa, Staphylococcus epidermidis
YNDFVKKCTIKIRHNTYALRKDITLYGGRINKMGKFGLNFFKPTEKFNGNWSVLEHKSREWEKMYRERWSHDKVVRTTHGVNCTGSCSWKVFVKNGVITWENQQIDYPSCGPDMPEFEPRGCPRGASFSWYEYSPLRVKYPYIRGKLLDLWTEALEEQNGNRIAAWASIVENEEKAKQYKEARGKGGHVRANWKDVTDIIAAQILYTIKKDGPDRIAGFTPIPAMSMISYASGARFINLLGGEMLSFYDWYADLPPASPQIWGEQTDVPESSDWYNASYIMMWGSNVPLTRTPDAHFMTEVRYKGAKVISVAPDYAENVKFADHWLAPHPGTDAAVAQAMTHVILQEYYENQPNDMFINYAKQYSDMPFVIMLDEDENGYKAGRFLRASDLGMSGENNEWKPVIQDKLSQQLLVPNGTMGQRWEEGKKWNLKLETEDGTPIDPMLSMVESDYHVETIQFPYFDSSGDGIFERPIATRTIQLANGEEVKIATVYDLMTSQYGVQRFEHELEATSYDDASSKYTPAWQEQITGIKKELVTKVAKEFAQNAIDTGGRSMIIMGAGINHWFNSDTIYRSILNLVLLCGCQGVNGGGWAHYVGQEKCRPIEGWNTIAFAKDWQGPPRLQNGTSWFYFATDQWKYEESNVDKLKSPLAENIKHQHPADYNVTAARMGWLPSYPQFNKNSLLFGEEAKDEGDDSNEAILQKAIESVKNKDTQFAIEDPDLRKNHPKTLFVWRSNLISSSAKGQEYFMKHLLGARSGLMAEPNEDDKPEEIKWREDTEGKLDLLVSLDFRMTATPLYSDIVLPAATWYEKHDLSSTDMHPFIHPFNPAIDPLWESRSDWDIYKTLSKAVSEMAKDYLPGKFKDVVTTPLGHDSKQEISTEYGIVKDWSKGEIEGVPGKTMPNFSIVERDYTQIYDKFVTVGPKLEKGKIGAHGVSYSVSEEYEELKSMVGTWNDDNTTSVKNDRPRIDTARKVADVILNISSATNGKLSQKSYEDLENQTGMELKDISKERASEKISFLNITSQPREVIPTAVFPGSNKDGRRYSPFTTNVERLVPFRTLTGRQSYYIDHEVFQQFGESLPVYKPTLPPMVFGARDKKVKGGQDTLVLRYLTPHGKWNIHSTYQDNERMLTLFRGGPVVWISNEDAADHGINDNDWLEVYNRNGVVTARAVTSHRMPRGTMFMYHAQDKHIETPGSEITDTRGGSHNAPTRIHLKPTQLVGGYAQISYHFNYYGPIGNQRDEYVAVRKMKEVNWLED

SEQ ID NO: 5059 - protein, 167 aa, Staphylococcus epidermidis
LPPVPFILLMSNPLSSAILRARGEIKILSRAALLGELSLLSEDGCDVSLTSCVSFSCSLSSFTFSDAKSSSSLSIASPSSPIIPNTALTSASSPACTLISNNVPLAGASTSLVNFSELIVTILSPCFTVSPSDLNHSSTVPSFIVIPSFGIIIFSLIVIHLLCVSLF

SEQ ID NO: 5060 - protein, 44 aa, Staphylococcus epidermidis
HYAVPHFTTFSRKSNSHIILFLMYKSHNIHNFILITKHLPMFYE

SEQ ID NO: 5061 - protein, 234 aa, Staphylococcus epidermidis
MTNVLYQHGTLGTLMAGLLEGTASINDLLEHGDLGIATLTGSDGEVIFVDGKAYHANEHKEFIELTGDEMTPYATVTKFKADSSFKTSNKNQEEVFDEVKKQMKSENMFSAVKISGTFKKMHVRMMPGQEPPYTRLIDSARRQPEETRENIKGSIVGFFTPELFHGIGSAGFHIHFANDDRDFGGHILDFEVDDVTVEIQNFETFEQHFPVDAKSFTDADIDYKDIADEIREAE

SEQ ID NO: 5062 - protein, 590 aa, Staphylococcus epidermidis
ERDVNKQRKQINFWRSLTMRRKRDSYDYVIIGGGSAGSVLGARLSEDKDKNVLVLEAGRSDYFWDLFIQMPAALMFPSGNRFYDWEYQTDEEPHMGRRVDHARGKVLGGSSSINGMIYQRGNPMDYEGWAEPEGMDTWDFAHCLPYFKKLETTYGAAPYDKVRGHDGPIKLKRGPATNPLFKSFFNAGVEAGYHKTADVNGYRQEGFGPFDSQVHHGRRMSASRAYLRPALRRRNLDVETRAFVTKLIFDENNSKKVTGVTFKKNGKEHTVHANEVILSGGAFNTPQLLQLSGIGDSEFLKSKGIEPRMHLPGVGENFEDHLEVYIQHKCKQPVSLQPSLDVKRMPFIGLQWIFARKGAAASNHFEGGGFVRSNDDVDYPNLMFHFLPIAVRYDGQKAPVAHGYQVHVGPMYSNSRGSLKIKSKDPFEKPSIVFNYLSTKEDEREWVEAIRVARNILKQKAMDPFNGGEISPGPQVQTDEEILDWVRKDGETALHPSCSAKMGPASDPMAVVDPLTMKVHGMENLRVVDASAMPRTTNGNIHAPVLMLAEKAADIIRGRKPLEPQYVDYYKHGIDDEKAGAMEDDPFYQY

SEQ ID NO: 5063 - protein, 45 aa, Staphylococcus epidermidis
EACVNIVSFLLCAISRVVIEIIDKIVIKKMTTMTNSFIFIEHPLL

SEQ ID NO: 5064 - protein, 43 aa, Staphylococcus epidermidis
SKCVNSLFNHKEFKINLSVHSITIKIRKEPVPMIDVSGSILST

SEQ ID NO: 5065 - protein, 153 aa, Staphylococcus epidermidis
GESVEPESLKHNQHLQMNLDKLRAQEGYDFGGIALYDYHHTSSPIKWQYVSGNTNDRYKLIILRKGRGLAGMVMKTGKRMVIADVDTALSPEEKVKFPIILSESLTAVVAVPLWLENSMYGVLLLGQRNHQPLPQSLDQLNIEKQIGIFTEIN

SEQ ID NO: 5066 - protein, 81 aa, Staphylococcus epidermidis
LESVNNMISVNNGVKNKKYKVKHIGISNKNMLYRLGALGLNIGSEISIKQKCLLNGPSVVEVNGQHLSLRQRDARLITLEE

SEQ ID NO: 5067 - protein, 204 aa, Staphylococcus epidermidis
IRSVKMSESNHITWHDSEVTKKQRQHKNGHKSAVIWFTGLSGSGKSTVSVALEKELFNEGKQTYRLDGDNVRHGLNKNLGFSPEDRSENIRRIGEVAKLMVDAGALTVTAFISPYKEDREGVRALLEDNEFIEVYTKCSVEECEKRDPKGLYKKARSGEIPEFTGISAPYQAPENPEITIDTEHDTIEQSVVQIIRYLKEHEYI

SEQ ID NO: 5068 - protein, 49 aa, Staphylococcus epidermidis
RNFVCICTSRTLYYKRRSKIKYIRSQSLPDHKVVVDFFYFKPESLPGNY

SEQ ID NO: 5069 - protein, 72 aa, Staphylococcus epidermidis
GKIVDILFIFGLLGGAATSLALGVPMISAGIERLTGLDGSNMILRSIILLTITVYFRNQFLHRFEKRYSKIK

SEQ ID NO: 5070 - protein, 304 aa, Staphylococcus epidermidis
ETTVAYKQFIRFAQHHLHFHHLGRHFMVISKKLSLITIGILISILLISLLIDQTISHQFMNQNSIFGTLFQNYGLFPPTLILIISTVILNYYIFTTFQNKLAKILTLLISFIFTLIKTNEFVSETAQYMLSTSANIKNHKPMGMANNEGNAGNALSLGMSFFISLIILIIITFICYQFWLKHTNNQELYHLFKVSLISFMILFIGLELVDSLKHLWGRFRPYEITDKAGHFTHWLTINGNTGHSSFPSGHTGNGAFLMFIAFYFKKLRTQKIVFSIGLCYSILMALSRIRIGAHFTNDYCRFYH

SEQ ID NO: 5071 - protein, 349 aa, Staphylococcus epidermidis
MNNVKESIIVAFAFVGVVVGAGFATGQEIFQFFTSHGIYSIGGIFITGLILTLGGIFVLNTGFRLRSQNHSESIRYYLHPTIAKLFDIILTVFLFSLAIIMTAGGASTINESFGLPFWLSSFILVILILITLFLKFDRLIAVLGGVTPFLVAVVVMIAVYYFITGDLNFSDVSQYSNQNKSISPGWWFDAINYASLQIAAAFSFLTVMGGKLRYQSSTIYGGLIGGIIVTLLLLLINFGLVTEFNQIKEVALPSLLLAKQISPSIGIIMSVIMVLVIYNTVVGLMYAFASRFSRPFTKRYYILIVMMAIITFACTFVGFISLIGKVFPIMGLFGFILLIPVIYKGILRK

SEQ ID NO: 5072 - protein, 243 aa, Staphylococcus epidermidis
IKRLKEGLLMIDLWPAIDLINSTSVRLTEGKYDSKEKMEKSVEDSIRFYSQFKCVKRIHIVDLIGAKAKEVKEFDYIRSLRKLTTKPIEVGGGIRSKQTIENYIHSGIDYCIVGTKGIQDIEWLTHMTHQFPNKLYLSVDAFGEKIKINGWKEDAKLNLFDYVAKIEHLPLGGVIYTDISKDGKLSGPNFDLTGRLALYTSLPVIASGGIRHQEDLFRLESLNVHAAIVGKAAHLDEFWEGLS

SEQ ID NO: 5073 - protein, 45 aa, Staphylococcus epidermidis
NVSVCKYISLHSKIIQRLWRRKIFKIKEDDKSYLYAQRMVEMINS

SEQ ID NO: 5074 - protein, 48 aa, Staphylococcus epidermidis
SSLVLCSKCNKNYYITLKTDIHILQSNLYLRGFYYESSSMVWTKGCTR

SEQ ID NO: 5075 - protein, 48 aa, Staphylococcus epidermidis
FVLVRASLVANESVAFVSIDWVKLELMFFSEDDVFDCVDLEVTFEDLF

SEQ ID NO: 5076 - protein, 68 aa, Staphylococcus epidermidis
TVIVSKMIERKIILDPSKPVNRSIPAEIIGTPRASDVAAPPSKPKINKISTIFPHNLSVCPFKIGRQA

SEQ ID NO: 5077 - protein, 47 aa, Staphylococcus epidermidis
MKPVNDNGIRLAPAENRINGIAVIAPENSSQNDDIFNPNVMCCCCHR

SEQ ID NO: 5078 - protein, 46 aa, Staphylococcus epidermidis
FVAVDSVDANVEGITVTERTDVTSIELKVLNIFISMITPYIKDGIF

SEQ ID NO: 5079 - protein, 43 aa, Staphylococcus epidermidis
YNKVKAQRAENHQKKYKKDNFYIISIEIVFIYLSWNFLSQPLF

SEQ ID NO: 5080 - protein, 315 aa, Staphylococcus epidermidis
KDKVGEVEMNKNKVIVIGSTNVDKFLNVKRFPKPGETLHINQAQKEFGGGKGANQAIAASRLAADTTFISKVGKDGNANFILEDFKKAGIHTQYILTSESEETGQAFITVDEAGQNTILVYGGANMTLSATDVEMSVDAFIGADFVVAQLEVPFEAIEQAFKIARKQNITTVLNPAPAIELPKSLLELTDIIIPNETEAELLTGISINNESDMKETATYFLDLGISAVLITLGEQGTYCAYQEQYKMIPACNVKAIDTTAAGDTFIGAFLSELNKDLSNLESAIRLANQASSLTVQRKGAQASIPTRKEVEAEYN

SEQ ID NO: 5081 - protein, 1186 aa, Staphylococcus epidermidis
EVKVSDVLIDVDVLDESEMLVLDDSLTDVLSLVDSLSLVDVDALSDVDVLVESETLVLDDSLTDVLSLSDSLTLVDVDALSDVDVDALSDVDVLVESEMLVLVEPLNDVLALSESLSLVDVDALADVDVLVESETLVLVEPLNDVLALLESLTLVDVDALADVDALVESETLVLVDSLNDVLSLFESLSLVDVDALSDVDVLVESETLVLVDSLNDVLALVDSLSLVDVDALSDVDALVESETLVLVESLKDVLALFESLTLIDVDALSDVDVLVESEMLVLVDSLKDVLALSESLSLVDVDPLSDVDVLVESERLVLLESLNDVLVLFEALTLVDVDVLVDSETLVLVESLNDVLALSESLSLVDVDALSDVDILVESERLVLVDSLNDVLALFESLTLVDVDALSDVDALVESETLVLTDSLDDVLALSESLSLVDADALSDVDVLVESETLVLVEPLNDVLVLFDSLTLVDVDALSDVDVLVDSESLVLTDSLDDVLALSESLTLVDVDALSDVDVLVESETLVLNDSLMDVLVLFDSLTLVDVDALSDVDVLVESEMLVLVEPLNDVLALSESLSLVDADALSDVDVLVESETLVLNEPLNDVLALFESLTLVDVDALSDVDVLVESERLVLVEPLKDVLALSESLSLVDVDALSDVDVLVESERLVLVEPLNDVLALSDSLSLVDVDALSDVDALVESETLVLIDSLNDVLSLVESLSLVDVDALSDVDVLVESETLVLNDSLMDVLALSESLTLVDVDALSDVDALVESETLVLVDSLNDVLSLVESLSLVDVDALSDVDVLVESERLVLVDSLNDVLVLSDSLSLVDVDALSDVDVLVESEMLVLNDPLNDVLALFDSLSLVDVDALSDVDALVESETLVLNDSLNDVLSLVESLSLVDVDALSDVDALVEPERLVLVDSLNDVLVLSDSLSLVDVDALSDVDALVEPERLVLVDSLNDVLLLFDSLSLADIDALSDVDVLVESETLVLVDSLNDVLALSDSLSLVDVDALSDVDVLVESETLVLVDLLNDVLALLESLTLVDVDALSDVDVLTDSDNSLLVLADSLAFIDALSDVDVLVESEMLVLVEPLTLVDVDALSDVDTLAESETLVLVDSLNDVLLLVDSLFLADSDALSDVDVLADSDNCLLVLADSLAWIDVLFDVDALNDSERLLLVDND

SEQ ID NO: 5082 - protein, 447 aa, Staphylococcus epidermidis
NIEVKIVRHKLGDSSMLLFIIEIIIMILAILLGLRTAGALGCGIFAIVAQLIMIFGFQLPPGSAPVTAVLIILSIGIAGGTLQATGGIDYLVYIASRVIERFPKSIIFIAPMIVFVFVFGIGTANIALSLEPIIAKTAQKARIQPKRALTASVLTANLALLCSPAASATAYIISVLAGYEISMGKYLSIVLPTALISMLMLSTFCTFVGRKEHVRDESERLVQMPEVEIKNDFSLKVKIGVISFLLCVMGILTFGIFPNLMPQFNVNGDVVKVEMTEIVQFFMYLSATINLLLIKINTSDILSSNITQSAMGALFAVLGPGWLGATIFNAPHNLKILKNDIGSIISEVPWLVIILVSVVAMIVISQTATASIMVPIVMSLGIPPIYFVAMVQTLNVNFVIPAQPTLLFAVELDETGRTRPTSFMIPGFFVITVSVITGFVIKTILGY

SEQ ID NO: 5083 - protein, 41 aa, Staphylococcus epidermidis
AIRVRNIKFYSTFVLLLLFIHNNLFYTLFQEFIEIDNSHIL

SEQ ID NO: 5084 - protein, 280 aa, Staphylococcus epidermidis
VSFLRFEQSRLYKHREDDTMFISKQELYEKLQYVTPRTFAYLNEIDYYNLLMIIEEHQISIPPIHQLRKTLRGSKIMKPKNRVDNCYIHLKDEIPTPINNEQLSFLHFYPRQQIHLILSAYSRMKSLKLQSQKHCLKLKFPLDQHSIRKEITPPQSSDKDNDILICLLQKLINEITKCQVPVSLKNNSFEIKLPNYIIKVDLNYHEQQDHLYPLQYSIHAWHRDFQYLEISNTFTIPSLNDLIFHIQKLFLLIFQLPEHLARQEYSLSQYYFYSQCHTKN

SEQ ID NO: 5085 - protein, 249 aa, Staphylococcus epidermidis
LKLVRNGLVKMFLNLNNEQQHALDAAKQAFGPMLEGLVKYSIPITLVTFILGLIIALFTALMRISTSKLLRGIARVYVSIIRGTPMIVQLFIIFYGIPELGRLVTNNADNQWTLAPVIAAVIGLSLNVGAYASEIIRGGILSIPKGQTEAAYSIGMNYRQTVQRIILPQAIRVSIPALGNTFLSLIKDTSLLGFILVAEMFRKAQEVASTTYEYLTIYLLVALMYWVVCFIISIIQGWYESRIERGYRS

SEQ ID NO: 5086 - protein, 62 aa, Staphylococcus epidermidis
LRKVLISLNFKVFLIIIFHDFLIYYEHGFMYSRFKEHAEQSSHLFILKSHLKPFPPFRYTYD

SEQ ID NO: 5087 - protein, 136 aa, Staphylococcus epidermidis
SVKVMKLKKEINVVGAIIYSDNKILCAQRSENMSLPLKWEFPGGKIENGETEKDALIREIKEEMKCDLIVGDKVTTTTYEYDFGIVNLTTYKCELNNKKPTLTEHKEIKWVGKNELDKLDWAPADVPAVRRIIEEN

SEQ ID NO: 5088 - protein, 69 aa, Staphylococcus epidermidis
IIEVMTMRNAIEELIFSDVSSYDIYVNTGVNQGLVGDIKDGYLTIDSIPYIDAERLYYYSLERKALVTS

SEQ ID NO: 5089 - protein, 114 aa, Staphylococcus epidermidis
VKEVGVMFIQFKRLLIGRPKRNRDLKNEKISKFKGLAILSSDALSSVAYGPEQILITLSVIGAVASWYTLPIAGAVLILLTALILSYRQIIYAYPKGGERILFLKQILVRNGDC

SEQ ID NO: 5090 - protein, 573 aa, Staphylococcus epidermidis
TLEVENMKSAQALKQNLTSLDGQKYGAYKQIKDLYEFNLFKLRINHIQADPFAPPSKMSVVIDRQQAKFPDSLLNSELKQRAVSDYLTRVFHKQIQSIVAQDKKVSKIQIDSCGQEILERTAIVIKNHQIEARIEVGLPARGRTILGRIARHTLINVLPQIVEHALCYRNINGSQLQQQVELMMDQEEIRQQLVKRDLVAFVANGAILPRKSGVSDLPMNNAIEFKSPKQYEIVMKLSSGKVIKGMGIPKGITLIVGGGYHGKSTLLEALERGVYNHIAGDGREYVITNQDAMKIRAEDGRSIQNVNIQPFIDHLPGEKDTTHFSTENASGSTSQAANVMEALESQASLLLIDEDTSATNFMIRDGRMQRLIAPEKEPITPFSNKVKALYDDHNVSTILIVGGSGDYFDVADQVLMMDEYVLKDVTQHAKDIAQSDGYQRRLSSHYQFGHIPSRIPLRASFNQKGKRDRFKAKGLNVVTYGKETIHISGLEQLVDDSQTQGLAMMLSYVKNELLDDKSTIVELTNSLYQRIEKHGLDVISNHQGHPGHLALPRKQEFIATLNRYRRLKIKQRE

SEQ ID NO: 5091 - protein, 333 aa, Staphylococcus epidermidis
IEEVGTFMFKKIATIIGSTLFGTVLFAKVKEKRSYKSFLQEKMIRISGMKKTFESIDDAKKALNETKYQTSGKYNGTTYEFKHKVQIRDYYGSLVYVVNDHGLPDQRTVLYVHGGAWFQDPLENHFEYLDLLVDALDARVIMPVYPKIPHRDYRTTFELLTKIYKRLLTKIDEPENLVIIGDSAGGQIALAFAQMLKKEQLSQPGHIVLISPVLDATFKNPEARKYEKEDPMLGIDGSKYLVELWAGDAPLDDYKMSPMNGDLEGLGHITLTVGTKETLYPDAVKFSHMLNDKGIKHQFIPGYNLFHIYPLFPIPERQHFLEQLKKIIVTKEL

SEQ ID NO: 5092 - protein, 154 aa, Staphylococcus epidermidis
VARVGYHLTWKMILGLFPKEDKVKALDALERVNILDKYDQRSDQLSGGQQQRISIARALCQEPTIILADEPVASLDPLTTKQVMDDLKKINEELGITILINLHFVDLAKEYGSRIIGLRAGELVYDGPASETNDEVFNHIYGRSIKNDEKLGVE

SEQ ID NO: 5093 - protein, 48 aa, Staphylococcus epidermidis
FSLLVFIKLYERAYFFKYFGETLEGTGQAEDYRLKLSPKKASQQYEVL

SEQ ID NO: 5094 - protein, 474 aa, Staphylococcus epidermidis
NFLFLMQMKLGWHNVLLVKGGIYYMSKSYDLIVIGAGPGGYVAAIRGAQLGKNVAVIEKNNAGGTCLNVGCIPSKTLLEHGEKAHSIRVANDWGITTKDLKIDFTQFVQRKKKVVQTLTGGVKQLLKKNKVTYIEGEARISKNLKVDVNNETYQAKDIILATGSQPFIPPIDGLDQVNYETTDTFFDLEKLPKQLAVIGGGVIATELASSMADLGVRVTIIEVADDILLTEINETREMLKAHLDNQGIKILTKAKIKQVKESKIILDGQDDVSFDTLLVATGRQPNTQVAKDLNLEMDGKFFKVNEHYETSQKHVYAIGDLIKGYQLAHAASAHGIHVVETIMNKQPSLVRQEDITRCIYTRLEAASVGLSEEQAKEAGYDVKVTQSAFQGNAKALIKGENEGFIKLVVDKKYGEVLGAFIVGPHATDIIGELLSVKASEGTIHELSQIIQPHPALLEAIGESADAFFDSAIHM

SEQ ID NO: 5095 - protein, 160 aa, Staphylococcus epidermidis
ILLLLLSLNKYIFWEKEMKFKKLLSRIIIATMITFTGTLSYQAIEQTHISHAAHNYYGKKQCTWWAFKRRAQLGKPVSNRWGNAKNWYSNARRSGYATGHKPRKYAVMQSTRGYYGHVAVVEKVYKNGKIKISEYNYNVPLGYGTRIISKSSARNYNYIY

SEQ ID NO: 5096 - protein, 419 aa, Staphylococcus epidermidis
ECLLTMLSAQQFLKEFNNVESLDESLYEIVSQICEEVKLQGDKALKNYNLQFDQVETEKLELEQSQLKNAYDMLDNETRDALEQSYQRIKVYQENIKVKQESSQQTECYERYHPIERVGIYVPGGKASYPSTVLMTATLAQVAGVNEITVVTPPQNSGICQEVLAACYITGVHHVYQVGGAQSIAALTYGTETIKKVDKIVGPGNQYVAYAKKFVFGQVGIDQIAGPTEIALIIDESADLDAIAYDVFAQAEHDEMACTYVISENEKVLNQLNTIIQEKLQYVERQDIISQSIANHHYLILAQDTEEACLIMNTIAPEHASIQTRAPEMYIDKVKYVGALFLGHFSPEVIGDYVAGPSHVLPTNQTARFTNGLSVNDFMTRHSVIHLSQKTFNEVAESAEYIAHIESLFNHEKSIHVRR

SEQ ID NO: 5097 - protein, 74 aa, Staphylococcus epidermidis
GEILSFYEFMQNFLGDDTPLGELVDWINQDINFPKDVTSQKEILTYFRNHPCPENIPVTSIKRALAVFNQFTKV

SEQ ID NO: 5098 - protein, 45 aa, Staphylococcus epidermidis
QYVLKNHLHVDKMNWLILIINIIAQKINILSKNSEKLTKIIFLSD

SEQ ID NO: 5099 - protein, 122 aa, Staphylococcus epidermidis
EESLMVLRYATNLKLAKELYDASKPKLKGDQGMIDTFTNTFGLPENSVKLAGGVEAAAAGLFAASFLNKNISRLGSLAAISVLGVAAYKHFEAGHGKKGAQHALDLLGLSTLSLLDTFSCKK

SEQ ID NO: 5100 - protein, 66 aa, Staphylococcus epidermidis
SNSLICLACPSVKGLLVTLKFNLIHLLYFVIPIFVIVYICLFLKVINYIFNSSMYHLLFSVNVILN

SEQ ID NO: 5101 - protein, 50 aa, Staphylococcus epidermidis
SESLLFEHPTRAIDITINKIPQNFFIFYLLLIFIYREITIKYYLVLNCYL

SEQ ID NO: 5102 - protein, 84 aa, Staphylococcus epidermidis
GTPLELVFVNTLGPKPCFAKPNKILLLEYIPLFVADAAAVKTTKLTMPAAKGTPISVNNLTNGLLSGSTLNHGMTDMITSKPPI

SEQ ID NO: 5103 - protein, 48 aa, Staphylococcus epidermidis
FVTFNHRILLTELGLSSRTVLQTSINVGIWCVVCMYNWNSYWYFHSQV

SEQ ID NO: 5104 - protein, 169 aa, Staphylococcus epidermidis
VNTFALGSEDMETVYFAGGCLWGTQAFFNTIPGVIQTEAGRANGTSKCLDAPYDGYAECVKIHFDPAKTSILMLMDYLFEMINPYSLNQQGQDKGQKYRTGVYSESSKHLNEAKDYIKRREDAKQVMVEVQPLSNYVKSAEEHQNHLEKFPEDYYLCHVPPALLNKYKK

SEQ ID NO: 5105 - protein, 108 aa, Staphylococcus epidermidis
IQTLSWLNIRKVTAQRGENHQKNYKKDNFYIISIEIVFIYLSWTFLSQAHLYIYIVFWMNRMMAITTMTIIETKDKILKCLLFVSLLDSPFSIISCSSRSISRSKSVF

SEQ ID NO: 5106 - protein, 42 aa, Staphylococcus epidermidis
IQTLSWLNIRKVTAQRAENHQKNYKKDNSYIISIEIVFFYLS

SEQ ID NO: 5107 - protein, 317 aa, Staphylococcus epidermidis
SFQFISPSISFIISNSIMNRKKKGKNKVMTIAIIGPGAVGTTLAFELKKVLPDTELIGRQDKLMTYFPENTSNGSNVKVTSFNHINQTFDVIIIAVKTHQLDDVIKQLPKITHDDSLIILAQNGYGQLNKLPYQHVFQAVVYISGQKVNNNVQHFRDYQLYIQDSTLTRQFKQMVHPSKIEVVLQENIEKSIWYKLLVNLGINTITAIGQQPAKILKSPHIESLCRRILVDGLKVARAEQIDFEDHIVDDILNIYKGYPDEMGTSMYYDVINKHPLEVEAIQGYIYKCAKKHHLETPYLDMAYTFLYAYHLEYTQPD

SEQ ID NO: 5108 - protein, 43 aa, Staphylococcus epidermidis
SPQFKYKHILRIHLSDMEYNYNIVSFDTKILMINHLMLVLMRI

SEQ ID NO: 5109 - protein, 61 aa, Staphylococcus epidermidis
KRQFLHYFNRNCLYLLILELSVPATLLIITKFLNTMFCYRDVGMFYSFEKRLYVAINKVTD

SEQ ID NO: 5110 - protein, 267 aa, Staphylococcus epidermidis
LFKFLGGYLTMKKIATATIATAGIATFAFAHHDAQAAEQNNDGYNPNDPYSYSYTYTIDAEGNYHYTWKGNWSPDRVNTSYNYNNYNNYNYYGYNNYSNYNNYSNYNNYNNYQSNNTQSQRTTQPTGGLGASYSTSSSNVHVTTTSAPSSNGVSLSNARSASGNLYTSGQCTYYVFDRVGGKIGSTWGNANNWANAAARSGYTVNNSPAKGAILQTSQGAYGHVAYVEGVNSNGSIRVSEMNYGHGAGVVTSRTISASQAASYNYIH

SEQ ID NO: 5111 - protein, 53 aa, Staphylococcus epidermidis
FPFSISSPSHFNKFILILTNVYVFIHPNYCEKCSAYVYKIYSLNKSWFTYLIY

SEQ ID NO: 5112 - protein, 45 aa, Staphylococcus epidermidis
LRFSFTFANKTVPNNVEPIIVAIFLNMNVPTSSIYNHFKPSASKR

SEQ ID NO: 5113 - protein, 70 aa, Staphylococcus epidermidis
WPKFLGNQNIQVHQTANNRFLKESCYLLGNNISMGTLRQESCDSCLSFIFLGKHLTYSNDNQYKFNKYTI

SEQ ID NO: 5114 - protein, 55 aa, Staphylococcus epidermidis
KCELRWYLNRLSRCVSFVSLHIMEVERSNCIAILMKVEGVIVKSVIHIYDNMELC

SEQ ID NO: 5115 - protein, 510 aa, Staphylococcus epidermidis
AITSNITKKGWVLMTNINVRNYIDESYGLFINNEFQASDSGETLTVSNPANGEDLAKVARAGKKDVDKAVQAAHDAFDSWSKISKEERADYLLEISRRIHEKTEHLATVESLQNGKPYRETSTIDVPQAANQFKYFASVLTTDEGSVNEIDQNTMSLVVNEPVGVVGTVVAWNFPILLASWKLGPALAAGNTVVIQPSSSTPLSLIELAKIFQEVLPKGVVNVLTGKGSESGDAIFHHEGVDKLSFTGSTDVGYGVAQAGAERIVPTTLELGGKSANIIFDDANLEQVIEGVQLGILFNQGEVCSAGSRLLVQSSIYNELLPKLKEAFENIKVGDPFDEDTKMSAQTGPEQLDKIESYIKIAEEDDKANILTGGHRITDNGLDKGYFFEPTIIEINDNKHQLAQEEIFGPVVVVEKFDDEQEAIEIANDSEYGLAGGIFTTDIHRALNVAKAMRTGRIWINTYNQIPAGAPFGGYKKSGIGREVYKDAIKNYQQVKNIFIDTSNQTKGLY

SEQ ID NO: 5116 - protein, 52 aa, Staphylococcus epidermidis
LLYSCNNKFCYYYNFSFDEFNLSFKYLANKEYLLDVNLILDIVKIVHKIDKK

SEQ ID NO: 5117 - protein, 44 aa, Staphylococcus epidermidis
YTHSIKRLQYFLKILHKKTRLLRVEFLKMYYYKKRLAATEIGGI

SEQ ID NO: 5118 - protein, 67 aa, Staphylococcus epidermidis
LKELNTTFGDKQRGQVTNEILNESKKDIPNSYITYNSQIDGVNNKVRHFNVTPESIYLIDYKLSKKE

SEQ ID NO: 5119 - protein, 46 aa, Staphylococcus epidermidis
NTNSIAFLEFIILALYFSDKIIYSNTSSSSLILIVLNFNNRIKVNY

SEQ ID NO: 5120 - protein, 88 aa, Staphylococcus epidermidis
TDYSSIIFDALTVDKKGCLYTPNHSQYVEERGVYQDVMDTLKPIWYTDAELLINDLITDSIPQLNNKYTNKNNQSFEYISKLISNQLK

SEQ ID NO: 5121 - protein, 340 aa, Staphylococcus epidermidis
FNSSLEECRNMVEKFKAFVVDQDDNGIVSNSYKELTKDDLPEGDVLIKVHYSGINYKDALATQDHNKIVKQYPMVPGIDLAGTIEETNAPGFEVGDKVIVTSYDLGVSHYGGFSEYARVKSEWVIELPEDLTLEEAMIYGTAGYTAGLAIEQLEKSGMSIEGKEVLVRGATGGVGTISLLMLNNLGYDVIASTGRDDAEEKLKKLGAKEVIGRLPEDNSKPLEKRTWQAAIDPVGGENLPYIVKRLDNNGSVALIGMTGGNNFETTVFPFILRGASIIGIDSVFTPIKLRKRVWRRLAKDLKPQQLHDIKHVISFDEIPKAIDQVINHNNTGRIVIDFNV

SEQ ID NO: 5122 - protein, 295 aa, Staphylococcus epidermidis
FEMSAQDPRNKFKTDNYEKQEQEVPGIQAKMSPQPDCGEDSYHGHHRLDGFKILVTGGDSAIGRAAAIAYAKEGADVAINYLPSEQQDADDVKQIIENVGQKAILIPGDIRDEQFNYDMVEKAYQQLGGLDNVTLVAGHQLYQDELSEFKTQDFTETFETNVYPVFWTVQKALEYLQPGGSITTTSSVQGYNPSPILHDYAATKAAIISLTKSFSAELGPKGIRVNCVAPGPFWSPLQIVGGQPQSAIPTFGQNTPLGRAGQPVECAGTYVLLASDDASYITGQVYGVTGGTQID

SEQ ID NO: 5123 - protein, 67 aa, Staphylococcus epidermidis
ISQSSDYVRHLNHWTGFFISINLNNNQYKFAILIKNNLLRFIRTIEMITAFAFKILIYLLGFALTGY

SEQ ID NO: 5124 - protein, 71 aa, Staphylococcus epidermidis
VLLPFSKFIQIKICKKVHIKIHHSLFIENTSFLNFKLMLEKYLYFTLISPFSLINFTLLFPFSTLLLYNTR

SEQ ID NO: 5125 - protein, 159 aa, Staphylococcus epidermidis
FAMLWHLIFMIPTIIGYSFGMFCLISSETFKSKGFLLLGVGIFIFSLIYILIYSLVTLIPNVAILSRRFHDRSMTMTLPIIFYVFTVIVSGFNYLPNIDNSAVLIFMGIICLIYWIGSILILVLTCLDSKTESNKYGPSPKYNRNETNFHGDNANPVDK

SEQ ID NO: 5126 - protein, 46 aa, Staphylococcus epidermidis
VLTLLQISCNVKHNSITYQEKWRDWPKEASATLYHVPIPVTEKVRR

SEQ ID NO: 5127 - protein, 322 aa, Staphylococcus epidermidis
GIKTMLLFLCFLIELLLIVLLYTKQSFTLNLFSFILYNIIGFVMMTYHMVTVSIPYDMFIIVIVAMILLLIKHRYIFKLQTGRFFILQLSHHFYTVGLFAVSCLYISTIPLIIINSLALWAATIAFSTIYSFIGYLSWSTAFENHQYYKHVKLIMVLGAGIFSEEVTTLLAARLDKALSVYHSQRTKPIIIVSGGQGPDEPISEALAMKRYLIAHNVPENHIFMENQSTNTRTNFLYSKSIIHSMMPTSSQMLCVTSQFHVLRALKFAKKAHLSFDGIGSRTPYHFLAQSMIIDFLGLMYQYKTILTIYFAMLFWLAILQTI

SEQ ID NO: 5128 - protein, 46 aa, Staphylococcus epidermidis
FTKTNKSEAKNLPKFLASVLFYSRDFVTLIKMNMFYNIILRRIFYA

SEQ ID NO: 5129 - protein, 210 aa, Staphylococcus epidermidis
MSETLQNQRQFNSQFEHQEIHRGKRYGKKKRSWVSLIIQVFVLVLTAITGYSMLKQPIFKISFVNETINFHQLRNFQDTVTQIGNLNLGNIDQLQQSVDNLIIIFNIFFVLCLISLFITVITIIFNRTALKVVNILLLAIMLVITLYFSYIIHTIAQKISESLKQYYLTVSPEQVLTEADAIHNALILIGCSIALLIVSLFFRNRLPRIK

SEQ ID NO: 5130 - protein, 158 aa, Staphylococcus epidermidis
MNKTFTVTRTVTEDAIDNNNHMHDAYYNIIFSEVINKFNEVHGLSWSERDRLQYTVFTVETHTTFLHELTLGQEFNIELFLYNYDDKRTHFFLRMLIDNQEVVATNEVMMLGIDRTQRRAAPFPKHYLNAIQDYAHKQEKIEWPPQLGHSIGIPYKGE

SEQ ID NO: 5131 - protein, 727 aa, Staphylococcus epidermidis
RERTYSMNKLTIIVTYYNAEEYITGCLESIKQQRTQDFNLIIVNDGSTDQSKKLMDEAIKDYDKNIRFIDLDENSGHAHARNIALEEVETPYFMFLDADDELASYAITFYLEKFNNTDGLIAPIHSFTTQRPQFVDLDRVRVEYFNAKENINSFLRKQSACNIIFRTAIVRAHHIRFNENLNTYVDWSFVLEYMKYVNKFVRIFNFPFYFRGEVYDPFETLTLSEQNFDILFKDYVNSFYDAIKRATNPKVREFIVTKMGNKIANEFEPTRYDINERYQTHKDTLVELSKFLHVHLVKNQKLINKIETILLMNNETDKAFKVNQFRKTLRHVKNIVLRRKNKERSLYDLTDKEDNVKPKTIVFESFGGKNYSDSPKYIYEYMQKYYPNYRYIWSFKNPDKNVVPGSAEKVKRNSAEYYQAYSEASHWVSNARTPLYLNKKENQTYIQTWHGTPLKRLANDMKVVRMPGTTTPKYKRNFNRETSRWDYLISPNRYSTEIFRSAFWMDEERILEIGYPRNDVLVNRANDQEYLDEIRTHLNLPSDKKVIMYAPTWRDDEFVSKGKYLFELKIDLDNLYKELGDDYVILLRMHYLISNALDLSGYENFAIDVSNYNDVSELFLISDCLITDYSSVMFDYGILKRPQFFFAYDIDKYDKGLRGFYMNYMEDLPGPIYTEPYGLAKELKNLDKVQQQYQEKIDAFYDRFCSVDNGKASQYIGDLIHKDIKEQ

SEQ ID NO: 5132 - protein, 499 aa, Staphylococcus epidermidis
KRGTVFVMNTQHSKTDVILIGGGIMSATLGTLLKELTPEKDIQLFERLSQPGEESSNVWNNAGTGHSALCELNYTKEGKDGSVDITKAIHINEQFQISKQFWAYLIREGHIESPDKFIQSVPHMSFVKGEENVKFLKSRVASLQKNVLFEKMKISQDPEKINSWVPLMMEGRQSDEAIAITYDETGTDVNFGALTKKLIANLQQKNVGINYKHEVLDIKKLNNGNWQVVVKDLNTSNVMNYESKFVFIGAGGASLPLLQKTKIKESKHIGGFPVSGLFLRCKNPDVIHRHHAKVYGKAEVGAPPMSVPHLDTRFVNGEKSLLFGPFAGFSPKFLKNGSYLDLVKSVKPNNMITMLSAGVKEFNLTKYLVSQLMLSNEERINDLRVFLPEAKDEDWEVITAGQRVQVIKDTDKSKGQLQFGTEVITSEDGSLAALLGASPGASTAVDIMFDVLQRCYKSEFKSWEPKIKEMVPSFGLKLSEHEDMYHSINEEVKKYLNVK

SEQ ID NO: 5133 - protein, 67 aa, Staphylococcus epidermidis
YADAHVTLNPNESEPESYDKYDVRVPVEQNDHTMKVELDVPKGLNVESVKTIEGFKHHFLKIKREHY

SEQ ID NO: 5134 - protein, 56 aa, Staphylococcus epidermidis
IFYFRHAFSFSVVFSFDQVKDKDFEVHDRLILNYFAHYRIDDLSLSQIDVCLILPF

SEQ ID NO: 5135 - protein, 56 aa, Staphylococcus epidermidis
LSRAILLFKFYLSTGLALSPWKFVSLRLYFGLGPYLLDSVLLSKQVNTNINIDPIQ

SEQ ID NO: 5136 - protein, 662 aa, Staphylococcus epidermidis
GGHFMTATFIIIYIVVALILIGFINFFLIKRKRKNKDKRVEQRSTIDSKRESNQSKFKASDLEQTTKSNTDPTQSNDIEDEKRKNHFDSEIDNASQFINTDSKEDRNALSHKNQEEDDASNDVLNPIDPNSTEGRVNERIKNQESNFIFGKGITRGKILAAMLFGMFIAILNQTLLNVALPKINTEFNISASTGQWLMTGFMLVNGILIPISAFLFNKYSYRKLFIIGLALFTLGSLVCAISFNFPIMMSGRVLQAIGAGILMPLGSNVIVTIFPPEKRGVAMGTMGIAMILAPAIGPTLSGYIVQNYDWNVMFYGMFFIGIIAIVIGLFWFKLYQSTTNPKADIPGIIYSTIGFGSLLYGFSEAGNKGWGSTEIVTMFIVGTVFIIFFILRELRMKAPMLSLEVLKYPTYTLTTIINMIVMMSLYGGMILLPLYLQNLRGFSALDSGLLLLPGALVMGALGPVAGKLLDTIGIKPLAIFGIGIMTYATWELSKLNMDTTYLHIMWIYIVRSFGMAFVMMPIITAGMNALPPRLISHGNAFVNTMRQLAGSIGTAILVTVMTTQQTNHLSAFGEELDKTNPVIQDHMRELAQQYGGESAAMKLLLEHVNKLASVEGVNDAFIVATIISAIALILSLFLQGKKKAQLSAEKANAEDYPSQQDK

SEQ ID NO: 5137 - protein, 221 aa, Staphylococcus epidermidis
VKHLRLIGLPHKNKNTYVNLILRVSLMKAYLYKFMPLLIFVIGLIIFYVFNDYPTLIHVIVIIAFITNGLKNVYFVNNNIRNHMIWVSPKLDRILGMISGILYFGIYVVGFIKQQPLWIVMLILVSTVGTAVLLETKLHITSLQLEETLSSERIKRKVISRHKAQRLKCIFFTVIVVVIISMLISLYLKLMVIFGLAVTIFILASISVAIFEKYFTIIENM

SEQ ID NO: 5138 - protein, 55 aa, Staphylococcus epidermidis
SCLYQYFTVILNCLILNLKIKYRWCVSKSHYKTVNNHKIVDSQYILWGIFYFFDD

SEQ ID NO: 5139 - protein, 72 aa, Staphylococcus epidermidis
VHLLRSSILALLHLSCVVALLFIKVSNYILHEIQIFNIPHFLFHINHFILLLNYLYQHLIITYKLKGRDIHD

SEQ ID NO: 5140 - protein, 341 aa, Staphylococcus epidermidis
KGDYVMISKVEHQRHGLDLIKIDNDDTKIVFTNYGARIVSWKYHDNNIVLGNVVEADEFYFEEPFNFGATIGRYAGRIENASFKLDDDTFQLESNDGQHHLHGGSHGLNRRIFDYEIVDDIGQVKIIFTTTIKEEEDNYPGDMMVKVIHTYDANHRWSVQYEAKSTKKTVFNPSNHVYFNLNRDNNVVYNHCINSSALKMYMLNNKHIVKEGQSLDLHRLLDTNKVYLKDIFESDNETLQQQINHYNGIDHPFEFGGNELTIDNSEFELNIKTDMPHFVMFTFNDPQVWNNDFNIYKAHSGFSIETQYMPNDINMYGAKAQSILEADTLFTSKTSFQIHEK

SEQ ID NO: 5141 - protein, 51 aa, Staphylococcus epidermidis
YKIYQSIIRESRLDYERDEEWQCLGINSFIVICLTISRCWYYFLVILPLCH

SEQ ID NO: 5142 - protein, 49 aa, Staphylococcus epidermidis
IDRYEKASPMIKVSNVITGLAYLYILILKIKSNTKIKLLECESLTQDLF

SEQ ID NO: 5143 - protein, 110 aa, Staphylococcus epidermidis
GGRYMNVQFKKGALELIVLLIIKKEDQYGYSLVQNISRYMTIAEGTVYPLLRRLVKSGELSTYYQPSTEGPSRKYYQLTQQGAARVNQLEEDWKLFTEAVEHFIEESENE

SEQ ID NO: 5144 - protein, 49 aa, Staphylococcus epidermidis
CFLYTQLSCTFNHRKSEITSIYKIMSINVERAERNIEELFPKYAHLDDI

SEQ ID NO: 5145 - protein, 61 aa, Staphylococcus epidermidis
TRSYPWYDFGHTIFWYLRGWLYKATAFMDSDAYSSINSGYCGFIRNKITYYITSIRGDVII

SEQ ID NO: 5146 - protein, 324 aa, Staphylococcus epidermidis
FIKYEGVRKMTVTVRFQSLSQPLTLVSNVKEIPKDATIIWYDFENATDEENEYLKNHFDFNYLEIDDAINGDPRVKYIEYDAYQYMIFHSIINDDYSPISLSVFLEGNVLVTYHHKHFPSLKRVAQYNAENHDSELDCADIVIHILDCMVDKYFNFVYGIEDKVYNFEAKHVDDRYSKSVMENVFQLRSDLIKIKRVLFPMQEVVDTMKQEGNIIKDAKHRMYIQHIDDHLIKQRSVIRTSQEMTNEIRENYESFTSFRMNSIMQILTLVSVIFSPLTFIAGVYGMNFEFMPELKWHYAYFVCLTLMLIITIILIIFFKKKKWF

SEQ ID NO: 5147 - protein, 43 aa, Staphylococcus epidermidis
KCNQYIQIRFIFLIGNDSYYSDIQTYNLNFIRCCRFNIKRKDV

SEQ ID NO: 5148 - protein, 42 aa, Staphylococcus epidermidis
LGNQRIFRITFFHQIFLEMGFHNGLGMNLIFNFFERSERRFF

SEQ ID NO: 5149 - protein, 387 aa, Staphylococcus epidermidis
WRLHTMKNSRFSGFQWAMMVFVFFVITMALSVILRDFQATIGVKRFVFSIKDLAPFIAAIVCILVFKHRKEQLAGLKFSISLKVIERLLLALILPLIILMIGLFSFNTYADSFILLQTSDLSVSLLTILIGHILMAFVVEFGFRSYLQNILETRMNTFFASIVVGLIYSVFTANTTYGVEYAGYHFLYTFMFSMIIGELIRATNGRTIYIATAFHASMTFALVFLFSEETGDLFSMKVIALSTTIVGVSFIIISLIIRAIVYKTTKQSLDEVDPNNYLSHIQDEEPSQEDASSTSNHDVSSKDETKQQDIDNDKHQSKKPNKSDDALTTSNYKEDASSVNKETDTTHNDNIKDHSTYTEDRHSSVVNDVKDEIHEVEDHKADTDKSH

SEQ ID NO: 5150 - protein, 228 aa, Staphylococcus epidermidis
ERKHMINCLIVDDDKKLLQYVSSHLERESIQTHTFTSGEASLDFLENKNVDIAIVDIMMSGMDGFELCQTLKDDYHIPVIMLTARDALSDKERAFLSGTDDYVTKPFEVKELLFRIKAVLRRYQINADNELQLGNLILNQSYMEITVGSKTMNLPNKEFQLLFLLASNPKHIFTRDDIIEKIWGFDYEGDDRTVDVHIKRLRQRLSKLKSSVSIQTVRGQGYRVDQNV

SEQ ID NO: 5151 - protein, 236 aa, Staphylococcus epidermidis
RGEQRHMKDAKELKLMTLEDVLSQIENGMTIGIGTGSTIELLIPQIAELIQQKNYTITGVCTSNKTAFLAKELAMNIVDVNDVEKIDLAIDGADEVDSALNLIKGGGGALFREKVIDEMADRFVVVVDESKLVNYLGETFALPVEVDKFNWYQVAKKIERTYDIHVSRRVNEDVPFITDNGNYILDCSLQNRIPAYELHEFLIHLTGVLETGYFLDIADQVIVGTQEGVKILNKET

SEQ ID NO: 5152 - protein, 145 aa, Staphylococcus epidermidis
KTEQNFYMKGGVLVLKIMSKHSATLVIMFLITLLPIFQYQASAHATLEKSTPQQQGVIKDKPEAIKLEFNEPVNTKYSSVTLFDDKGKKIKDLKPITTGWSQTVVFSSEQIVNGTNTIEWHTVSADGHEVGDTFEFSVGKVRLKM

SEQ ID NO: 5153 - protein, 134 aa, Staphylococcus epidermidis
IMTKIHFEAPSPEDYCNLRANAGMSSKSIEAAIKGLPHACFNVTLYENDMLIGMGRVIGDGGTVFQIVDIAVKDIYQGLGHGMTIMHEIMKYIESVAEEGTYVSLIADYPADQLYEKFGFKSTEPYSKGMYIKY

SEQ ID NO: 5154 - protein, 66 aa, Staphylococcus epidermidis
TKYKCLPQSITQKTKINIQSYIFGVQHKSVIELTLLQIGGLNEYDKIVCHSCLYNSNMYCLCNLIT

SEQ ID NO: 5155 - protein, 61 aa, Staphylococcus epidermidis
MKYKTTFKIKPPFTPAKDLAIFSKIITKTLSKLLLKKLVNVLHQLDKLILTFITKLNLNKI

SEQ ID NO: 5156 - protein, 44 aa, Staphylococcus epidermidis
KRHKMHLLLHPMTFFSYLNIEINDNTSSIIMIDDLIDGFWDFIE

SEQ ID NO: 5157 - protein, 537 aa, Staphylococcus epidermidis
GEFNMLVESFNPFGNLLLSSLIAAIPIILFLLCLTVFKMKGIYAAITTLVVTLLIAIPFFKLPVGIASGAVVEGFFQGIFPIGYIVIMAVLLYKITLKSGQFATIQDSITSISQDQRIQLLLIGFSFNAFLEGAAGFGVPIAICALLLAQLGFRPLQAAMLCLVANAASGAFGAIGIPVGVVNTLNLPGHVEAMGVSQTSTLTLAIINFFIPFLLIFIVDGFKGIKETLPSILVVSVTYTVLQGLLTVFNGPELADIIPSLASMLALALFSKKFQPKNIFRVQKDVKPEAPKKLKGKEILFAWSPFIILTVIVMIWSAPSFKALFAPKGKLSALVANFDLPGTFSNISHKPITLSLNLIGQTGTAILITIIITVLMAKKVNFGDAGRLFVEAFKELWLPIITICFILAISKITTYGGLSNAMGQGISKAGSVFPILSPILGWIGVFMTGSVVNNNSLFAPIQASVAQQIGTSGSLLVASNTAGGVAAKLISPQSIAIATAAVKEVGKESELLKMTLRYSIGLLVFICIWTFILSFIL

SEQ ID NO: 5158 - protein, 40 aa, Staphylococcus epidermidis
NCVKILSLYYDSTAVLFVFLRESTKVTTTETTNAISIPIK

SEQ ID NO: 5159 - protein, 74 aa, Staphylococcus epidermidis
NNPNKLEELPLAPLLSSIAIENPNVAIPVTGATKITKPQESIQKVQWLSKVSDTIITPITCIVDMILSNSNLSI

SEQ ID NO: 5160 - protein, 58 aa, Staphylococcus epidermidis
IKPNYNRHKIKKINLVNLHLKEAFKCLKHYKTKDNSTLNLNIKRSIVEKDMVKRNAHG

SEQ ID NO: 5161 - protein, 51 aa, Staphylococcus epidermidis
RIIKIDWILSNIQNILLKGRSKLEKSVSVRKSIITFYCYFRFINSIWPIGY

SEQ ID NO: 5162 - protein, 214 aa, Staphylococcus epidermidis
RCVNKKYTNIFNNCVGLQFIYLNFLFDLGEYMKQRAKYKIIKSLIELLEYYPFDEITIKMICAYSGVNRSTFYDHFQDKYQLLDKIQNYHLNKYISLLQSFYNDFHHIKTDQKKLYKFFLLIAKYIKRKEAFYRATLVTYPNKDIALDYINATKTCYEKVMNRYETSINNKRMFIIYSVGGQAGVFIDWLRNGCIESPQEVAQVLLANTIKLQR

SEQ ID NO: 5163 - protein, 52 aa, Staphylococcus epidermidis
LVQNNLKACVNLTFSLIRYTPFHFVIKTSVLNQHIICYINKSLFLLKLILKV

SEQ ID NO: 5164 - protein, 186 aa, Staphylococcus epidermidis
MNKNDYLKELKKHLKHMNKEEKEDILNEYDTHFYSGQQEGKSESDVCKELGNPKLIGKELTATSSVENAHQKVSLMNISSAIVAVMGLSLLNFFIVIIPAFLCILLVLTFIIFTLASLAAPLMLLIKGIMDGFHSIILYDAFMTGLMFGVGLVLAVVTYYLIKWLFDVTMKYLKWNISIVKGSVQS

SEQ ID NO: 5165 - protein, 320 aa, Staphylococcus epidermidis
LIKNQGGYIMYQLAQSNLWTGRLDSETDPTQFRHFQTVKFGDLSQLDFSDEHKGVGLLGYAIDKGVELNKGRVGAKEGPNAIKRAFAGLPDLNQCEEIIDYGNVEHNHELLIDTQREFADLAAKSIKRHKQTFLLGGGHDIAYAQYLATRKVYPESSIGVINIDAHFDTRDEGYSTSGTSFRQILEEDDNADYLVLGISQGGNTQALFNYAKEKDIQFVYADELLHQVSPPIKDMIERFIHNHDTVMFTICMDVVDSAFAPGVSAPAVLGIYPHTVFELAKRVIPSEKVKSISIAEMNPTYDSDQRTAKLVANLVHHCLI

SEQ ID NO: 5166 - protein, 300 aa, Staphylococcus epidermidis
LMKNRMMNRVVNKYILHNRSIFFSNDDEVKHFLEKRSIENSKKHQQPATLNVKSNLDKLTLNDMQVFRFNFRHEKNQKILYLHGGYNTLQPSPFHWRLLDKLTLNTLHEVVLPIYPKSPDYHYLETFKAIRDVYNQLVEEVGANNIVMMGDGSGGGLALSFVQSLINDNQEVPRKLFLLSPLLDATLTNPNITKTLEENDILVSRFGVHQLMKSWTNDLPLSDARISPLYGTLKGLPPIYMYGGGREILSPDMHAFTHALEECGNDVEFKEYPKMVHDFPIYPIRQSHKVLKHITKSILE

SEQ ID NO: 5167 - protein, 205 aa, Staphylococcus epidermidis
LIVKKIKAETLSDMQNYKLLSGSIIPRPIAFVTTQNLKGDINAAPFSFFNVVNHTPPMIAIAVQRTKGNRKDTSINIEQSGEFVVHITDEAIVNDVNETAAPLEYGVNELKRTSLSMIDSDLIKVPAIKEAKVRFECKLHQIVQLGNKDNGSDLIIGEIVVYHIDEEVYFEDSKIDANQLNPVARLAGNDYSLLGQTFTVNRPTS

SEQ ID NO: 5168 - protein, 240 aa, Staphylococcus epidermidis
YYALFNILIEIQFNMIKRQSRRRFQMKKVLASATILSLMLVGCSNGGNDESSHKDDSSKTEQKDKSSSQHDSKKDSKRNDTNNKQDNQENNTNKEQTNNQNPNDGEQRTSERPTTNSNGNSSDNQNKQQQSVQDNQNKYVAPYQSENATRVARCLSPFEGDRSQALQQLPNFETALSIAKNEANMYGSENKSYNDYSIEQTEDGFRYVFSFKDPSKSNTYSIVTLNRQGQPTVVDPNFQP

SEQ ID NO: 5169 - protein, 359 aa, Staphylococcus epidermidis
HIKKWERISMNLAWKEIKFYKFRFILIMFIIFLMAIMVLFISGLAQGLARENISIFDQIKGNQFVVQKMKEPQLEKSILSRSKQDNISKIIDEKPFKMAGKTFKINGNEENVMAINSVKNHQPNLKSGHYPKNGNQIAINEKLTAEGLYLDDKVKVKGDDTTYKVVGILKNTMYSHSNIVMMDQSKIEQSSNVATFYVTNQLSKSDKNKINHIKGVQTATTDNITSNIASYKAEQTPLDMMIISLYIITAIVLSAFFYVMTIQKTSEIGILKAIGITTKHLLTSLILQISMITFIGVAIAEVVILLISQILPVSMPFHIDMHNIIIVLVIFMIVGLIGTSLSFIKLIKIDPIEAIGGGQ

SEQ ID NO: 5170 - protein, 61 aa, Staphylococcus epidermidis
TMNLIEFINDLAKNNIIICVMHMIIIIYSIFCHSSGYGKCLVHLFNLLSYNTILTEKSTYM

SEQ ID NO: 5171 - protein, 378 aa, Staphylococcus epidermidis
ERAERYMTNYSTYVDWRRTFHQYPELSDEEYETTEKLRKILKSYGIRILEVPLKTGLVAEIGQGEEMIAVRTDIDALPIEEQVKHEFTSKYQGAMHACGHDIHMASILATGIQLKEIEDELNGRVRLIFQPAEELGHGAFEIINTGVLKGAKAVLGFHNYPTLKVGEFAIKSGAITSAVDRFEFNVKGKGAHAAKPEQGNDPVIVVGQLINSLQTIVSRNLSAFDSAVVTIGEISCGNTWNVIADKAYIQGTVRSFDEDIRHYIENRMKNIADGLSRVFNVDIDLTYSRLPGAVVNDAHLTQEAIEVAKNVGYHVSMLDEPVTIGEDFSGYTEEYPGVFAFIGSDSKYDLHHPKYHPDERILEKVPQYFVQLVQRLLT

SEQ ID NO: 5172 - protein, 286 aa, Staphylococcus epidermidis
CDYEISKMEYLYCQRKCTIMKKIAAIIFLIGLSLIIICSVGVYAQNKKLSKDNQYNNQTTNLMKNYDDNTVKSIYIDGKVSDITVKKGKHFSVKSKGNDKNLNVTSKVNNQRWVITERQTSPHINFRIQGKVSNHITITVPKYIKNIDIKTNAGDLNIVGVNSGTGRFDAESGDIKVQKGRYKKVTLHNEDGDIHTKDIHFNQANIQNDNGDIQMKQLDPDIPLRIKNEEGDINLNYKKELHHTQIITRNEEGETDIDHRVLYNSKVENGNNKVKLINENGDIKVK

SEQ ID NO: 5173 - protein, 397 aa, Staphylococcus epidermidis
CYNDLNIIENNEVFYAMKSFTFFMHNIYAMGGTVKSVTQLANTLAEKGHPVTIISVFRGADSPYFELHSAIKVKVVVDYRLKLKNTRAITANRIKKYTPFLNTKVISQFEPGKSQFSSYVEKKMIKAIRHTKTDVLVGTRASFNILISKYAKAEIVTIAMEHMNFDAHPDQYQKEIIAAYRNINKITTLTVADQQKYQSQLKTPVYVIPNMVTEKRIAAPKKNRIISAGRLEYEKGYDLLLESIRLIQEDLRQLNYDVHIYGSGSKKTSLVDFINQYHLNDLIKIYEPTQELNNKLAQSKIVVVPSRNEGFGMIILEAMVQDNIVISFEGNVGPDSIINNGDNGYLVNYENVSELAKRIDLTTQHYNELDHIIENSKDTLKQFSPDHIYQLFMSMFK

SEQ ID NO: 5174 - protein, 46 aa, Staphylococcus epidermidis
MNAESSFILTILNESNIATNIANKRPPMTGAGIQIRLKIETWLIIV

SEQ ID NO: 5175 - protein, 460 aa, Staphylococcus epidermidis
EVKDIGWTKMFKTLYSRIAIYAITVILFSALMSFLFTNIYYHFHLKASNDAKIMRTLKEAREYERTQKPKPLDTYLKHLGQMNYQIMTVNEHGTKHFYGETFRKNTISQSAIKKVLNGEDYHGIKNKPYAFFVTGFFDNETDNTVGIQFKTDDGALAVFMRPDIGETFSEFRIFLAVLITLLLIISISLVIASTYSIIKPVTALKNATTRIMKGDFSTPIKQTRHDEIGTLQSRFNTMRQNLGQVDQMRQHFVQNVSHEVKTPLTHLQRLLTQLELTQNEEEKQLCINEMFEITNQVSELTKELLLLSELDNASHLTFNDNVHLNTLIKDIIRHEQFRTDEKDLVMFTELEDLYFRGNERLLHQAFNNLIINAMNYAPQNSMINITLTSTNHLIIFNIENDGSIAEEDAKHIFDRFYKLSDESSSNGLGLAITQSIIHLHHGSITLTSDDKTQFIVKLFI

SEQ ID NO: 5176 - protein, 40 aa, Staphylococcus epidermidis
LSSLLILVIPSLFFMLYDDRKIHVYSKPEFIKRHQVNKNQ

SEQ ID NO: 5177 - protein, 41 aa, Staphylococcus epidermidis
AGGLLYGIKIIFFTQLKDFVFMMGNSIHRMYISHFFWLGLI

SEQ ID NO: 5178 - protein, 292 aa, Staphylococcus epidermidis
IFSWKSEAKDVDTSSPFYEKSKFWFGLLRYVTEGANFLLIGLFWLNGIARKRGLRQFNVLPKQSGIAWIMAMSLLVSLVVYMMTLTSDILEDILSFKLEVIMQFPYILSSISLIILFILFILKDMEKIWYWLISIVMIAVISMSGHVWSQQVPLWSIIIRTIHLIGLTLWLGSLVYLICYAIKVKINQLTSVRRMLLKVNIIAVIMLVFTGILMAIDETNTLTLWNNVSAWSIYLVIKIAGIIAMMLLGFYQTMRALRQRQQVHRFALMTELLIGMILIFAGIMMSQINIPS

SEQ ID NO: 5179 - protein, 54 aa, Staphylococcus epidermidis
LKLCMLKILYVSTYVNNYLNDSYHCGTSYAAMYDCINADMFIHFNFNHGIVDSN

SEQ ID NO: 5180 - protein, 301 aa, Staphylococcus epidermidis
AIWWYPYLGAALGMILVHPGLMSAYDFPKAVEEGKAIPHWDVFGLHINEVGYQGQVLPMLVATYILATIEKWLRKVIPTVLDNLLTPLLSIFITAFITFLFVGPVTRQLGYWLSDGLTWLYEFGGAIGGLIFGLLYAPIVITGMHHIFIAVETTLIADATKTGGSFIFPIATMSNIAQGGAALAAFFIIKQNKKLKGVASAAGISALLGITEPAMFGVNLKLRYPFIGAVAGSGIGAAYISFFKVKAIALGTAGLPGFISINPTHAGWLHYLIGMLIAFVVSVVVTLVLSRRKTNKTAVES

SEQ ID NO: 5181 - protein, 40 aa, Staphylococcus epidermidis
QYVSETLLIKVEFKKSYIAIFKYKVFDMFSQKATPLWQTS

SEQ ID NO: 5182 - protein, 179 aa, Staphylococcus epidermidis
MGERIRSVQITEVEQLQLIAKRTFFTTFRESYSDEDFKQFFSDAYDIDVLRKELEQSNSFHYFYEVDQNIVGFLKLNINDAQTENKGHAYLEIQRIYFDEAFQGSGRGQLFINLAIDQAIKFGKSKIWLGVWEHNPKALSFYKNRGFRVTGSHQFYTGSVVDNDLIMELDLTTNYKQSL

SEQ ID NO: 5183 - protein, 229 aa, Staphylococcus epidermidis
SYWRWPIMGLVVKDISKTFGEKTSKTEVLKDINFEVKDGEFIILNGASGSGKTTLLTILGGLLSQTSGDVVYEGKSLFERHTNKAHLRLNDIGFIFQASHLVPYLKVLDQLTLIGKETGMSSKEAQARAKELLKKIGLEEQLNSYPHMLSGGQQQRVAIMRALMNHPKIVLADEPTASLDASRAQEVVEMIRKQIKANQMIGIMITHDESLFKYADRIVQLYDGKIKNS

SEQ ID NO: 5184 - protein, 54 aa, Staphylococcus epidermidis
ERLGGYFYKKDKLYIISIEFVFFTYPETLCLGIINKRDDSRIKRTLKSSLFNTW

SEQ ID NO: 5185 - protein, 476 aa, Staphylococcus epidermidis
EIEGRFMIKQINISNMDKLKEQMERALSDGYTHVIPYSNEIQIHQSMIKAITLPKTSFIVDYTINNYYLNDCKYFGLDFVDFEDWVKNINLYPNVIYEINSTLELIDKFEVENIFDLALLTILKGHIAVEGHVVLDFKGPLKTSKGFWRSFDRNDLTYRDKFFLNTIAYAHKQRIPFTRVPFNDHDSIRYYDSVLLSTKFKAPRWLVTPIKNYSVKKHKEISYIYKKDSSKLKNHVVFLGFDFGYRGNSKYLFNYFVKHNPMIESYFITDERTGPHFISTNDENVKNLIETATFVITESYIPDDIHPNGKIIQLWHGTPIKKLFLDSKEPHQNLNIYNYRARKYNKWTQQDYLIVDSEESKTYFESAFPSQKIDILPVGYPRNNYLLNRINDVGLHKRIFSEINIDPTKRVLLYAPTWKTNSSDDDIFPINEQLLTHYNVIYKGHVESKNDLVPEGVINPPNNIETQDLIIISDVV

SEQ ID NO: 5186 - protein, 41 aa, Staphylococcus epidermidis
YLFMEKTKIITTNTLSYRLALNLTKGIIICLKLCQNFKSLL

SEQ ID NO: 5187 - protein, 41 aa, Staphylococcus epidermidis
HYVIVLDYLYLSVSGHLSCHSFCKSKFIEMYFSYTKPEMKL

SEQ ID NO: 5188 - protein, 60 aa, Staphylococcus epidermidis
KFYMLAPTLIIISMIHITVELHMQRCTIVSTLTCLFISTLITVSLIQIKRLKKDNNLNQI

SEQ ID NO: 5189 - protein, 46 aa, Staphylococcus epidermidis
CLSIVYMNVSVYKNDNYIFESSYIQFIYVNCRNLWNITRKSVTICK

SEQ ID NO: 5190 - protein, 43 aa, Staphylococcus epidermidis
IPFILNTVRHSKNKMIGIAAIKDDNSKLPNGLKDSTNILNSPH

SEQ ID NO: 5191 - protein, 62 aa, Staphylococcus epidermidis
KPSIIPLMSNINGAASEARVKMMKVNTSKMHKKAGIITIKKLSKLSPITATIADEIFINDTF

SEQ ID NO: 5192 - protein, 114 aa, Staphylococcus epidermidis
KGNITKITWTATDKGIGPHEFIEFPIVVANPKKEGTFKWNTTQTYDNGDVVKWTGKEDSAHPAPTTTVKKGANPNDTHSDSSQGDSIALWIVAIVAIVISLIALFKQAHPKKFN

SEQ ID NO: 5193 - protein, 352 aa, Staphylococcus epidermidis
GVLMSDSQREQRKNEHVEIAMSQKDALVSDFDKVRFVHHSIPSIDVSQVDMTSHTTKFDLAYPIYINAMTGGSDWTKQINEKLAIVARETGIAMAVGSTHAALRNPNMIETFSIVRKTNPKGTIFSNVGADVPVDKALQAVELLDAQALQIHVNSPQELVMPEGNREFASWMSNIESIVKRVDVPVIIKEVGFGMSKETLQALYDIGVNYVDVSGRGGTNFVDIENERRSNKDMNYLSQWGQSTVESLLESTEFQDRLNIFASGGLRTPLDAVKCLALGAKAIGMSRPFLNQVEQSGITNTVDYVESFIQHMKKIMTMLDAPNIERLRQADIVMSPELISWINQRGLHLNRK

SEQ ID NO: 5194 - protein, 40 aa, Staphylococcus epidermidis
TNLIIYINCVTQKNKSQHYENSFITQFKLQLFTCYPLYTN

SEQ ID NO: 5195 - protein, 133 aa, Staphylococcus epidermidis
RRIIMSIKEKLVIELMNLKDTVKYELSELNEQQYLFMNGPAPQLMKRAMKMSYILGQKEAIDHFLLLIDTCHENVLLDNCQDYQKQIQHKQFSLQEDIIHQINQSKEFESFLSTYYVNKGKYDITSKIKTLLE

SEQ ID NO: 5196 - protein, 548 aa, Staphylococcus epidermidis
FITITLYIGGIHMSYSIGIDFGTASGRVILADTSNGHIISRYEEDYANGTYMNSLYDKPLPENYFLQNADDYLQILEQGVQFVLEDSKVNKNDVVGIGVDFTSSTIIFLDEQFEPLHRHEDLKTNPHAYVKLWKHHGAQDEANYMIQMSKNKNWLDYYGSSVNSEWMIPKILEVKHEAPEILRRARYIMEAGDYITSILTNSNIRSNCGIGFKGFWDNEAGFNYDFFHSVDPDLPKIVKEKCEAPIISIGESAGRLCKDYQQIWGLSQDVQVSPFIIDAHSGVLGVGAIEAGEFTAVIGTSTCHLMLDSRQVPISSITGSVKNAIIPGLYAYEAGQPAVGDLFEYSKNQAPKHIVDQANEHHMPVLNYLEELASHIRIEEQHVVVLDWLNGNRSILSNSHLTGSIFGLTLQTPYEMIHRAYIEATAFGTKLIMKQFEDNHIPVHTVYASGGIPQKSKLLVEIYANVLNKRVVVIDSSNASALGAAMLGANVGNAYSTLKEAALSMKQPIAYIQEPEIQKVQAYKPLYHKYCELHDLLGRQYPELSYLI

SEQ ID NO: 5197 - protein, 154 aa, Staphylococcus epidermidis
EIKMVRRIEDHISFLEKFINDVNTLTAKLLKDLQTEYGISAEQSHVLNMLSIEALTVGQITEKQGVNKAAVSRRVKKLLNAELVKLEKPDSNTDQRLKIIKLSNKGKKYIKERKAIMSHIASDMTSDFDSKEIEKVRQVLEIIDYRIQSYTSKL

SEQ ID NO: 5198 - protein, 48 aa, Staphylococcus epidermidis
VCMMFSTFVVLSLRKIYTNQHAIVKLIYLSPTSHTIYLTGNITCIIRG

SEQ ID NO: 5199 - protein, 231 aa, Staphylococcus epidermidis
KVVIYMIKVNAISIGKIETLSYGNYKPMQSALNKIPFKGQMWLNRLGFVDDEQAYHNHGGIHKAICCFSKSNYQLFKDDLDQLPEFAMFGENLTVEHLDEADVYFGNQYQLGDTIIEVSDIREPCWKIQAKYAIPNLVQKMSQSGKTGFYFRVIKEGYVHQSDNLKLIKKAESNTRLSVKDLNHLFYNERNNLRLIYHALRNPYLSPDRKKKLQKMKTRAENRKFIKSDDK

SEQ ID NO: 5200 - protein, 471 aa, Staphylococcus epidermidis
CSEMSRGDKMSQCPNCGHQVKDDTSQCPNCGQLLTKKKKRKIKDQSSQSSNENSTNIRLRKIVPIGISVFILILIIVLFFLLRNYNSPNAQAKILVNAVDNNDSQKVATLLSTKNKKVDDVEAQQYINYVKKEVGIKKYIQDINNTVDKLNKSNSSVASYIQTKSGQDVLKISKNGTKYLIFDNMSFTAPTKKPIIKPKVETKYEFRTSGKKKTVIAEANKNTPLGEFIPGTYHLPAKKITENGTFNGHLNFDFRESHSETVDVAEDYDQSFINIKFKGANKLSDKSEKVQINDRTFTYSHSKEFGPYPKTKDITISATGKAKGKTFSSETKTISADDLKDNTKVTLEFDSDKINSYVEKKEKEENSLKNKLTEFFTGYATAMNSAFNMNDFNFISSYFKKNSSIYTSMKSNFQNRTNVTMISPQVLSVHRNGHTVRTTIQHIDHIGNYINKDYELEIDNDDSNMQLVKEL

SEQ ID NO: 5201 - protein, 57 aa, Staphylococcus epidermidis
TLFLKPTPLLSYKNFAPFFILDIITHLNNNYSNFFELDTNIKIEILSSKLNTSIYKS

SEQ ID NO: 5202 - protein, 408 aa, Staphylococcus epidermidis
KGGVSLKRVYQSENQSLLFIVILGSLTAFGPLAIDMFLPGLPNISHDFDISASTTQLTISFFMIGLALGNFLAGPISDITGRKKPLIFSLIIFTIASLGIIFVTNIWIMIILRFIQGLTGGAGAVISRAIASDMYSGNALTKFLSLLMLVNGIAPIIAPALGGIILNYGPWRIVFVILTMFGIVMLIGTLFKVPESLEKSLRESSNIGTMLINFKELFKTPRFVLPMLIQGVSFVLLFTYISASPFIVQTIYGLTPLNFSIMFAFIGVTLIISSQLTGKLVDYIDRLLLLRIMSTIQVIGVIIVSLTLLNHWTFWILSCGFVILVAPVTGIATLGFSIAMDESKGAKGSSSSLLGLFQTLLGGVISPLVGIKGDSNAIPYIIVIVITAIILMVLQLINVKIFKKAKIH

SEQ ID NO: 5203 - protein, 208 aa, Staphylococcus epidermidis
KREVIYLDFINQQTTQTAKALLGVKIIYQDDYQTYTGYIVETEAYLGIQDKAAHGFGGKITPKVTSLYKKGGTIYAHVMHTHLLINFVTRTEGIPEGVLIRAIEPDEGIGAMNVNRGKSGYELTNGPGKWTKAFNIPRSIDGSTLNDCKLSIDTNHRKYPKTIIESGRIGIPNKGEWTNKPLRFTVKGNPYVSRMRKSDFQNPDDTWK

SEQ ID NO: 5204 - protein, 54 aa, Staphylococcus epidermidis
NLLFNYCCPFADIIINKKLKKIVYSIESLLAYKIRKPRTLIFVLGAYYHKQILY

SEQ ID NO: 5205 - protein, 320 aa, Staphylococcus epidermidis
KELLIMITAYKHALHHPSQIIETEINHSASWINVVEPDREEIEGLMEFYNIPEDFIRDPLDSEESARIEYDEDTGYSLIIIDLPIVNSTNRRVLSFVTIPLGIIIGNGIVMTVCDAENEFLENFAKQEDINLKFHSRFALEILTTIANHYNRNLRLLNKSRIRIERELKNNITNKQLFKLMEVEKSLVYFLAALKGNDTIIKKLFRLPAIKRFEEDEELLEDLVIENNQAIETTELHQRILESITSSYASLLSNDMNNIMKTLTLFTVLLTLPTLVFSFFGMNVPLPIDDHSYVSWIIVVGISLILVAIVSIFLWKKQKL

SEQ ID NO: 5206 - protein, 219 aa, Staphylococcus epidermidis
EGIFMKKMILINVITIIVLVVIGVLGFWFWHNTTSYVTTDNAKVDGDQIKISSPASGQIKSLNVKQGDKLDKGDKVAEVLAQGQDGQSKDMNIKMPQKGTIVKTDGIEGSMTQAGNPIAYAYNLDDLYITANVDEKDISDVEKGNDVDVDIDGQKASIKGKVEEVGQATAASFSLMPSSNSDGNYTKVSQVVPVKISLDSNPSKNVVPGMNAEVKIHKN

SEQ ID NO: 5207 - protein, 410 aa, Staphylococcus epidermidis
VLVLFSGDFTTMPLNVAITITVIVALLMNRKETFAKKVEVFTKGAGHSNIILMMLIFILAGAFSTTAEKMGGVSSTVNLGLSLIPQNLIIVGLFIICMFVSISMGTSVGTVAAIAPVGFGFAQATDVPAALAMATVVGGAMFGDNLSMISDTTIAAVRTQKTKMSDKFKVNFKIVLPGAIITIIILFFLTNGISIDHTKNYDYNLIKVIPYLLVLILALVGINVIIVLIGGTVLAGIIGLIDGSFGWNGLLNAISKGIIGMEDIAMIALLIGGLVGIIQHNGGIDWLLNFVRSKVKSKRGAELGIASLVSAADISTANNTISIIMAGPLAKNIADEYDVDPRKSASILDIFGGCFQGLLPYSPQVISAAGVAGISPFLMLQYSIYPILLGVCGLVAIILRVPRLNQSSKK

SEQ ID NO: 5208 - protein, 142 aa, Staphylococcus epidermidis
GGFFMRRLLYSFLFYMVIGLLSGFYYRELTKAHDFVGDTQLSLVHTHTLILGMFMFLLLLPLEKVFKLSSYYLFNWFFFVYHLGVLITISMMTVKGTFQVIGKKFSPEMFAGFAGIGHTGMLAGLLLLFFLLRQAILTEPKK

SEQ ID NO: 5209 - protein, 94 aa, Staphylococcus epidermidis
CKTLTNFLSKSLLSVLVIIFEKIARSLAGVKGGFILKVVLYFIYFFVAFFVVDSLISLVFPIEFDVYTNLITAFIFAVFMTPLLFVLKQDKNKK

SEQ ID NO: 5210 - protein, 40 aa, Staphylococcus epidermidis
LFKFKIECIVLSLSIFYCYSKLFDTQLKNKIQMVCIKESL

SEQ ID NO: 5211 - protein, 55 aa, Staphylococcus epidermidis
HIKFLAYTISIMFFDMKQQIDIAKLILSLNSLVFIDLMTFNKFRFAINMYFSIII

SEQ ID NO: 5212 - protein, 41 aa, Staphylococcus epidermidis
HAISHSVINCQHVKMPETSTNITGILKLNISKIIKFLHDDF

SEQ ID NO: 5213 - protein, 43 aa, Staphylococcus epidermidis
VIELCLTLQDICNNVNTYYFKYFNNSLHIFNNSKVFFENSHTY

SEQ ID NO: 5214 - protein, 402 aa, Staphylococcus epidermidis
MIEFDAITTLCLACVLYLIGQTIINHVSILRRICIPAPVIGGLLFAILVAILDSFNIVKIKLDSAFIQNFFMLAFFTTIGLGASLKLFKIGGKVMLIYFTFCGIMAICQNIIGVSLAKLLNIKPLLGLTAGSMSMEGGHGNAAAYGKTLQDMGVDSAVAAALAAATLGLVFGGLIGGPIVKYLIKRYDLKPEHRDDSFKNYGVVEYNQSLHTKYKPIQVFFIQFSILVFCMALGTYIGNTFTDLTGVNIPMYVGSMFVAVIIRNATDFIGWDIVDLKMSEQIGDISLGIFLSLALMSIQLTQIYSLAIPLIIIVLVQVVFMVLFSIFILFKGLGKDYDAAVMVGGFIGHGLGATPNAMANLDVITKKFGNSPKAYLVVPIVGAFLIDLIGVIIVMSFIQLFS

SEQ ID NO: 5215 - protein, 62 aa, Staphylococcus epidermidis
TVHSYIYLLSRINSIKLYTVVIQINYSIHYYTLQGTEFNLLIHTSLFKLHHLLLTNYKNQYF

SEQ ID NO: 5216 - protein, 42 aa, Staphylococcus epidermidis
APISNNIDFKKLFSSNHFKNKNHIFALSQYILNNHDYFVLGI

SEQ ID NO: 5217 - protein, 47 aa, Staphylococcus epidermidis
IILSLLILSCVNKKRQKKHTLKKFLCLNLINLYSFYINCILPHTTKI

SEQ ID NO: 5218 - protein, 362 aa, Staphylococcus epidermidis
DITSMEGGYKLNITKAIVVAIYIIVGAALGVIIIPEVVTDLGIHHHAVITNYYVDGFIGIIIFFIIFGLFINKVTYTFKQFEQLIMRRSAVEILFATIGLIIGLFISVMVSFILEMIGNSILNHFVPMIITIILCYLGFQFGLKKRDEMLMFLPENMARSMSNNIRRATPKIVDTSAIIDGRILDIIRCGFIDGDILIPQGVINELQVIADAKDSVKREKGQRGLDILNQLYDLDYPTRVIHPTQSHSDIDTLLIKLAQQYHAHVITTDFNLNKVCHVQGITALNVNDLSEAIKPNVHQGDQLSILLTKIGKEPGQGVGYLDDGTMVVVDNAKSYIGQQVNLEVVSLLQTSSGRIVFAKFVD

SEQ ID NO: 5219 - protein, 68 aa, Staphylococcus epidermidis
IQTSSWLNIRKVIAQRAENHQKNYKKDNSYIISIEIVFIYLFWNFLFQAFHIYIDIDLIIITMFVGIK

SEQ ID NO: 5220 - protein, 331 aa, Staphylococcus epidermidis
EVKSLVKSGKARAHTNIALIKYWGKADETYIIPMNNSLSVTLDRFYTETKVTFDPDFTEDCLILNGNEVNAKEKEKIQNYMNIVRDLAGNRLHARIESENYVPTAAGLASSASAYAALAAACNEALSLNLSDTDLSRLARRGSGSASRSIFGGFAEWEKGHDDLTSYAHGINSNGWEKDLSMIFVVINNQSKKVSSRSGMSLTRDTSRFYQYWLDHVDEDLNEAKEAVKNQDFQRLGEVIEANGLRMHATNLGAQPPFTYLVQESYDAMAIVEQCRKANLPCYFTMDAGPNVKVLVEKKNKQAVMEQFLKVFDESKIIASDIISSGVEIIK

SEQ ID NO: 5221 - protein, 90 aa, Staphylococcus epidermidis
THKSLRRIQYMTKNTLNDLNNHLFAQLERLSDEELKGEELQEELNRSKAVSDVAKNIVSNGNLILQAHKFKDEQMNADAKLPKMLENKEK

SEQ ID NO: 5222 - protein, 413 aa, Staphylococcus epidermidis
VKFLASQLFKGGFFIDYLGVDISKRSSVVAHYKNEKFQKEFFIQNNKNGYNYLLKYLNDLDHPQLIFESTGIYSRSMERFCCVNQINYIQMNPLEAKFKTSALRSWKTDQADAHKLACLGPTLKQTDNLPIHELIFFELRERVRFHLEIENEQNRLKFQILELLHQTFPGLERLFSSRYSIIALNIAEIFTHPDMVLDIDKEVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGGIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 5223 - protein, 43 aa, Staphylococcus epidermidis
RHTFPPILYIPKNIYFLFLILLDETMLIIHMFVKMISSLKLNP

SEQ ID NO: 5224 - protein, 141 aa, Staphylococcus epidermidis
GGTLSKYNSKKVEYKGVVFDSKIECDFYQHLERNLGNEYDHIELQPRYELIPKFDNQRKTEYIADFALWKNNKLLEVIDVKGMPTEVAKLKAKIFRYQNREVPLTWICKAPKYTGQEWITYEELIKVRRKRKKEKMKDGKD

SEQ ID NO: 5225 - protein, 41 aa, Staphylococcus epidermidis
TIHPQAPTKPQAKYNFLGASNMTQKKSEARKLNIKLNIQNI

SEQ ID NO: 5226 - protein, 44 aa, Staphylococcus epidermidis
SNYPECVPLYGLPINGSCLGHRHIYSTYSVNTGRRKNTWQETFL

SEQ ID NO: 5227 - protein, 331 aa, Staphylococcus epidermidis
FGVLYMCTAISLYTKQRYHYLARTMDFAFEFNGIPTIVPRHYHYQFDLDSDMRLEYGFVGTNLKVGRYRFGDGINEKGLAISNHYFTGEASYSTHKRYGYFNLAPEEFIVWVLGFNKSISELKQKVKKINIMNEKNTTLNIVPPLHFMVTDETGHTVAIEPHNGLLIVKDNYVHTLTNEPKLDWHLSNLRNYAFLTPQKSTNQLIGKVLVRSMGCEAGTNGLPGGYTSTDRFIRATYLRHQLRCSHNEDENLMNCFKVLESVSIPQGAVIDANKIHYTQYQLVMESKERSYYIKPYFSNQIFKIKLTEDLLSKNEMTFLPINHELKITSIQ

SEQ ID NO: 5228 - protein, 42 aa, Staphylococcus epidermidis
HTLPIETSVLIPANDISRYVHDIVETIHDTEFDEFRHPRGLI

SEQ ID NO: 5229 - protein, 47 aa, Staphylococcus epidermidis
NEPPGCVGLKNEERRTYSMPTINQLVRKPRKKQNETIRFTSFKQRFQ

SEQ ID NO: 5230 - protein, 405 aa, Staphylococcus epidermidis
AGEPAFLHKKWYTYHKVINMKIINNNFTFHKGKNWINLSGLPRKKTKRGEQIIWKNSIGYNVNYFFEGISGDIKILDSYRKNDERYLKVEVKNETYEIRSSNFKNCEIKKIVTDGYKHNLGFIINGCKVIGKRLNPRSKEREYKMLCLNTNLTFYRRESRIDVGAPSPYISGKYVYEGNWLYNEKNVLPFLKDVNDAKKYTKFSRREINCVCPNCKTEKTTPVNNLVQQGFFCHVCSTNISYPEKLMIALLNENSVVFEYQKIFQDLKPKRFDFYLPEYNLVIETHGKQHYKENEIWYRKSKESDVVKMSYCKKKNIKYVEVDCSLSDYNFIMNNINKTELKHVLKLYDKENIIKRIKELEQIKDVDEIIKLYKNGRNLTYISRNVGLTKWKIEGLLKRLGYIAR

SEQ ID NO: 5231 - protein, 226 aa, Staphylococcus epidermidis
RRLPIMTDERHVLVIFPHPDDETFSSAGTIASYIEKGIPVTYACLTLGQMGRNLGNPPFATRESLPFIRERELEEACKAIGITDLRKMGLRDKTVEFEPYDQMDQMIQSLIDETNPSLIISFYPKFAVHPDHEATAEAVVRTVGRMHESDRPRLTLVAFSNDASEILGEPDIQNDISQYSDIKLKAFEAHASQTGPFLKQLASPEIDGQAQSFLKIEPFWTYHFES

SEQ ID NO: 5232 - protein, 41 aa, Staphylococcus epidermidis
IKMPINEFMKIHLLAILLGIMSQRLFSFLSIHNKYCIHIKS

SEQ ID NO: 5233 - protein, 277 aa, Staphylococcus epidermidis
MMALKKVLTIAGSDTSAGAGMQADLKTFQELDVYGMVALTSIVTMDKETWSHDVTPIDMNVFEKQLETAISIGPDAIKTGMLGTQDIIKRAGDVFVESGADYFVVDPVMVCKGEDEVLNPGNTEAMIQYLLPKATVVTPNLFEAGQLSGLGKLTSIEDMKKAAQVIYDKGTPHVIIKGGKALDQDKSYDLYYDGQQFYQLTTDMFQQSYNHGAGCTFAAATTAYLANGKSPKEAIIAAKAFVASAIKNGWKMNDFVGPVDHGAYNRIEQINVEVTEV

SEQ ID NO: 5234 - protein, 200 aa, Staphylococcus epidermidis
FQLTRKVRYMNLNKQQHEYTALCLSQTENKSSEELFESLIEELKPLIYNKIRYISHNKYDIEDMYQEIVIKFYRALQKFDYQQGVPIEHYIYFLIRSVKYDYLRKVKANYKRQPLLVNEYIVEYNATLALNDIERSIIRKELTLAFKRSEVKLSRMERRIIRLLLNDYKPKEIAMVLNLESKVVYNAIQRSKCKLKRSFE

SEQ ID NO: 5235 - protein, 50 aa, Staphylococcus epidermidis
QTELRRRLRQTLLNRSYYCEGVKLNSVSLLLFYIALIVLNVSNNLFTLFL

SEQ ID NO: 5236 - protein, 91 aa, Staphylococcus epidermidis
SKYTEVVKLRHKLLKTANDLNKLILHSDEKVKAEFHTFDNGEVGITFWHYSQKYESDCNHLNFYEFFTDKELQRSFELAKDVIAGECLIDE

SEQ ID NO: 5237 - protein, 112 aa, Staphylococcus epidermidis
SADTMLTKLLTTSGNDVEYTINPQAIIKGNTSFLLKPKFLIIAKAIGVKIKVAPSLAKNAAIIAPNIMINTNIFNPCPCDALTICMADHSKNPISSRINEIRITATKVSVAF

SEQ ID NO: 5238 - protein, 40 aa, Staphylococcus epidermidis
KYNTNHNTSLKINKKKSSIKFLLLTVIIEDKVYVKVFKNM

SEQ ID NO: 5239 - protein, 58 aa, Staphylococcus epidermidis
TKLTGCLMYKEYNMTQHTLPIETSVLIPTNNISRHVNDIVETIPDTEFDEFRHHRGLI

SEQ ID NO: 5240 - protein, 56 aa, Staphylococcus epidermidis
PNVTACSPIRIIFPVDSPYPCLVMFSHLYIPSLKYHFIRCTDDVRMIDLLFYVILI

SEQ ID NO: 5241 - protein, 48 aa, Staphylococcus epidermidis
VLSTSLFNFNLSDSTCQFKIDLFILNRRCLNGQEKSNIRMYGMWLSIS

SEQ ID NO: 5242 - protein, 173 aa, Staphylococcus epidermidis
GIPTHMKKNHDYMRLAINEAHKAKALGEVPIGAVIVKEDQVIARAHNLRETLQQPTAHAEHIAIERASEVVGSWRLEECTLYVTLEPCVMCAGTIIMSRIPKVVYGATDPKGGCSGSLMNLLEQPQFNHRAIVEKGILEEECAELLRSFFKEIREKKKAEKQGKIQKDINLLK

SEQ ID NO: 5243 - protein, 175 aa, Staphylococcus epidermidis
RMATCARLCRLYKKQTQIKGVFMGLYEKMLIEHDYIEVRETDVMPNDLHGLWLGDLILIKRNLSEIRKAEVLYEELAHHKLTYGNILDQSKFNNRKFENYARRYGYETALPLRIIVEAHNYGVSNLYELAEYVQLSEEYISEILKHYKNKYGIGTNYGEYLITFDPLRVFKYKEI

SEQ ID NO: 5244 - protein, 84 aa, Staphylococcus epidermidis
YSKTTLFSFNKAIINFSGYDMLVEHTWQKKPCWTKLLTGVVFSVLQLGQTQFISLLENFVYFFASLTSFKKGKTFFSLYNQFPS

SEQ ID NO: 5245 - protein, 308 aa, Staphylococcus epidermidis
ENMTRQGYGESTGKIILMGEHAVTFGQPAIAIPFNAGKIKVLIESLDEGNYSSITSDVYDGMLYDAPEHLKSIINRFVEKSGVKEPLSVKIQTNLPPSRGLGSSAAVAVAFVRASYDFMDQPLDDKTLIKEANWAEQIAHGKPSGIDTQTIVSNKPVWFKQGQAETLKSLKLNGYMVVIDTGVKGSTKQAVEDVHVLCESDEYMKYIEHIGTLVHSASESIEQHDFHHLADIFNACQEDLRHLTVSHDKIEKLLQIGKEHGAIAGKLTGGGRGGSMLLLAENLKTAKTIVAAVEKAGAAHTWIEHLGG

SEQ ID NO: 5246 - protein, 69 aa, Staphylococcus epidermidis
PQMTLGNRIKQHRQDKGLNMREFGEFIDNASDSIVSRWERNISVPNAKRLKLIADDMNITVTELLKGVK

SEQ ID NO: 5247 - protein, 146 aa, Staphylococcus epidermidis
YTMTKLNLKQQAFVDEYIKTGTAYQSAIRAGYSEKYAKSSSHKLLENVGIKAEIDKRMEKLKKDSIADQDEILQYLTSVLRGEVTDQELIPIQVGRGEMEVEELEKRSDTNARTKAAELLGKRYMMWTDKQQIETTAMVHFDDDIN

SEQ ID NO: 5248 - protein, 67 aa, Staphylococcus epidermidis
PPTAFVPNAIGKTLTSDLPNRTCFTIKSHLLYLKYLNILYPNHNLFIHVNYLLEASILTLKSLYALM

SEQ ID NO: 5249 - protein, 248 aa, Staphylococcus epidermidis
YTYAYGCTAFCYSGKETTSCLGFEYGGLINTLEAARRYQLKYFTPSSIGAFGISTPKVNTPQLTIQQPTTMYGINKVTGELLCQYYYVKFGVDTRSVRFPGLISHVKEPGGGITDYAVDMYFKAVRKGHYTSYINRYTYMDMMYMEDAIDAIIKLMEEDSVKLKTRNGYNLSAMSIEPEMLKQAIQVYYPDFTLDYDIDLERQDIALSWPDSIDTSCAQEEWGFDPKYDLPTMTKVMLEAIEKKQKEC

SEQ ID NO: 5250 - protein, 42 aa, Staphylococcus epidermidis
TGSASKSARNAIVGPFESDPLKVAFIPLRPTGVSMVHANWLN

SEQ ID NO: 5251 - protein, 118 aa, Staphylococcus epidermidis
MEIAKMRVKNKYFSITPNVVEKMKEADINPDILRQRLASGWKFEDAIEAPLGVRRSEWDSLKPKEDGIASYKERMAQRRLQELKRKKPHLFTVPQKHPRSEWCTYLMENDIFPRKVAK

SEQ ID NO: 5252 - protein, 105 aa, Staphylococcus epidermidis
VMNAQDVKILNNLSLDDTSNDETIELLIEKYLNVAEEYCNQTFNRQSLPSNVEKFIANCIKQGTTSNISSRTMGTVSYTFVTDLPKETYGYLKPFRRLRWTGYHV

SEQ ID NO: 5253 - protein, 81 aa, Staphylococcus epidermidis
SSLAPVSGNLSFVFLSELLSNPESLSESESLSESESLSESESLSESESLSESESLSESESLSESESSLSESESLSESESSS

SEQ ID NO: 5254 - protein, 176 aa, Staphylococcus epidermidis
IMKAIPKIFDKEKGQWIELMAKPIAEEVVKIMKEDWLSNKKTIDYWLLQYTEGVVEPIQVAIFTDGNEVDEILKSNLEWMFNGYVSNLENKKLFNLQDFINYCYSTKTELPKQFKVNAIVKFDSLDEPIKLQEIDNITTNPDVLGILDETSEGSIEVKYIYNDHSIEDKKLIKENK

SEQ ID NO: 5255 - protein, 342 aa, Staphylococcus epidermidis
KVRARCLMMSNIHTNISEWMKMSEETPVIISSRIRLARNLENHVHPLMFPSEQEGYRVINEVQDALSNLTLNRLDTMDQQSKMKLVAKHLVSPELVKQPASAVMLNDDESVSVMINEEDHIRIQALGTDLSLKDLYQRASKIDDELDKALDISYDEHLGYLTTCPTNIGTGMRASVMLHLPGLSIMKRMNRIAQTINRFGFTIRGIYGEGSQVYGHIYQVSNQLTLGKTEEDIIDNLTEVVNQIINEEKQIRERLDKHNSVETLDRVYRSLGVLQNSRIISMEEASYRLSEVKLGIDLNYILLENFKFNELMVAIQSPFLIDDDDNRTVNEKRADLLREHIK

SEQ ID NO: 5256 - protein, 1185 aa, Staphylococcus epidermidis
ICLAGQVVQYGRHRKRRNYARISEVLELPNLIEIQTKSYDWFLKEGLLEMFRDISPIEDFTGNLSLEFVDYRLGEPKYDLEESKNRDATYAAPLRVKVRLIIKETGEVKEQEVFMGDFPLMTDTGTFVINGAERVIVSQLVRSPSVYFNEKIDKNGRENYDATIIPNRGAWLEYETDAKDVVYVRIDRTRKLPLTVLLRALGFSTDQEIVDLLGDSEYLRNTLEKDGTENTEQALLEIYERLRPGEPPTVENAKSLLYSRFFDPKRYDLASVGRYKANKKLHLKHRLFNQKLAEPIVNSETGEIVVDEGTVLDRRKLDEIMDVLETNANSEVFELEGSVIDEPVEIQSIKVYVPNDEEGRTTTVIGNALPDSEVKCITPADIVASMSYFFNLLNGIGYTDDIDHLGNRRLRSVGELLQNQFRIGLSRMERVVRERMSIQDTDSITPQQLINIRPVIASIKEFFGSSQLSQFMDQANPLAELTHKRRLSALGPGGLTRERAQMEVRDVHYSHYGRMCPIETPEGPNIGLINSLSSYARVNEFGFIETPYRKVDLDTNSITDQIDYLTADEEDSYVVAQANSRLDENGRFLDDEVVCRFRGNNTVMAKEKMDYMDVSPKQVVSAATACIPFLENDDSNRALMGANMQRQAVPLMIPEAPFVGTGMEHVAARDSGAAITAKHRGRVEHVESNEILVRRLVEENGTEHEGELDRYPLAKFKRSNSGTCYNQRPIVSIGDVVEYNEILADGPSMELGEMALGRNVVVGFMTWDGYNYEDAVIMSERLVKDDVYTSIHIEEYESEARDTKLGPEEITRDIPNVSESALKNLDDRGIVYVGAEVKDGDILVGKVTPKGVTELTAEERLLHAIFGEKAREVRDTSLRVPHGAGGIVLDVKVFNREEGDDTLSPGVNQLVRVYIVQKRKIHVGDKMCGRHGNKGVISKIVPEEDMPYLPDGRPIDIMLNPLGVPSRMNIGQVLELHLGMAAKNLGIHVASPVFDGANDDDVWSTIEEAGMARDGKTVLYDGRTGEPFDNRISVGVMYMLKLAHMVDDKLHARSTGPYSLVTQQPLGGKAQFGGQRFGEMEVWALEAYGAAYTLQEILTYKSDDTVGRVKTYESIVKGENISRPSVPESFRVLMKELQSLGLDVKVMDEHDNEIEMADVDDEDAAERKVDLQQKSAPESQKETTD

SEQ ID NO: 5257 - protein, 61 aa, Staphylococcus epidermidis
LSQAFYLLAIDNRVELGLISIFNSSPHYQVRQRITYAFYLTLLNLIFNVIIVVTQYAKLKL

SEQ ID NO: 5258 - protein, 173 aa, Staphylococcus epidermidis
MDFLQQNWTNILKIIVSLISIVTFIRVFLYERSRLKVNIIGYDQIEEYLDVYISFSNSSKLPISINEIQIFHKNTMIGEIENFTEKILGQTDGKSIVYSNPMPLNLNSYSSDKDLFRIKLVEELPLNKTLTFKFITTRKNITYKIKDFKLPQYRRSFHRKLKHHKKVSNKNKD

SEQ ID NO: 5259 - protein, 291 aa, Staphylococcus epidermidis
LIYYYSCSSFTIMDLATKYFNQINWRYVDHSSGLEPMQSFAFDDTFSESVGKDLSCNVVRTWIHQHTVILGIHDSRLPFLSDGIRFLTDEQGYNAIVRNSGGLGVVLDQGILNISLIFKGQTETTIDEAFTVMYLLINKMFEDEDVSIDTKEIEQSYCPGKFDLSINDKKFAGISQRRVRGGIAVQIYLCIEGSGSERALMMQQFYQRALKGETTKFHYPDIDPSCMASLETLLNREIKVQDVMFLLLYALKDLGANLNMDPITEDEWTRYEGYYDKMLERNAKMNEKLDF

SEQ ID NO: 5260 - protein, 256 aa, Staphylococcus epidermidis
HEYYCNRVTERSEIMAVFRVYKETGNFVTVHKNFIHDDNLSWKAKGILLYLLSRPDDWQIYESELVRHSTDGLSGLKTGIKELEKVGYIQRTRKRDDKGRLKEYEYAVYEKPNHIRFSNVGKTYIGKTYVGESHTTNNNSTNNDLTNNKNTNNVTDETSKSFQYISNNLEIIQSPLKAQQLEEAIKDFKDNKLEIVTVATDYCKENNKGINYLIKVLENWSKDGVDTKEKAISKVKPRNNKEDNYLAKKKQELLGG

SEQ ID NO: 5261 - protein, 274 aa, Staphylococcus epidermidis
NLYYNYNNDLFLILKKFGDEMNKDTIETSREALIKDVVMIAARILLESGAEGTRVEDTMARIATKLGYPESNSFVTNTVIEFVLHNEAYPRLYRIKTRDTNLIKISQANEISRQITNGTMTLEEAKYQLEEIYVAKRDSSLPFKGIAAAIIATSFLYLQGGRLVDIITAVLAGTIGYLVVEILDRKLHAQFIPEFIGSLVIGIISVIGHAFVPSGDLATIIIAAVMPIVPGVLITNAIQDLFGGHMLMFTTKSLEALVTAFGIGAGVSSILILV

SEQ ID NO: 5262 - protein, 501 aa, Staphylococcus epidermidis
IMYYFVGNNIGHKTAGIEKAMINRLNLFKAYHYQAKILLLAWNRYLTQTASQYINSEDYINMYDYFQEASNVTSVFSKNWIHYWRNECGYTIKPVSETNDVRIYDQQQFIMYAHFADEAYQKIDYINYFDTSRRKIKRELYDTRGFLSCVRVLSTDQKIQAEYYLSPQGNVKIEKYYDINSNHPYVAKKIILNHLGKTHFLNNETELGAFFIETIYQSSDLFFSDRNLVTSHIFNIVASYIPVIAVLHSTHVKDVTDLTHSPIKNVYKGVFEHLQRYKAIIVSTQQQKADVIERIRGVIPVYAIPVGYSSFEMNDDSNKNNYVSPKKIISVARYSPEKQLIQQIELINRLKDTFPNIELHMYGFGKEEQHLKERIQELGLEKHVILRGFLKDLTDEYQDAYLNLITSNMEGFSLALLECESHGVPSISYDIQYGPGELIQDGKNGYLIEKNNQHMLFEKVKLLLNNPQLQQSFSHHCIETAQKYSQTQIMLLWKNLLQHFN

SEQ ID NO: 5263 - protein, 72 aa, Staphylococcus epidermidis
VMLYSLYIRHPVNLVYWYLLNYTKRPYFLKYFNIKLHISTKYFGETLEGTGQAEDYRLKLSPKKASQQYEAL

SEQ ID NO: 5264 - protein, 331 aa, Staphylococcus epidermidis
IILYNTLNAWGGFIIMKYIDEQTQAQLLDMNEVILEVEKALQAFSENKTITPLRYVLPFNEQNRYLVMPALSDELNIVGLKTVSFAPENSKKGKATITGSVILSDYETGETLSILDGGFLTKVRTGAISGVATKYLAKENAKTLSVIGAGVQAEGLIEAILAVRDIEKIHIASRTFEKAEKFAQNIRNRFNIKVSVFRSADEAIDSADIVVTATNANQPVYTHSLHPGVHLNAVGSFKPDMQEIPSETMLVANKIVVESMEAALEETGDLKIPQAEGILTKNMLHSELGDIISGEKVGRETEEEVTVFKSVGLAIVDIIVAQYFYKKLIQS

SEQ ID NO: 5265 - protein, 127 aa, Staphylococcus epidermidis
WRKYKMANQEQIIEAIKEMSVLELNDLVKAIEEEFGVTAAAPVAAAGAAGGGNAAAEKTEFDVELTSAGSSKIKVVKAVKEATGLGLKDAKELVDGAPKVIKEAMPKEDAEKLKEQLEEVGASVELK

SEQ ID NO: 5266 - protein, 135 aa, Staphylococcus epidermidis
YLVYSKASILNMIDGYKMNCNILEDVVPECDSNSIAQYGIQATLPKPQGENGSKVEDVVIRLERTNKRYAQMLKEVEFINQSQQKLGHVDFCFLEHLKKGRRRDKIIEKMPNAKLNRNNFLARKDELAEKIYLLQ

SEQ ID NO: 5267 - protein, 823 aa, Staphylococcus epidermidis
NRRYLYMLFGRLTERAQRVLAHAQEEAIRLNHSNIGTEHLLLGLMKEPEGIAAKVLESFNITEDKVIEEVEKLIGHGQEQMGTLHYTPRAKKVIELSMDEARKLHHNFVGTEHILLGLIRENEGVAARVFANLDLNITKARAQVVKALGSPEMSNKNAQANKSNNTPTLDGLARDLTVIAKDGTLDPVVGRDKEITRVIEVLSRRTKNNPVLIGEPGVGKTAIAEGLAQAIVKNEVPETLKDKRVMSLDMGTVVAGTKYRGEFEERLKKVMEEIHQAGNVILFIDELHTLVGAGGAEGAIDASNILKPALARGELQCIGATTLDEYRKNIEKDAALERRFQPIQVDEPTVEDTIEILKGLRDRYEAHHRINISDEALEAAAKLSDRYVSDRFLPDKAIDLIDEASSKVRLKSHTTPSNLKEIEQEIDKVKNEKDAAVHAQEFENAANLRDKQSKLEKQYEDAKNEWKNAQGGLDTALSEENIAEVIAGWTGIPLTKINETESDRLLNLEDTLHKRVIGQNDAVNSISKAVRRARAGLKDPKRPIGSFIFLGPTGVGKTELARALAESMFGEDDAMIRVDMSEFMEKHAVSRLVGAPPGYVGHDDGGQLTEKVRRKPYSVILFDEIEKAHPDVFNILLQVLDDGHLTDTKGRTVDFRNTVIIMTSNVGAQELQDQRFAGFGGASEGSDYETVRKTMMKELKNSFRPEFLNRVDDIIVFHKLTKDELKEIVTMMVNKLTHRLSEQNINIVVTDKAKEKIAEEGYDPEYGARPLIRAIQKTVEDNLSELILDGNKIEGKEVTIDHDGKEFKYDIHEITAKKETTES

SEQ ID NO: 5268 - protein, 58 aa, Staphylococcus epidermidis
MKYLLSYMSMFIAMIITLILGGGFFTVIAFSMLTLIFSTFFWEKWIEITKKTETCANK

SEQ ID NO: 5269 - protein, 171 aa, Staphylococcus epidermidis
WFFQTKITSILDANEHSTVYGKRGRERVYEERYRVHEEQLQRNHGRATLLDYSEIRQITSQYIGYLPYDELMSLTPNEWKDWVIGRRLALLDEQETLLFGAQANGLVQAGKSLKRLQKQLERARYEVRGQSDEYERMKKRKLAQNKRNREAQKQGTRRFMNSLRNTSQRGG

SEQ ID NO: 5270 - protein, 154 aa, Staphylococcus epidermidis
ECTHMFWIFNFIFSFLASLFFCVIFDAPRKLYFACGFVGACGWMVYTVLFNGFELHTIYSSFFGSLALGLLSHYMARRKKEPVIIFMVTGIIPLVPGGLAYDATKNLVLLHFGKAINTMLEVTLIAGAIALGLLFADQISKIVISGFARTRKRL

SEQ ID NO: 5271 - protein, 41 aa, Staphylococcus epidermidis
ISTHKTDVFYVLLKEKGRRRANRLTHLRLTQFKNFIFRIAL

SEQ ID NO: 5272 - protein, 162 aa, Staphylococcus epidermidis
GRSHMYSVRQATEKDVVAIRDVATKAWYNTYLNIYAASTVNELLAASYNETHLKKRLNEQLFLVAEEDSEIVGFANFIYGEELYLSAHYVRPESQHRGYGTRLLEAGLKRFKDQYETVYLEVDNNNSNGIEYYQNHGFEIIRSYQPEMYGEIMDLALMKKSF

SEQ ID NO: 5273 - protein, 49 aa, Staphylococcus epidermidis
VKYHVFTSVRSLLRTVYNLTFFVPVSQHFSLQKIQKDFFYLYIVFIWER

SEQ ID NO: 5274 - protein, 130 aa, Staphylococcus epidermidis
YVNQGKSKTKQSDSPALNRGFNSKKKQFTNLNSPQKRGVCTRVGTMTPKKPNSALRKYARVRLSNNIEVNAYIPGIGHNLQEHSVVLVRGGRVKDLPGVRYHIVRGALDTSGVDGRRQGRSLYGTKKPKN

SEQ ID NO: 5275 - protein, 57 aa, Staphylococcus epidermidis
HERLPLSLIKLISTRLNHYAEYHRYHKFKNMKRAPLTFVARGALARFHSSFNSNTHI

SEQ ID NO: 5276 - protein, 312 aa, Staphylococcus epidermidis
LILHDVEVYKNKERLRISNNRFTGTALRVVSYDVKGAGYDRKFDEIDRVNGRFHNATKEEKKSISMTVRYDVEKIAYASHLKANIQAMLRGHFYLRELATSESEVKFENIFEPKEQSFELEYVDGRQILVGLVNEVSFDTTKTSGEFTLDFETIELPYFESIGYSTDLEKESGNLNKWGIPDKNPFNTSHKERRYTFYDTKVGDVYYGGTAEINQFNQDSVVEMTLGENVSKNDSDGFNFYMTHSDIMKISGLELRAGDVIKFDGIHVYRNNLRIDDYNKTKQQPVLMPGWNTFHTTKKLQKITFKHKRYYL

SEQ ID NO: 5277 - protein, 277 aa, Staphylococcus epidermidis
HMAQGTTTKSTQIVPEVLKPMMQAELDKKLRFAQFADIDSTLVGQPGDTLTFPAFVYSGDATVVPEGQKIPVDKIETNRREAKIHKIGKGTDITDEALLSGYGDPQGEAVRQHGLAIANKVDNDVLEALRGTKLTVSADIGTLAGLEAAIDTFDDEDLEPMVLFINPKDAGKLRSSASANFTRATELGDNIIVKGAFGEALGAVIVRSKKLDEGEAILAKRGAVKLITKRDFFLETDRDPSTKTTALYSDKHYVAYLYDESKAVKVTKGAGTTDSGA

SEQ ID NO: 5278 - protein, 42 aa, Staphylococcus epidermidis
YKRQKENGNTYDDTIFDFYLHLINLSILRKSTHLLNINFYIL

SEQ ID NO: 5279 - protein, 45 aa, Staphylococcus epidermidis
QERQKKLYYKLIKHKKYHCASIYGDIKDDTDENGNEYKIHICKIQ

SEQ ID NO: 5280 - protein, 406 aa, Staphylococcus epidermidis
RNMHIVIGILGIIFFLALAVLFSSDRKNIRWRYVGLLLVIQLIFAFILLKTNLGISVIGSISDGFNYLLAKAAVGVNFVFGGFKFIDPKQPPFFFSVLLPIVFISALIGILQYTRILPLIINLLGFLISKINGMGRLESYNAVAAAILGQSEVFISLKKQLPYIPKQRLYTLTASAMSTVSASIIGAYFTLIEPKYVVTAVVLNLFGGFIIASIINPYKVNEEDDKLLIDENETKKQSFFEMLGEYILDGFKVAVIVGAMLIGYIAIIALLNGMVSGILSFMSGGAIQWNFQTLIGFIFAPFAFLTGIPWQDAVQSGSVMATKLLSNEFVAMQDLGKATGLSEHAKGITSVFLVSFANFSSIGIISGAIKSLNDEKGDVVARFGIKLLFGATLVSFISAAIAGFFI

SEQ ID NO: 5281 - protein, 246 aa, Staphylococcus epidermidis
ISMQIQPEFFEKLKPRYSDNGVFQLINTSILNAFGLNDKIRGEEMSHYYDEQPDVKSNPKRISYQIKNVQLELTTDAGVFSKDNVDFGSDLLIKTFLKEHPPGPSKTIADVGCGYGPIGLAIGKASPHHQITMLDINNRALALAEMNKTKNQVDNVTIMESDCLSAVNHQCFDYILTNPPIRAGKDIVHRIFEQAFDRLKTTGELYVVIQKKQGMPSAKKKIEELFGNVEIIAKSKGYYILKSIKG

SEQ ID NO: 5282 - protein, 600 aa, Staphylococcus epidermidis
IQTQCWDLPNYIFNRYWHFKTTGNAIAMAWYRYPKGFKFYRNTRNFVPKPGDMAVWGKGSFNNGVGHTAVVIGPSTKSYFTSVDQNWIGANSYTGSPGAKIKHSYNGISGFVRPPYHAETKKPSKPSSTPSKPSNDNTPKNTKEQTKPITKEITKVSYTSFAYDLDDDLEYIYHYMVEGQKLIGKVKGIYIKESTHMRSVEELYLQRNKYVNEDEYPHVYIDRERVWTPRPDSEEAPEHPGWLVMEVCGGQTDSKRQFMLNQIRALIYGVWLLSWSKVKLSESSIKADPNIWRSMKDLINYDLIKNGIPDESKYKEVEKKIIGLYLKRDKLLTETITTTTTKTKIKIKPKTSVDNPSQNDKSTGKTTNRTSNKPRVVVEKSKYTFQQALNAQMAHGMPQKSYSWGWGNASRSQTSKYMNPNTIWNSSTQRYQMLDLGKYQGISVSKLNKILKGKGTLSGQGKAFADGCKKYNVNEIYLIAHAFLESGYGRSNFASGRYGIYNYFGIAAYDNNPNASIGYARRQGWTSPRNGIIGGAKFVRKQYFNKGKNTLYRMRWNPSNPGRMQYATAIEWCNFQASTISKLYKTVGTKGMYYIRDKYR

SEQ ID NO: 5283 - protein, 180 aa, Staphylococcus epidermidis
RMAQNKYIAALQIADKDLASKLKEEDAILLASLAEGGHTISNDLAEMITGGKKDYGRNSVEEEIKLTVDRVPGDKGQEALKESVKNFKQLRLWIWEVKKRDGKHHGTFAYVIIEEQEWSFDDEDDKIEITAKVKFNSADGSVDSLPPEWLNPSAAAPTVEFEGMGEYTGTYEERTPSAGA

SEQ ID NO: 5284 - protein, 224 aa, Staphylococcus epidermidis
YNFNYEVNIMNFDSYIFDFDGTLIDTTTCHVKATQSAFKRLNLDEPTEQAILHTYHLNLYNNFKALASHELSFYQIEKLIDEYNHCFSNDEIHQSKEYTGISEALKFLHNQKKKIFVVSNKEILTTQKYLDYLGLSRFITDSLGVCIKNEDKLLCETIQNLIQKHHLMIGKTVYIGDTAQNIKSANQAHVQTCAVTWGAQSAHELLHENPHYIVNDPEEFLTIL

SEQ ID NO: 5285 - protein, 136 aa, Staphylococcus epidermidis
EVINVIWISFSSVIIVLVLCIFAIYKWIKAEKRVNELQEDKHGLQLDKLHLEREVSWLKNKDNKNNIGKYVVELKKGVYLVKKYIGSYGNTCIITDNVFEALSYDDLYSAKEDACSFNGRVLEHKPNLEVVKQCGA

SEQ ID NO: 5286 - protein, 336 aa, Staphylococcus epidermidis
ERIKEDIMADLLSVLQDKLSGKNVKIVLPEGEDERVLIAATQLQKTDYVSPIVLGNEDNIKSLASKHALDLTQIEIIDPATSELKDELVDAFVERRKGKATKEQAVELLDNVNYFGTMLVYTGKAEGLVSGAAHSTGDTVRPALQIIKTKPGVSRTSGIFFMIKGDEQYIFGDCAINPELDAQGLAEIAVESAKSAQSFGMDPKVAMLSFSTKGSAKSDDVTKVQEALKLAQEKAEADQLDHVVIDGEFQFDAAIVPSVAEKKAPGAKIQGDANVFVFPSLEAGNIGYKIAQRLGGYDAVGPVLQGLNSPVNDLSRGCSTEDVYNLSIITAAQALQ

SEQ ID NO: 5287 - protein, 53 aa, Staphylococcus epidermidis
LKTNSNLEYFIEIQFDNAIIYYRFKNILRNMRLKDEKDNVHHCSNDIRHRIFR

SEQ ID NO: 5288 - protein, 64 aa, Staphylococcus epidermidis
VMANREETIEVEATIKVRCKYPVWVNNQITASDEKERILDLISKNPEKELMSEDFELVELIEVE

SEQ ID NO: 5289 - protein, 271 aa, Staphylococcus epidermidis
NEYKLIRFRQRNFFNVCFFCLFLFTQLRIRRDKMIYAGILAGGIGSRMGNVPLPKQFLSLQGKPIIIHTVEKFLMYKDFDEIIIATPQKWINYMLDLLNNYQLDDKKIKVIQGGDDRNHSIMNIIESIEQHKKLNDEDIIVTHDAVRPFLTNRIIRENVEYASQYGAVDTVVNAVDTIISSNDAQFISGIPIRSEMYQGQTPQTFKIKELKDSYLSLTQSQKEILTDACKILVELGKPVKLVKGELFNIKITTPYDLKVANSIITGAVDND

SEQ ID NO: 5290 - protein, 97 aa, Staphylococcus epidermidis
RMYKVIEYFEDLQDDNYEYNVGKTFPRKGLNVSDERLTELSTKENRQNKPLIERVESDKDLKGMKVSELRELAKEREIEGFSSMKKDELVEALGSVK

SEQ ID NO: 5291 - protein, 467 aa, Staphylococcus epidermidis
CKHNYIKCLQMVMKMKKIMEYLQHYINQYPHRLALVFEDRHLTYGELSKEIYQASMRYKEVKLNKKVGLMDEHPVNNIINYFAVHQRGGIPCIFNHQWSNERIHQLVKSYDIQWLIKDNHLTSNHDNSIYNDEVIPRNVIHIGFTSGTTGLPKAFYRNEHSWIVSFKENEKLLQHCEETIVAPGPLSHSLSLYACIYALSTGKTFIGQKNFNPLSLMRLINQLNKTTAIFVVPTMVQQLISTQRHCSSIKSILSSGAKLTLQQFQQIRNLYPQANLIEFFGTSEASFISYNFNQSSPANSVGKLFPHVETRLLNQDDDAVGLLAVRSEMVFSGYVGQSNQEGAWIKTGDFAYIKNQHLFLVGRESDRIIVGGINVYPTAIESLIMDIEGIDEALVIGIPHAKFGEIAILLYSGKVQLNYRQIKSFLMKHLSRQEVPSKLKKIDHMIYTESGKIARKEMKNKFINGEL

SEQ ID NO: 5292 - protein, 65 aa, Staphylococcus epidermidis
EHCNSDCHNSHNSKVLSSQLFTFTHYNTNILYISIVLNVKLMRHAIISSPYSILFAYYFLIQNFF

SEQ ID NO: 5293 - protein, 40 aa, Staphylococcus epidermidis
PISNKAKIIHEILNNRVSRIAFLGSKILDISNVLGMDFLK

SEQ ID NO: 5294 - protein, 162 aa, Staphylococcus epidermidis
SMSKLFELKDSYQQVYDLIAEQEDEQILKDTLASINDAIEDKADGYVAVIKSLEADNNAIDEEIKRLRQRKTSNQNGVKRLKESLQEVMEQTGKEKFKTALNSYSIANNPPSLDVTDESLIPKQYYIEQKPKLDKKELLKAIKDGLELKGVELKQSRSLRVR

SEQ ID NO: 5295 - protein, 67 aa, Staphylococcus epidermidis
FKINRLNSSLFIFLSFGKRMIKKINPITNQIPKAMYDGIESAAGEPGISNKHKNTKDTIDPIIPKIL

SEQ ID NO: 5296 - protein, 48 aa, Staphylococcus epidermidis
ISSKVLLASTFNILTLFVTSSQQLIFAFINKIQSTSKFHSNYYNIYNL

SEQ ID NO: 5297 - protein, 141 aa, Staphylococcus epidermidis
KSVLLAKVKYGNWDLVKELEEFEKETIRWAKKGIAKTTTIIHNSIVSNMPVDTGYLRESVSMDFKKGGLTGVINIGSEYAVYVNYGTGIYVVGPGGSRAKNIPWRYKDADGHWHTTKGQHAQPFWEPAIDEGRAFFNKYFS

SEQ ID NO: 5298 - protein, 317 aa, Staphylococcus epidermidis
MANNKDNPKITNQNDIDNYIDRLVNQANKEIETLFAKRLKEIKQIIANMYEKYDRDEPQVTWTEFNKYNRLNKELNRIGQMLSQDYREVAKAIKQSQQNIYIEKYMMSLFLYEVASQTSMNFDIPTTQTIQTAIEQPIEFIKLVPTLQKHRDDTLKRIRMHITQGIMSGEGYSKIAKALRDDLGMAKAQSVRVARTETGRALSQAGLDSAMVAKDNGLDMKKRWYSTKDTRTRDTHRHLDGTSVDIEDNFHSSGCVGPAPKLFVGVASAKENINCRCKLLYYIDEDELPTTMRTKEDGAIPFTTYREWEKDKRKGGV

SEQ ID NO: 5299 - protein, 59 aa, Staphylococcus epidermidis
LKNKQIKNWGKRNMDKVVIDLYKKKLYTDETFKKFVRVGWITPEQFKETTGKDYEPQVK

SEQ ID NO: 5300 - protein, 80 aa, Staphylococcus epidermidis
KELKMNSRVITKENKKEIAHRIKQIRLQRNFDINEFAEILYVSPFSIKQWEEGKRIPNIKKIKLIAFVFKTTPEWLLYGE

SEQ ID NO: 5301 - protein, 111 aa, Staphylococcus epidermidis
KRINKIESTQCVGFLIYLKGDMSMKTDVGSIVRTIVFILAWVNQFLATKHISPIPVDEVTISSIITGAISLWTWWKNNNFSHAAQKGQQKLHEVKAGTENTNGKAPIGGND

SEQ ID NO: 5302 - protein, 125 aa, Staphylococcus epidermidis
RMVKIKKKVEMTLPELIEWAWKNGVKEKAFYSNIDRGSVYFDMVQTVSIEYSIVVDETFTVEVEEEVTEETKIPEMLEIFVNGGGVKRVEKSINELKDDFSKEFWLKDGDTMTLIWKDGELVGDE

SEQ ID NO: 5303 - protein, 54 aa, Staphylococcus epidermidis
PKPNNNVAPITIDAVPTVNFLIAYLLDLFAIGFFLVSKLFFFNHKNSLSLTISM

SEQ ID NO: 5304 - protein, 67 aa, Staphylococcus epidermidis
IFTKIKILQMFWQIFYRRGKTMKNYDLIIIGFGKAGKTLAAHAASHGQKVAVVERSTKMYGGTCINI

SEQ ID NO: 5305 - protein, 461 aa, Staphylococcus epidermidis
LMTNKTRSQAHAYLDRLKGYWWDFDGVYGAQCFDLANQYWYYVTGHTLSGMYAKDIPFVNDFNGYANVVKNYNSYIPKKGTLVVFPYEYGNGCGHVAIIESATQNYFYSLDQNWYGGARNNPPEVAQTIYHEYHPDMYFVEPLYSKETKVSKIKAKTTKPKPVKKVKKRKVMIVAGHGYNDPGAIGNGYNERDFIRKNIVDNVSKYLKDAGHTVGIYGKKQDMYQDTAYGVRVGNHRDYGLYWVKSQGYDTVIEFHLDSAGPKATGGHTIIPAGYPANITDKNIQAALKQSVGTIRGITQRNDLLNCNVANDIGIEYRLVELGFITSYKDMKYINENIKPFTKSIASDINGKPIGGTSAGKVKSVKKTWDWKGRFYPNTTIKVRKKPNGEIVEKGSWLYGKDDWVDIVQLYKDTKKKLWWGKFKYPTNPSSGYFYCALGEITDKQERIKKEKKLYGKIKWQ

SEQ ID NO: 5306 - protein, 70 aa, Staphylococcus epidermidis
VHPLINNDILIESDIVVTLCSDADANCPVLPKNVTKEHWGFDDPAGKDWSEFQRVRDEIKAAIETFAHRV

SEQ ID NO: 5307 - protein, 196 aa, Staphylococcus epidermidis
KQQNNVEQLLKVNKMSEFNNYRLILEELDSTLSQVDNTEYERFANDVIGADRIFTAGKGRSGFVANSFAMRLNQLGKNAYVVGESTTPSIKEHDLFIIISGSGSTEHLRLLAEKAQSEGAKIVLLTTNAESPIGNLAETVVELPAGTKHDVEGSKQPLGSLFEQASLIFLDSVVLPLMDAFHISEKTMQENHANLE

SEQ ID NO: 5308 - protein, 231 aa, Staphylococcus epidermidis
MAKKGKKYQEAASKVDRTQYYSVEEAIKLAKETSVANFDASVEVAFRLGIDTRKNDQQIRGAVVLPHGTGKSQRVLVFAKGDKITEAEEAGADYVGEADYVQKIQQGWFDFDVVVATPDMMGEVGKLGRVLGPKGLMPNPKTGTVTMDVKKAVEEIKAGKVEYRAEKAGIVHASIGKVSFDEEKLVDNFRTLQDVLAKAKPASAKGTYFKSVAVTTTMGPGVKVDTSSFKL

SEQ ID NO: 5309 - protein, 930 aa, Staphylococcus epidermidis
LKKNNLLTKKKPIANKSNKYAIRKFTVGTASIVIGATLLFGLGHNEAKAEENTVQDVKDSNMDDELSDSNDQSSNEEKNDVINNSQSINTDDDNQIKKEETNSNDAIENRSKDITQSTTNVDENEATFLQKTPQDNTQLKEEVVKEPSSVESSNSSMDTAQQPSHTTINSEASIQTSDNEENSRVSDFANSKIIESNTESNKEENTIEQPNKVREDSITSQPSSYKNIDEKISNQDELLNLPINEYENKVRPLSTTSAQPSSKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 5310 - protein, 99 aa, Staphylococcus epidermidis
FMKKIIITGALGQIGTELVIKCRERYGTENVLATDIRKPEPHSPVKNGPFEILDVTDRNRLFETVRYFNADTLMHMAALLSATAEKKPLVAWDLNMGDL

SEQ ID NO: 5311 - protein, 43 aa, Staphylococcus epidermidis
LIEKPRYQNNGVLTSQRIQVVFALKSILNRLNIHFQPNYLIRK

SEQ ID NO: 5312 - protein, 73 aa, Staphylococcus epidermidis
GKEKSILVPSLLLKKLIFDENTNLITEKIGDDNNITCNLIKVVFYLYCIHNKINIYFEYLENSLNSRITIDII

SEQ ID NO: 5313 - protein, 164 aa, Staphylococcus epidermidis
NVRNHIYSQCLKNTLVVNGVRTLWKMTSSLERLRNDMNIKLIKEKIDNENKRMGSELEYTFKYKGHKCKVKRIEEYGHLCGYIYLNVKRGSEEYEIIDELAHCGVSYHKGNLIGFDCAHAGDFSLRMYNLFENKTYLSDLETYKDLEYVENNIKEIIDSLQKGG

SEQ ID NO: 5314 - protein, 187 aa, Staphylococcus epidermidis
NVGKQRKMTYFKWQDKHVKFLKENANGNNSEDLTQSFNNRFGTNQSKSSLKSKMYQIGIKFNNNTGRFKKGDHSYNTYAIGTKSIDKDGYVIIKHSNSKGDYNKNWKLYHHYLWEQKHGRIPEGYVVIFLNGDNRDFRIKNLYCVERGVWLKVINNDMRFDNPELVESAIHLSKLMIKQKNIEKRRR

SEQ ID NO: 5315 - protein, 192 aa, Staphylococcus epidermidis
VRCLKLLCENCHFNEAEVKLTVKGIDSTHEKWVCSVCAQGENPWLHSNDDNTYHTHQDDIEEAFVVKQILQHLAAKHGINFHEMAFKEEKKCPTCQMTLKDIAHVGKLGCADCYATFKEDIIDIVQRVQGGQFEHVGKTPQSSYKKLAIKKQIEEKSKYLNKLIDGQEFEEAAIVRDEIKALKSESEVSHDE

SEQ ID NO: 5316 - protein, 1215 aa, Staphylococcus epidermidis
SKLKEVGSLIDVNNFHYMKIGLASPEKIRSWSYGEVKKPETINYRTLKPEKDGLFCERIFGPTKDWECSCGKYKRVRYKGMVCDRCGVEVTKSKVRRERMGHIELAAPVSHIWYFKGIPSRMGLLLDMSPRALEEVIYFASYVVVDPGPTGLEKKTLLSEAEFREYYDKYPNQFVAKMGAEGIKDLLEEIDLDEELKELRDELESATGQRLTRAIKRLEVVESFRNSGNNPSWMILDVLPIIPPEIRPMVQLDGGRFATSDLNDLYRRVINRNNRLKRLLDLGAPGIIVQNEKRMLQEAVDALIDNGRRGRPVTGPGNRPLKSLSHMLKGKQGRFRQNLLGKRVDYSGRSVIAVGPSLKMYQCGLPKEMALELFKPFVMKELVQREIATNIKNAKSKIERMDDEVWDVLEDVITEHPVLLNRAPTLHRLGIQAFEPTLVEGRAIRLHPLVTTAYNADFDGDQMAVHVPLSKEAQAEARMLMLAAQNILNPKDGKPVVTPSQDMVLGNYYLTLERKDAVNTGAIFNDTNEVLKAYANGYVHLHTRIGVHANSFNNPTFTDEQNSKILATSVGKIIFNEIIPDSFAYINEPSQANLERTTPDKYFVDPTQLGEGGLKEYFDNAELIEPFNKKFLGNIIAEVFNRFSITDTSMMLDRMKDLGFKFSSKAGITVGVSDIVVLPDKQDILDEHEKLVERVTKQYNRGLITEDERYNAVVEIWTDAKDQIQGELMQSLEKTNPIFMMSDSGARGNASNFTQLAGMRGLMAAPSGKIIELPITSSFREGLTVLEYFISTHGARKGLADTALKTADSGYLTRRLVDVAQDVIVREEDCGTDRGLLVSDIKEGTEMIEPFIERIEGRYSKETIRHPETDEVIIRPDELITPDIAKQITDAGIEQMYIRSAFTCNTRHGVCEKCYGKNLATGEKVEVGEAVGTIAAQSIGEPGTQLTMRTFHTGGVAGSDITQGLPRIQEIFEARNPKGQAVITEIEGVVDDIKLAKDRQQEIIVKGANETRSYLASGTSRLKVEIGQSVERGEVLTEGSIEPKNYLSVAGLNATESYLLKEVQKVYRMQGVEIDDKHVEVMVRQMLRKVRIIEAGDTKLLPGSLVDIHNFTDANRDAFKHRKRPATAKPVLLGITKASLETESFLSAASFQETTRVLTDAAIKGKRDDLLGLKENVIIGKLIPAGTGMRRYSDIQYDKATAPVTETSEEVETIE

SEQ ID NO: 5317 - protein, 218 aa, Staphylococcus epidermidis
KRMKWSEVFHDITTRHDFQAMHDFLEKEYTTQTVYPDKQNIYQAFDLTPFEDIKVVILGQDPYHGPNQAHGLAFSVQPHAKFPPSLRNMYQELENDIGCHRTSPHLQDWAREGVLLLNTVLTVRQGEAHSHRNIGWETFTDEIIQAVSNYREHVVFILWGRPAQQKERFIDTSKHLIIKSPHPSPLSAFRGFFGSKPYSTTNNYLKSKGKTPVQWCES

SEQ ID NO: 5318 - protein, 75 aa, Staphylococcus epidermidis
TMMKMTTSTLELSSTINQRYKYNTQGKTPTQIQQELRQIGVKGFVVKVAGSRVTMKVEKENIRKNRECMRNGRSN

SEQ ID NO: 5319 - protein, 460 aa, Staphylococcus epidermidis
GVMNYERSYLRSCQVRTLEQKEVGYSIEEQERKLKSFCEINDWSVSDVFIDAGFSGAKRDRPELQRMMNDIKRFDLVLVYKLDRLTRNVRDLLDLLEVFEQNNVAFRSATEVYDTSTAMGRLFVTLVGAMAEWERETIRERVMMGKRAAIKQGMILTPPPFYYDRVDNTYIPNDYKKVVLWAYDEVMKGNSSKAIARKLNDSDIPPPNGKRWEDRTITRALRNPITRGHYTWGDVFIENSHEPIITEEMYQQIKERLEERINTKIVSHVSVFRGKFICPRCGGTLTMNTATRKRKKGYVTYKTYYCNTCKTKKQSFGFSENEALRVFRDYLSKLDLDKYEVKTKQKDDVVTIDIDKIMEQRKRYHKLYAKGLMQEEELFELIKETDETIAEYEKQKELVPRKSLDIDKIKKFKNALLESWKIFSLEDKADFIKMAIKSIDIDYVKLKNRHSIKINDIEFY

SEQ ID NO: 5320 - protein, 49 aa, Staphylococcus epidermidis
IIVKKVPLNCENCGNRNYNVPKKEGSATRLTLKKYCPRCNAHTVHKESK

SEQ ID NO: 5321 - protein, 60 aa, Staphylococcus epidermidis
RKVKFMITVLVITIFFITVTLIIWQPKGLDIGISAVIGALLAIVTGVVSVSDILEVTSIV

SEQ ID NO: 5322 - protein, 286 aa, Staphylococcus epidermidis
KIKNNKWRMETMTELNTKEMKLDALLKDMQSVVIAFSGGVDSSLLLKKAIDILGVNYVKPVVVKSELFRNEEFELALKLGQSLGVEVLETEMSELQDANIVKNTPESWYYSKRLMYSQLENIKNKLGFNYVLDGMIMDDLDDFRPGLKARDDFGVRSVLQEAKLYKSEVRELSHQHDLPVWNKPALCSLASRIPYGEELSFTKVNKVNEAEKFILSLGINHVRVRYHHNIARIEVTEDQLNNLLKLKDSIILHLKELGFDYVTMDLEGYRTGSMNEIIDTKSTSFK

SEQ ID NO: 5323 - protein, 164 aa, Staphylococcus epidermidis
KKEKCRMKEPPHNRLTFKESMTEGKYLTTITKEDKIRYKKLSVEEKRKVLNDFNASTPQKDDKVSLFDYMKRTMLKHGLDEVTSITENAVLKNEPGKHIDSFMTRLSSFSTTKDGTTVFTYELINQNFVVIKILDEQLKQNKKIIEQNNEIISLLKQIANRGEM

SEQ ID NO: 5324 - protein, 300 aa, Staphylococcus epidermidis
NKWKRGQLMIKLIATDMDGTLLNAGHEITTMNQEAIKFAQANGITVVIATGRAFYEAQTPVAETDLKVPYICLNGAEVRDESFNIMSTSHLNHDLVHKITTALKNNHIYYQIYTNRGIYTEDPKRDLAIYIDIAERAGQKADVDKIRNNIQKRIDNGTLKVVDNYDSIEDIPGELIMKVLAFDADLSKIDQVGQALASSPNLAVSSSSRGNLEITHSNAQKGIALSAIAHQLGIDLTDVIAIGDNLNDISMLERVGYPVAMNNATDEVKHIAKYVTDTNENSGVGKAIMKILKEENNLEV

SEQ ID NO: 5325 - protein, 42 aa, Staphylococcus epidermidis
LRWKILKTLVKNLTMFTKLSFKVNIFHDFDNSLKEFYNIKVL

SEQ ID NO: 5326 - protein, 43 aa, Staphylococcus epidermidis
NQFEIFHLNIVPKFVRYVSHETLILTKIIYKISVNKFRKNNSS

SEQ ID NO: 5327 - protein, 48 aa, Staphylococcus epidermidis
LSSDEPLPLPLLPQALSTMAKASVASSPKNFELRRFNITCFPLFNISL

SEQ ID NO: 5328 - protein, 165 aa, Staphylococcus epidermidis
RMTENTINPITTLEFNGEEVEAKATFLFDKTAKKFAKDEQDKNGKTTKVSGFNAIYNGILERDTNAIADFWECATAYLNKKAPTREQIETSLMQFIDKNGDTLELLQGALDVMNNSGFFKQKSRQFWTQMNIAPSMAKEEEKESTKNGIEFMKNNYKEIMGELPY

SEQ ID NO: 5329 - protein, 86 aa, Staphylococcus epidermidis
MSNEKVARFNKQQYVVGLKETLKALKKGQVTSLIIAQDVEVHLLTRVLSYINHKNIPVSFFSSQRALGKYVGINVNATIVALISEN

SEQ ID NO: 5330 - protein, 406 aa, Staphylococcus epidermidis
NNNDILISIIKMEEVIHVFDWFQLASNKEKRMVQLRRYLHQYPELSFEEKRTHDFIVNQLSQLACTIETPVGRNGIKATFKGSDSNGPTIALRADFDALPVQELNDVPYRSKNKGCMHACGHDGHTAILLGVAEIVHEHRHLLKGNVVFIFQYGEEIMPGGSQEMIDDGCLQNVDKIYGTHLWSGYPSGTIYSRPGAIMASPDEFSVTIYGKGGHGAKPHETIDPIVIMAEFILSAQKIISRTIDPVKEAVLTFGMIQAGSTDSVIPDTAFCKGTVRTFDTKLQSHVQNKMDKLLQGLSLSNDITYELEYIKGYLPVHNHQQSYDVVKQAANDLHLRFNESDLMMIGEDFSHYLKVRPGAFFLTGCGNKDKGITAPHHNPHFDIDESSLKYAASEFLKILEIENVF

SEQ ID NO: 5331 - protein, 165 aa, Staphylococcus epidermidis
KNSDFGKSVDWAIQGTDARNGVMQETKDELDSDNLDKYSLKESADQDQFKKIQSAFKQQEPIVFTAMEPSWFSKELDVKMLKDPDNIYGNNNQHIDLVFNKDFKEAHPAAYTVATRMADDWSKSDEDKLAKKIFVDNKNPEQVAKDYVDDNDNKVDEWLEGIETI

SEQ ID NO: 5332 - protein, 187 aa, Staphylococcus epidermidis
VRSEDMSEEVGAKRWYAVHTYSGYENKVKKNLEKRVESMNMTEQIFRVVIPEEEETQVKDGKAKKLVKKTFPGYVLVELIMTDESWYVVRNTPGVTGFVGSAGAGSKPNPLLPEEVRFILKQMGLKEKTIDVELDVGEQVRIQSGPFANQIGEVQEIEADKFKLTVLVDMFGRETPVEVEFDQIEKL

SEQ ID NO: 5333 - protein, 44 aa, Staphylococcus epidermidis
QLNELKIIKKNYKKDNFYIISIEIVFFYLSWTFLFQPLYKIVTK

SEQ ID NO: 5334 - protein, 120 aa, Staphylococcus epidermidis
NHLDVYVGLVIMFNPLDEFPHTIELGSREVVGEYPREQERFKSEKTIQGFMDTPTSSEQLKFHQMNQSYDRNLYTPYSLPITNTNLFKYNGKTYEVVGEPVDQGGQQEINLTRLKECPIG

SEQ ID NO: 5335 - protein, 69 aa, Staphylococcus epidermidis
KVIECGGLMMAKKESFFKGVKSEMEKTSWPTKEELFKYTIIVVSTVIFFLVFFYALDIGINALKQLFLG

SEQ ID NO: 5336 - protein, 293 aa, Staphylococcus epidermidis
NMTEFDLSTREGRWKHFGSVDPVKGTKPTTKNEMTDLQSTHKNFLFEIEEVGIKNLTYPVLIDQYQTAGLFSFSTSLNKNEKGINMSRILESVEKHYDNGIELEFNTLHQLLRTLQDKMNQNAAGVDVSGKWFFDRYSPVTNIKAVGHADVTYGLAIENHTVTRKELTIQAKVTTLCPCSKEISEYSAHNQRGIVTVKAYLDKNNDVIDDYKDKILDAMEANASSILYPILKRPDEKRVTERAYENPRFVEDLIRLIAADLVEFDWIEGFDIECRNEESIHQHDAFARLKYRK

SEQ ID NO: 5337 - protein, 109 aa, Staphylococcus epidermidis
GMAEVTKEQLLEFIRNNELDLDESYPRSDWWKFRNERDSLRKQRDELINDMAETKRKAEAFDEIVKVLASISKEIVEYPGDNDKQKEVIYKRYDDLFEPMKLLEVNDER

SEQ ID NO: 5338 - protein, 83 aa, Staphylococcus epidermidis
FLQENAEVLWMKVYEYQQLLGFMYREDYKEDPIIAKILIESGWAVKRLLDTGTIKPFDDYEEVKELIMNETKWRQPDGTYRRT

SEQ ID NO: 5339 - protein, 183 aa, Staphylococcus epidermidis
MTKELEIKLLTENATMPKRDRLDAGYDIYSAETVILEPQEKATIRTDIAVNIPEGYVGLLTSRSGVSSKTHLVIETGKIDAGFQGNMKINIKNDIEVVDADEFIYKDIKNEIIDDGSFNEPIEEQSSNPLDIFKPRNTSYVIKKGDKLAQLVIVPIWTPELKEIEEFSSGSERGEQGFGSTGF

SEQ ID NO: 5340 - protein, 83 aa, Staphylococcus epidermidis
TMKDKDYKSLWIKLKEKKLKEYVEVHRSVNQIITPYNQYHLFEIANEMVSENELKRDLKYMDQLDGTHEFQNLLSDLEACNGQ

SEQ ID NO: 5341 - protein, 208 aa, Staphylococcus epidermidis
MTEETLFNQLNQKDVNDHVEKKNGLTYLAWSYAHQELKKIDSNYSIKTHEFVHPDVPLDNYFVPYLATPEGYFVQVSVTVKGQTETEWLPVLDFRNKSLAKGSATTFDINKAQKRCFVKAAALHGLGLYIYNGEEVPSANDNDITELEERINQFVTLSQEKGRDATLDKTMRWLGIQNINKVTKKDIANAHQKLDAGLKQLDKENSND

SEQ ID NO: 5342 - protein, 212 aa, Staphylococcus epidermidis
ISLELQLAIDLLNKEEAAKLAQKVEEYVDIVEIGTPIVINEGLPAVQHLNENINNAKVLADLKIMDAADYEVSQAVKYGADIVTILGVAEDASIKAAVEEAHKHGKALLVDMIAVQNLEQRAKELDEMGADYIAVHTGYDLQAEGKSPLDSLRTVKSVIKNSKVAVAGGIKPDTIKDIVAEDPDLVIVGGGIANADDPVEAAKQCRAAIEGK

SEQ ID NO: 5343 - protein, 116 aa, Staphylococcus epidermidis
FIQEILKMRNNDEIITIIKSAMKEQDMSLSELARRVGVAKSAVSRYLNLTREFPLNRTEDFAKALSISTEYLLGFDKSEQQDEQPKHRAAHLEGELTDEEWQRVLDYADYIRSKRK

SEQ ID NO: 5344 - protein, 167 aa, Staphylococcus epidermidis
LTEEKCRMKKVLFLIFASLLVLGACGQDEDKNKEDDAKKVEVKKTKENKKDKQSQSKEQKQEKPYNNDDEPILNDNRNANDNNSNQRNNKQNQNVDKIDNNAYNQQQNGQVNQKENTENGLDPNFVRHNDNMVKEWQNQMREHNENFNPESGGDLYNVETGNYVDDE

SEQ ID NO: 5345 - protein, 437 aa, Staphylococcus epidermidis
DRRESMTLSSYATSKLTEEKVFKDPIHRFIHVQDQLIWDLIKTKEFQRLRRIKQLGTLYLSFHTAEHSRFGHSLGVYEIVRRMIDETFIGQDAWDNTDRPLALCAALLHDLGHGPFSHSFEKIFNTDHEAFTQAIITGDTEVNGVLSRVSDNFPKQVADVINKTHDNKLVISMISSQIDADRMDYLQRDAYFTGVTYGSFDMERILRLMRPSKEEVLIKDSGMHAVENFIMSRYQMYWQIYFHPVSRGGEVLLNNCLKRAKQLYNEGYEFKMYPKDFIPFFEGTMTIEQYVELDEAVVLYYLKKWIHENDTILSDLSRRFINRDLFKYIPFDGSIITISELQELFEAGGINPDYYFVSEAFSDLPYDYDRPGSNRKPIHLLKSNGGITEISNQSLVINSITGINREDHKLYYPKEMILKIKDYQIKGSIINLLNELN

SEQ ID NO: 5346 - protein, 219 aa, Staphylococcus epidermidis
TEGETFVLKRMRDDIKMVFEQDPAARSTLEVITTYAGLHAVWSHLIAHKLYKNRRYVAARMISQLSRFFTGIEIHPGAKIGKRLFIDHGMGVVIGETCTIGDNVTIYQGVTLGGTGKEKGKRHPDIGDNVLIAAGSKILGNIKIESNVNIGANSVVLQSVPSYTTVVGIPGHIVKQEGRRIGKTFDHRNLPDPLYEQIKHLERQLEKAKNGEIQDDYII

SEQ ID NO: 5347 - protein, 344 aa, Staphylococcus epidermidis
GGLFMKAAVVTKDHRVSIEEKRLRELRPGEALVKTEYCGVCHTDLHVKNADFGDVTGVTLGHEGIGRVIKIADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKIQLRQLSEINDIFDEMEKGTITGRMVIDMKSTH

SEQ ID NO: 5348 - protein, 124 aa, Staphylococcus epidermidis
WKSLYRKVGSKMKNKFLICDECQAVNLKSLKRKLEKLDPEAEIEIGCQSYCGPGRRKTFAFVNNRPLAALTEEELMEKVTKQLKKPRDPEEEERLRKRNEERKRRKEEQDRKLKEKLKKHKAEK

SEQ ID NO: 5349 - protein, 191 aa, Staphylococcus epidermidis
NATLTFVAVILISLILDEIGFFEWSAIHMVKASQGHGLKMFVFIMILGAIIAAFFANDGATLILTPIALAMIRNLGFNKKLVFPFIIACGFIVYSTSLPLVVSNLVNIVSADYFGIEFVEYLKRMFIPNLFSLLASILILWFYFRKSIPKTFDISSIFEPKNAIRDTRLFKISWIILALLLIGYLVSEFIP

SEQ ID NO: 5350 - protein, 44 aa, Staphylococcus epidermidis
IQLCNRTIFNMINIGIWPMVILALLIIANSIFMVYKTVDVKKRK

SEQ ID NO: 5351 - protein, 283 aa, Staphylococcus epidermidis
LSFCLYILIWMHNFSHEGCAFFLIQIKIIGGIKMKKTAIITGSSRGLGAKIAITLLEKGYNVVVNYKQNKDKAEKLIRNYNQSRAIAIQADVTDRNDVNRMIQTATQHFGKIDIVINNALVGFKFDPNQQKSFKDLTWEDYQQQLNGTLKGAFNVTQSVIPQFIEQQSGCIVSIGTNLYQNPVVPYHEYTTAKAGLIGFTRNIAAELGQYGITANVVSGGLLKTTDASAVTTPEVFDLIAQTTPLRKVTSPQDVANMVVYLASDEARGVTGQNITVDGGLTMN

SEQ ID NO: 5352 - protein, 43 aa, Staphylococcus epidermidis
NLPWTISKVTRDISHLGFEAQPGVGLCIQFHFLILLVYGMYEF

SEQ ID NO: 5353 - protein, 40 aa, Staphylococcus epidermidis
KGKCTTIKFFLIFIIKFTYKSLFYLLNSMKMTLNNKLHVM

SEQ ID NO: 5354 - protein, 75 aa, Staphylococcus epidermidis
TERWCLIMEFNVKVNVDADEAIEKLERIKKLYEEINQLKNDRPVVKVGISNEADVEQIRSYINEKNVENANFNLF

SEQ ID NO: 5355 - protein, 168 aa, Staphylococcus epidermidis
RSFRHEMFKSGRAKLSPVTTSRYQGVHIVAKKVEKVVKLQIPAGKANPAPPVGPALGQAGVNIMGFCKEFNARTQEQAGLIIPVEISVYEDRSFTFITKTPPAPVLLKKAAGVEKGSGEPNKTKVATVTKDQVREIAQTKMQDLNAADEEAAMRIIEGTARSMGITVQ

SEQ ID NO: 5356 - protein, 172 aa, Staphylococcus epidermidis
EVSRLSEKKGFNFNIIKNDPLDGHKGTNIGSISLDNIAPVFIDVENQKAFVDIGGMHARAEVEKGVKWITDKSQVEGEEAKAYWLCWVTTERSEEGPYYAGVTACYLLVNKSIRRGYKSMPEHVNMMDKSMKHQFIIDQIGDDNKQILKEFLQNHNVEMWNNSSEELYRAFE

SEQ ID NO: 5357 - protein, 75 aa, Staphylococcus epidermidis
HLLLEALSHGSTLHLIAILIFDLLLFSSQLFIFINKGAFINIYDVLTATAHSLTHKHLTTNPLNHFIFIIICCHL

SEQ ID NO: 5358 - protein, 157 aa, Staphylococcus epidermidis
IMPRKGSVPKRDVLPDPIHNSKLVTKLINKIMLDGKRGTAQRILYSAFDLVEQRSGRDALEVFEEAINNIMPVLEVKARRVGGSNYQVPVEVRPERRTTLGLRWLVNYARLRGEKTMEDRLANEILDAANNTGGAVKKREDTHKMAEANKAFAHYRW

SEQ ID NO: 5359 - protein, 40 aa, Staphylococcus epidermidis
KIIFYSHQLSLLIRKKTWDNHFVPGLSFYDLSIVSHLLKI

SEQ ID NO: 5360 - protein, 901 aa, Staphylococcus epidermidis
KLLRFLWLRRSKTLKLDNLITKLHSYFSQKFVSQLENNFEQIKYWTNKSDDSFNEHLTTQKNAHTTDQIKHKTTKGKDVVLSNHENYQDELIEHLVLGHNGDGNNELKASHTSMDAQSFDSLHQRLYHDFLRESNAREELRADLTKKIQRIVNVDDFGGDPTGQKDSTKAFQDALGNGNVQVTMSGGTYLTTGIKMPNNSRLVGQGKDITTIKFMDETPAENIGITNLKMSGGAENISLESFSFNGNKFRQNKTLKATGGSRSSNIRFAGVTNGYIYNVKSYDALLHCIDVTYANDNYYYEGDGNRVPYALESKHIHIDNCEVYGCGDDGITTHHSRYITISNCYAHTPTGGSNNNGVEIDDGSQYVFLSNNRTKGNFGGLEIKAHSNASAASGVFVNGHVSIEDTRAYNIRHIGHHRAKTDNKSLTAYDVVLNNCLALNPKYNGVYPGSTPRALLISAYRNVSVNNFTAIGDSDFGKLEGGKLDKKQPAIAIQFMSENISLNNINVRNFKNAEVDIRLFGGDNRPSRVSLNNINIWNSSNNIGIGVGSKIYDTKITNCNLHGNGSGIGLRLTNNHAMISGVTADNYSTSAWIAGEKYDTPPTVGKGGASIASTGSAGVANASAVIASTGGSKAYSNRSFVLGSGANSKSYGSRSGIINSLNSETDKKGHTQLIMNSNRVKSPGNYHVVAGYGSSGNASTSNIKFDLSTYSGNLTLAGQLKQDSADIAELFESQNGLAIDLGTIVTLDGDKIRKAQPNDTPIGVISGTAALVANEKTFHHKDRFLKNEYGVTITNRKQVEFVDDEGNVSFEWRDIPVENPEYNDKIDYQSRSERPEWNVVGLLGQIYTNIEKDVIPGDYINGRAGVGYKDNVNGKGRVMKITSEYTEERGCAIALVLWGAK

SEQ ID NO: 5361 - protein, 42 aa, Staphylococcus epidermidis
LAILRDINLISLHIHLDRCHLNVNFIEYIYHIANNQAFIITI

SEQ ID NO: 5362 - protein, 41 aa, Staphylococcus epidermidis
TIGRISGGIIGNTSKIIQEGLFPEFLNDSTTSKRLIARVNL

SEQ ID NO: 5363 - protein, 133 aa, Staphylococcus epidermidis
IHQRGLIQIIFTVNMNGRSDEMKVVYLWKNGQAIIVHKNEEDEYVYPDEKWTENQPPQGIILPCYYDGKQWVGQTQDELEKMLPEVEIPVDDKDIAIAKLTSLVVDLQEEVMSLKQNIALITEEQANQKLGEA

SEQ ID NO: 5364 - protein, 121 aa, Staphylococcus epidermidis
EMQLYLKDGMEIREVQFTNEEVQNYCELLNIKYDHYVPTLMCAKLWPQFELFQSFSKKPIILKETHIKTQHQLQVDCTYEATLHKVSQKLIKNIIKYTYGLEINKDKKHCMYIKQIFIEVR

SEQ ID NO: 5365 - protein, 168 aa, Staphylococcus epidermidis
LSIRSKYLDLKIIIRFNVTNEVTLRWVKMNLEFNIAVHVLCFLAQHDQEQFNSKELAKLTCLNPVQLRRVLAYLTEHNYIKVQRGKAGGYQANQHTAQVDLAKLYQHFVLDKNNSQRRFTGASDSHCQISKKIAHTMSHYYSQEHQIILDFYKDKNITDVLADILQEG

SEQ ID NO: 5366 - protein, 42 aa, Staphylococcus epidermidis
KINSKISSLLTTLLLFVLFYTFITLVYVHPSLINKGIYFSNL

SEQ ID NO: 5367 - protein, 362 aa, Staphylococcus epidermidis
GRDRMIQVKAPGKLYIAGEYAVTEPGYKSILIAVNRFVTATIEASNKVEGSIHSKTLHYEPVKFDRNEDRIEISDVQAAKQLKYVVTAIEVFEQYVRSCNMNLKHFHLTIDSNLADNSGQKYGLGSSAAVLVSVVKALNEFYGLELSNLYIYKLAVIANMKLQSLSSCGDIAVSVYSGWLAYSTFDHDWVKQQMEETSVNDVLEKNWPGLHIEPLQAPENMEVLIGWTGSPASSPHLVSEVKRLKSDPSFYGDFLDQSHACVESLIQAFKTNNIKGVQKMIRINRRIIQSMDNEASVEIETDKLKKLCDVGEKHGGASKTSGAGGGDCGITIINKVIDKNIIYNEWQMNDIKPLKFKIYHGQ

SEQ ID NO: 5368 - protein, 705 aa, Staphylococcus epidermidis
YLFSKYWKEKKYMARDFSLKNTRNIGIMAHIDAGKTTTTERILYYTGRIHKIGETHEGASQMDWMEQEQDRGITITSAATTAQWQGHRVNIIDTPGHVDFTVEVERSLRVLDGAVTVLDAQSGVEPQTETVWRQATTYGVPRIVFVNKMDKLGANFEYSVSTLHDRLQANAAPIQLPIGAEDEFEAIIDLVEMKCFKYTNDLGTEIDEIEIPEDHKERAEEARAQLIEAVAENNDDLMEKYLGDEEISVDELKDAIRQATTDVEFYPVLCGTAFKNKGVQLMLNAVIDYLPSPLDVKPIIGHRANNPDEEVVAKPDDSAEFAALAFKVMTDPYVGKLTFFRVYSGTLSSGSYVKNSSKDKRERVGRLLQMHANSRQEIDTVYSGEIAAAVGLKETGTGDTLCGEKNDIILESMEFPEPVIHLSVEPKSKADQDKMTQALVKLQEEDPTFHAHTDEETGQVIIGGMGELHLDILVDRMKKEFNVECNVGAPMVSYRETFKQPAQVQGKFSRQSGGRGQYGDVHIEFTPNETGGGFEFENAIVGGVVPREYIPSVEQGLKDAMENGVLAGYPLIDVKAKLFDGSYHDVDSSEMAFKIAASLALKEAAKKCDPVILEPMMKVTIEMPEEYMGDIMGDVTARRGRVDGMEPRGNAQVVNAYVPLSEMFGYATSLRSNTQGRGTYTMYFDHYAEVPKSIAEEIIKKNKGE

SEQ ID NO: 5369 - protein, 90 aa, Staphylococcus epidermidis
VIYSSQKRTNGGENMVLNLKRLRAERIACGITQDEMAQMMGWKTRTPYAKRENGIVDIGANEFIKMAKILGYETNNLDIFFTQVVPKKEQ

SEQ ID NO: 5370 - protein, 81 aa, Staphylococcus epidermidis
LCNRTCFLIYLLNTRYFHQQFFQSVAFSNDVKLLMVPNVGITCYIIKCNILNMLNLRYRFNVIAHKTSAHYPYFKRYKLMK

SEQ ID NO: 5371 - protein, 60 aa, Staphylococcus epidermidis
GVSRLIKRILKIWFTIAMYELGKWIGREVYYKLTANDEVEVPKDFDENDHAHLNGIYGGY

SEQ ID NO: 5372 - protein, 213 aa, Staphylococcus epidermidis
RLIRSGQMDIVGMQFNYLKVLEFYGRNKHKKKLYKCYCTRCGNKKIMIGTEVKNGYSKSCGCLNKVSHSKKHGMTGTLIYNKWKGMKQRCYNSNYDFYSAYGGRGIKVCDEWKDDFMQFYKDMGDVPFEGAELDRINNDDDYKPSNCRWVSHEENANNRRKYHNKTGYTGVTYKPHLNKYQAQLYKNKKFIYLGVYETAEEAHLAYKKAKNEY

SEQ ID NO: 5373 - protein, 89 aa, Staphylococcus epidermidis
MKRSGGNQMGLIDGLKKQYTLYQIDGWKMCSVTPLGEDTFKLGNYAGIHFRNTFSGTVTKDELEKLKRKHKLFRKEELQQQMTINELLF

SEQ ID NO: 5374 - protein, 69 aa, Staphylococcus epidermidis
MKRSSYLRRQSNLIISMIIFVIFLIVDINVLINKHQVVPVLLSSISLIIFIMLFVVALFKCITNYKHQS

SEQ ID NO: 5375 - protein, 260 aa, Staphylococcus epidermidis
VPMSHSYNSIEEVLKAVKSNQLSINDAKAQLSHYDELGFAKIDLHRAQRQGFPEVIFGQGKTKEQITKIISSLIFHNEVILVTRVDEMKAKYILQHYPNLEYHQTAQLISTPLKDIPQSKYYVSVLCAGTSDLPIAEEAALTAEIMGVSVKRFYDVGVSGIHRLLSNIHDIRRGKVSIVIAGMEGALASVVGGLVNHPVYAVPTSVGYGANLNGVTTLLSMINSCAPGTSVLNINNGFGGGYNAAQIIHMLENKESEVSL

SEQ ID NO: 5376 - protein, 65 aa, Staphylococcus epidermidis
VIWRLAMDNREFIQRCIVSSTAFTGHDGCLLIKELNEVYRKAELYDKIVENNSKSLVENGGTIND

SEQ ID NO: 5377 - protein, 1040 aa, Staphylococcus epidermidis
SKRRLAMNKNFMARISAIITDFQRNIRKAQRMAKTEIPDEIETQVDANISKFKRALNTAKAMAQRWREHTVDIDGNANPVKRAIAVVREKLQQLRDKEVDIKGNNNPLKRSVLGAKAMLATLHDKTVHVNFDTRGMTRAQVLTRALGQSLDEYGDKMDALATKIRTFGTVFGQQIKGMLIASFQGLIPIIAGLVPAIMAVANALGVVAGGALGVAGAFGIAASGAFAFGAMAVSAIKMLNDGTLQATAQTRRYQASLEQVKSTWEGIIKQNQAQIFNTLSNALDTVNVALGRMKPFLAGISKGMEQASQSVLKWAQNSQTASKFFNMMNTTGVKTFNTLLSAAGRFGDGLINVFTQLGPLFLWTAKGLDNLGKKFQNWANSVAGQNAIKSFIEYTQTNLPKIGQIFGNVFMGIGNLMKAFAQNSSNIFDWLVKMTAKFREWSEQVGKSEGFKKFVQYVQENGPVIMDLIGNIVRVLVAFGTAMAPIASVILKVVTALAGFIAKLFETHPAIARMVGIGMILGGMLWALLAPIIAVSTVLSNVFGVGLIQAIGKMLAFARNTQILRSALNLVKIAFRLLMSPISTIMRILPMLSGAFQALGVAIGAISWPVLAIIGVIVALIGIIVWLWKTNENFRKTCIEAWNTIKDTIMNAVKSVINWFNQFRASIQQTLQPIIPILQMLGQVANQVLGFLFISLINGVVMAFQYLWTIVSVVFTAIGGILQAASQLFIGLATAWIQLLSGDIPGAWQTLQTMTQNVMNTIWNTILSIWNQISNFIFNVLNRILGTNITSWNQIWSAISGAVTRIWNTVASWFSRVVSTVAQKMMQALSRIISGGAQWVSSIISAMSRFLQAVVSGFFRVVGAVGNGMRNALNRARSFIGHFYQVGVDMIAGMIRGIVQKAKDLAAAAWNAAKGALNAAKSALDSHSPSRKFIQLGNDSMTGLGMGISEYAGKAARESKLAALKVMDAFNADLKPDFLEEGLAGLGNSFDAHMSKDVRHSMQENNKPIVNVTVRNESDIPAIKSYIEDSNSKDASFGLF

SEQ ID NO: 5378 - protein, 501 aa, Staphylococcus epidermidis
LIFGYLLSTQLIVGVKIMSERIRVRYAPSPTGYLHIGNARTALFNYLFAKHYNGDFVVRIEDTDSKRNLEDGESSQFDNLKWLGLDWDESVDKDKGFGPYRQSERAEIYNPLIQQLLEEDKAYKCYMTEEELEAEREAQIARGEMPRYGGQHAHLTEEQRQQYEAEGRKPSIRFRVPKDQTYTFNDMVKGEISFESDNIGDWVIVKKDGVPTYNFAVAVDDHYMQISDVIRGDDHVSNTPKQLMIYEAFGWEAPRFGHMSLIVNEERKKLSKRDGQILQFIEQYRDLGYLPEALFNFITLLGWSPEGEEEIFSKEEFIKIFDEKRLSKSPAMFDRQKLAWVNNQYMKTKDTETVFELALPHLIKANLIPENPSEKDREWGRKLIALYQKEMSYAGEIVPLSEMFFHEMPELGKDEQEVLQGEQVPELMNHLYGKLESLESFEATEIKKMIKEVQKETGIKGKQLFMPIRVAVTGQMHGPELPNTIEVLGKDKVLSRLKNLV

SEQ ID NO: 5379 - protein, 46 aa, Staphylococcus epidermidis
KLNGFIYSNLQLNYVLLTSKPPATIIHVSGGFDLFISLLCASLTFP

SEQ ID NO: 5380 - protein, 52 aa, Staphylococcus epidermidis
FRGGQTMWGVIAIIILVLLLFGSLLEQNDLKHQLEVKEYEIKTLKDKLENGG

SEQ ID NO: 5381 - protein, 128 aa, Staphylococcus epidermidis
EETGTIRRLDIMSMTELEAIEILELINNVYDMKFNEIKYNLWVEQLTQYGDFDRTLHKTKKYVRESRYKPTISQIIDRKPPEMESAVIPEEQTDKYRMQHDKEFREKRQQLRKQWQKMKEDWGLDDEY

SEQ ID NO: 5382 - protein, 256 aa, Staphylococcus epidermidis
WMKGSVNVEDIVIVGRHAVKEAIISGHAINKILIQDGIKKQQINDILKNAKSQKLIVQTVPKSKLDFLANAPHQGVAALVAPYEYANFDEFLQKQKKKARYSTVIILDGLEDPHNLGSILRTADASGVDAVIIPKRRSVALTQTVAKASTGAIQHVPVIRVTNLSKTIDELKDNGFWIAGTEANNATDYRDLQADMSLGIVIGSEGQGMSRLVSDKCDFHIKIPMVGHVNSLNASVAASLMMYEVYRKRHQLEEKS

SEQ ID NO: 5383 - protein, 232 aa, Staphylococcus epidermidis
EVGGLNVIYMYEPFTHTVTKTDLSHLHNITGIPLNTLWYQKERGTYNDKLKCFFTDTMPRVNKKQVFNESVVAKDEIWKYSEKYDLYVSNLGRMKRPDGKYKFANGCNGISTVIYKNKKYRAADIVYETFIGNLRTGYHAYPKDSRYNNLMADNLFQSTLQKYRVYRRNKGISKPVYLVDNNNRIVEEFASTVEAQKLLFIDRRNIARKCNRKHVSDGLMYMWADEYEELNA

SEQ ID NO: 5384 - protein, 67 aa, Staphylococcus epidermidis
RGKGGINNMIIYRRNIENGTPIYEIITKTFKTITIKCDETFNKYEIYQLLSLLENDVDNMPTSYSYR

SEQ ID NO: 5385 - protein, 47 aa, Staphylococcus epidermidis
KSFIILKCCENLNKKLLCPFVVILLLNSYNERLIIGDMINVFDKIDI

SEQ ID NO: 5386 - protein, 398 aa, Staphylococcus epidermidis
GIFMTKALYLDCHAGIAGDMLLSALVDLGANPEDIESELKKLPLDQFKLHFQKRVKQGIHAMTLNIDVKEANHHRHVNDIFKMIDDSTLPERVKYRSKKIFEIIGQAEAKIHGMSFEEVHFHEVGAMDSIIDIIGGCIALEQLGINTLYCSAIPTGHGKINIAHGIYPIPAPATAEILKGIPIAHFDVQSELTTPTGAAFAKGLVSSFGPFPSATIQHIGYGAGSKDFDFPNILRVIQFESEFEQQDSVQVIECQIDDMTPEALGYFMNNALEQGALDAYYTPIFMKKSRPSTQLTLICKLHDKTYFEQLILQETSSLGVRSTSVNRKTLNRAFKILSTQHGTVSIKFGLQNGKIMKMKPEYEDLKKIAKTTKQPFQVIHNEVLQQLYQTYHIGNILQ

SEQ ID NO: 5387 - protein, 499 aa, Staphylococcus epidermidis
VLFMENKNNNVDRGNLKQNLSEKFVWAIAYGSCIGWGAFILPGDWIKQSGPIASSIGIVIGALLMILIAVSYGALVEKFPVSGGAFAFSFLSFGRYVSFFSSWFLTFGYVCVVALNATAFSLLIKFLLPNVLNNGKLYTVAGWDVYITEIVIATVLLIVFMLITIRGASVSGSLQYYFCVAMVLVVALMFIGSFFSSHFSLSHLEPLASVDKGWFQSIIMIVSIAPWAYVGFDNIPQTAEEFNFSPNKTFKLIVYSLLAASLTYVVMLLYTGWLSTQATSLNGNLWLTGAVTQDAFGFIGLAVLAVAIIMGIFTGLNGFLMSSSRLLFSMGRSGIMPTVFSKLHSKHKTPYVAIIFLVAVSLIAPWLGRTALTWIVDMSSTGVSIAYFITCLSATKLFSFNKQSNTYAPVYKIFGIIGSIVSFVFLCLLLIPGSPAALSIPSYIALGIWLVIGLIFFIIRLPKLKKMNNDELSRLILNHSEDEVLEMVHEPGQSNSTNK

SEQ ID NO: 5388 - protein, 55 aa, Staphylococcus epidermidis
AKIMSHKILVQKFSDENICARVIIQEWDDAFSLIYVPLFSFLLQIIDIVIITMKF

SEQ ID NO: 5389 - protein, 387 aa, Staphylococcus epidermidis
WRVIKMKQPVIIAAKRIAFGKYGGRLRHLEPESLLEPLFNHFTDQYPKVMSLLDDVILGNTVGNGGNLARKSLLEAGLDFKIPGITIDRQCGSGLEAVIQACRMVQSGAGTIYIAGGVESTSRAPWKIKRPQSVYESEFPQFFERAPFAREGEDPSMIEAAENVAKKYHISRNEQDDFAYRSHQLASKNMNNGNISQEILPFKVKGEYFNQDESIKPQLTLRTLGRLKPLLNEGTVTVGNSCKKNDGAVLLIVMEENRARQLGFTEGIKFVNSATVGVQPQYLGVGPVPAVNQLLAQERLTINDINAVELNEAFSSQVIASQQQLNIPLNKLNCWGGAIATGHPYGASGAALVTRLFYMKHQFRTIATMGIGGGIGNAALFERWYGN

SEQ ID NO: 5390 - protein, 414 aa, Staphylococcus epidermidis
YRILLTYVRKYRHSINIGCIPTKTLIHDGIEGSSFKEAITRKKEVVQALNNKNYQGLNSKDNIDVLNYKANFISNEVIELQDNNGTIQETITADKIVINTGSRANIPDIKGIDTAQNIYDSTGLLNIDYQPQELVIIGGGYIALEFASMFANFGTHVTILERGDAIMTNEDQDIANLIVKDLQDKGVTINTNTSTIAFSNNKDQTIIHTNHGEISADTVLLATGRKPNTNHLGLENTDVKIGKQGEVIVNTHLQSTVKHIYAAGDVKGGLQFTYISLDDYRIIKSHLFGDGSRTTENRGAIPYTVFIDPPLSRVGLIASEAKLQGYDILENKVFVSNIPRHKINNDSRGLFKAVINKDTKEILGASLYGKESEELISLIKLAIDQHIPYTVLRDNIYTHPTMTESFNDLFLEPL

SEQ ID NO: 5391 - protein, 166 aa, Staphylococcus epidermidis
MSAIIEAKKQQVDTIAEQLKNSVSTVIVDYRGLTVAEVTELRSQLREAGVEYKVYKNTMVRRAAEQAGIEGLDEFLTGPTAIATSTEDVVAPAKVIAGFAKEHEALEVKTGVMEGNVISAEEVKTVGSLPSHDGLVSMLLSVLQAPVRNFAYAVKAVGEQKEESAE

SEQ ID NO: 5392 - protein, 60 aa, Staphylococcus epidermidis
LLILVCNFLLTFYTKAVILILVIILPKTVAVINNLKQYPTEAKIDLNVMINDLSSTFCRG

SEQ ID NO: 5393 - protein, 41 aa, Staphylococcus epidermidis
SLHIIMLQYDNLYNLMVKVHELIHSPFRVYYTLEVSFIYGK

SEQ ID NO: 5394 - protein, 42 aa, Staphylococcus epidermidis
FIHIFYFLTIYIYHVSEKSSLLITPYNFGDEGVYFKNLNWRG

SEQ ID NO: 5395 - protein, 280 aa, Staphylococcus epidermidis
GVHMTNNHFLNIGVLLYGCGHHQAAWRMKDSNIEDIGNISYYQHLAQIAEKGLLDIVFFADNQAFNASDNTTMPAFWFDPIINLSAIAQVTSHIGLVPTISSTFSNPFTASRQLLSLDYLSHGRVGWNLVTSMTDIEAQNHSLQYLPERHERYKKADEFASVMNQLFTSWSTASYVPDKNNNKIIESKDIKPFYHEGDYFQVRGPHTTPQSPQGKPVSMQAGASKEGIALAAKYADAVYSVSWDIKQARSYKKKLSDAISKTQHPDRKIKIFPGLSNLCR

SEQ ID NO: 5396 - protein, 148 aa, Staphylococcus epidermidis
IMSIKDLNRGDRIRMQEVNGVEITVQIKNVYRLVQSSLDMDKWVADVEAIDGRTWTIDDCYDFYSLPNGNEGTKKTLDDKVNHPSHYTYGDMEIIDFIEQVTKDYKPELAFAIGNAIKYISRANRKNGKEDLDKARWYLNRAFEKWEG

SEQ ID NO: 5397 - protein, 416 aa, Staphylococcus epidermidis
MMSIDVLSTEESIISNLMRNPELLGKFRLKPEMFTDEKLRVFIEYVLEQGKVDVNQIYFKSRDDNEFISTDRLGRLYNSDGTDKAFFMDDQLNLLQEYVLSQAREKLTEYQSMPSKENFNYLVEELEKLKGMTIKKSDATDSFLAEVVENILSDEPKQFIKTGIASIDNKIIGFEPGQLNVLGARPSLGKTSLALTMMWNIAQRGYPTTFFSLETGGNNIVERLVATITNIPLSKIKQGNGLNDDEVSSVMSAIDQIKKCNSLKIEDQAQMTPQDVREVASQKADKPHVIFIDYLTLMQSDVPQRDRRLEVEKISRDLKIIAKETGCIIIALSQLSRGVESRSDKRPMMSDLREAGGIEQDANMIFFLYRDDYYDQDQQDNITGKSEIEFIISKNKDGETGVAHLDFYKKTQRFYG

SEQ ID NO: 5398 - protein, 414 aa, Staphylococcus epidermidis
ETIMRDKFEITFIKNRRDLIMAKEKFDRSKEHANIGTIGHVDHGKTTLTAAIATVLAKNGDTVAQSYDMIDNAPEEKERGITINTAHIEYQTDKRHYAHVDCPGHADYVKNMITGAAQMDGGILVVSAADGPMPQTREHILLSRNVGVPALVVFLNKVDMVDDEELLELVEMEVRDLLSEYDFPGDDVPVIAGSALKALEGDAEYEQKILDLMQAVDDYIPTPERDSDKPFMMPVEDVFSITGRGTVATGRVERGQIKVGEEVEIIGMHETSKTTVTGVEMFRKLLDYAEAGDNIGALLRGVAREDVQRGQVLAAPGSITPHTKFKAEVYVLSKDEGGRHTPFFTNYRPQFYFRTTDVTGVVNLPEGTEMVMPGDNVEMTVELIAPIAIEDGTRFSIREGGRTVGSGVVTEIFE

SEQ ID NO: 5399 - protein, 44 aa, Staphylococcus epidermidis
YLIIRNQSIEWSAGEGFTCIRTTNDQRSKYRVERRRRIHLHKNH

SEQ ID NO: 5400 - protein, 158 aa, Staphylococcus epidermidis
VKPMKKALSKKAELDQKLPIEDALKQLSFFVQQDCSDWELDEPVPPLPPAKNFKGPIGRYETVLAIIKDKQPTVRELLGYLSAGGGHLTLIGTPEEIVDEMEQWFNEGVADGFNLMPPSLPHSLEDFLKYIIPELQRRALFKNSYNQSTLRTLLNLDS

SEQ ID NO: 5401 - protein, 229 aa, Staphylococcus epidermidis
KGVFCMNYFRYKQFNKDVITVAVGYYLRYALSYRDISEILRERGVNVHHSTVYRWVQEYAPILYQIWKKKHKKAYDKWRIDETYINIKGKWNYLYRAIDAEGHTLDIWLRKQRDNHSAYVFIKRLIKQFGKSQKVITDQAPSTKVAMAKVIKAFKLKPDCHCTSKYLNNLIEQDHRHIKVRKTRYQSINTAKNTLKGIECIYALYKKNRRSLQIYGFSPCHEISIMLAS

SEQ ID NO: 5402 - protein, 178 aa, Staphylococcus epidermidis
PLIIEGWFLMLINVLNLNDSQDGNRIKQGDLSHMRYILSDNNNEDLKLEGLPAKVFLTDSTGVKYIYDTTVRQYDNAYVCDVVINQIIPANTYSLEIWVDNKYVFPSDNKAKIQVTESVIGRQLINTQNHDLWQEMIEYGVKNGLIKNQTESEENFVIGENAPNDTTKIWIDTTGGNE

SEQ ID NO: 5403 - protein, 122 aa, Staphylococcus epidermidis
VRIMNKEQILQLIEQELIQADEAQTDTEFEKHMYAIHMLTSLVSSHQSRSTIEKLNHSKPMNSNIKDDYEMKQQSSQKHHVTAAEIEAMGGKVPQSMKKHHTSNNMMITDDQVGNGESIFDF

SEQ ID NO: 5404 - protein, 236 aa, Staphylococcus epidermidis
AHVIMIFFHMCWNTSLMVQYSLSILTFGEVIMNKPFIAIEGPIGVGKSSLAHRLSKTFGFYEEKEIVDENPFLSDFYDDIEKWSFQTEMFFLCNRYKQIRDIESLNQGIVSDYHIHKNKIFAKNTLDAKEFDKFSRIFDILTEDIEMPNTIIFLDADLDVLKSRIAQRNRSFESQIEDDYLLTLKKDYLAYYESLKNDGANVIRIDTSQQDFVKNDYDYQNILNLVKPMIGENKDE

SEQ ID NO: 5405 - protein, 202 aa, Staphylococcus epidermidis
GVVIMKREFLRGLGVEEDAIQKIIDEHHEGLQSYKEKVEKVDSLKEQLETANEEIKNRDNQIEELKNNVGDNDELKQELEKYKEQNANYDQKLKDVQLNKAIEVSLAKEKAIKPEQVIKLIDKDNLEVDDNGNVKGLDDYMSEFKKENEHLFEQSKPSGRTPDDGKNVNGGITQEEFNNMSVAERTNLFVNDRKTYDTLINN

SEQ ID NO: 5406 - protein, 228 aa, Staphylococcus epidermidis
MVVIKNYITEDDGTTTVVIKGVELDNKTSLLLDNGYEVEVDVRVVDPFKITDKQRRKVFALCNDIECATGQPRDYMRYMFMDYVEVLYGYEKRLSLSNCTREQASQIIEVIIDWVFHNNIPLNYKTSDLLKNDKAFLYWSTVNRKCVICGKPGELAHHKAIGRGANRKKMDHYGYEVLALCREHHQSQHDMGVETFDKLHHLENSWLSVDERLNKMLKGVKNEFESNN

SEQ ID NO: 5407 - protein, 192 aa, Staphylococcus epidermidis
RCKIMKGLIIIGSAQVGSHTNALSKYLKGQLGEHDVEVEIFDLAEKPIHQLDFAGTTQAVDEIKNNVKSLQSKAMEADFLILGTPNYHGSFSGILKNALDHLNMDHFKMKPVGLICNSGGIVSSEPLSHLRVIVRSLLGIAVPTQIATHDSDYAKLEDGTLYLEDNEFQLRAKLFVDQIVSFVTNSPYEHLK

SEQ ID NO: 5408 - protein, 60 aa, Staphylococcus epidermidis
YKKITLKDGLLFKKMFIETEDFMFNYSTSKALLSDFQNNNFNYFIQNKKERVIFEDGHFL

SEQ ID NO: 5409 - protein, 225 aa, Staphylococcus epidermidis
LEKIKMNNYGIPQNAVITIAGTVGVGKSTLTQALADKLNFKTSFENVDHNPYLDKFYHNFERWSFHLQIYFLAERFKEQKRMFEYGGGFVQDRSIYEDVDIFAKMHEEQGTMSADDYHTYYELFNAMVMTPYFPKPDVLIYLECDYDEVIDRIQQRGRDMEINTDPEYWKKLFKRYENWINNFNACPVVRLNINEYDIHEDVDSLDSVIDKIAQVIKAYRQVDTR

SEQ ID NO: 5410 - protein, 901 aa, Staphylococcus epidermidis
INEIGGNVLAKLLYKLGKFIAKNKWLSVIGWLVILGVIITPLMINSPKFDSDITMNGLKSLDTNDKISKEFHQDSEKASMKIVFHSNKNDGLNNKDTKKDIEDALDNIRQNDDYIQNISNPYDSGQVNDEGDTAIANVSYVVPQTGLKDSSKHIIDKELKDVTDNHNVQIEKTQGGAMNSEPGGTSEIVGIIVAFVILLITFGSLIAAGMPIISAIIGLGSSVGIIALLTYIFDIPNFTLTLAVMIGLAVGIDYSLFILFRFKELKKKGVDTVEAIATAVGTAGSAVIFAGLTVMIAVCGLSLVGIDFLAVMGFASAISVLFAVLAALTLLPALISIFHKSIKIKDKPTKSKDPKDHSWAKFIVGKPVIAVIVSLIILILAAIPVSGMRLGIPDDSLKPTDSSEYKAYKLISDNFGEGYNGQIVMLVNTKDGGSKSTIERDLNNMRSDLEDIDNVDTVSKAQLTDNNNYALFTIIPEKGPNSQSTENLVYDLRDYHSQAQEKYDYGTEISGQSVINIDMSEKLNNAIPVFAGVIVVLAFFLLMIVFRSILVPLKAVLGFILSLMATLGFTTLVIQHGFMGSLFGIENTGPLLAFLPVITIGLLFGLAIDYELFLMTRVHEEYSKTGDNDHSIRVGIKESGPVIVAAALIMFSVFIAFVFQDDSAIKSMGIALGFGVLFDAFVVRMTLIPALTKLFGKASWYLPKWLGAVLPNVDVEGKALEEDNHHDTSSEKGHVNDKNSEYSRQDKDNYVYQNDKRNYNRNYNDEDYNRSVHLNNHHDQHHRQHQYDNQRDDIDYESLYTQDGDHTHHDERNYNDRHYQDNYDRNDDYRHNNHDHQNDNHDYHDSNFDKTTNLYKELTDSNIDQDVLFKALMLYARENNKGVYDRYNRSSQHRHDDELRD

SEQ ID NO: 5411 - protein, 169 aa, Staphylococcus epidermidis
VEEIRPITYQDKEAYYYYIQEWYENEEKVVPGNTDIANYSSFNNMVDRLNCSEVDEGFVPTTTLFYFKDSIIIGAVDIRHQLNDKLSNIGGHVGYGVAKSYRGKGYATILLEKALDELKTLNVEVVLMTCNPLNFASQTVMKKCGGYQIESYIKKNGKPVHRYHIPNTK

SEQ ID NO: 5412 - protein, 355 aa, Staphylococcus epidermidis
KLRIQLLLELLIMINQVYQLVSPRQFEATFKTIDLHNHNSKVIVRPLYLSICAADLRYYCGNRDSKILSKKLPMSLIHESVGEIVYDSEHRLKNGTKVVMIPNTPSKSHNIIAENYLTSSHFKSSGYDGFMQDYIVMKPDRVVTLPQEIDLSVASYTELVTVSVHAIDRFQSKAIPQFESLGIWGDGNLGYITAVLLKKLYPTTKIIVFGKTLYKLSRFSFVDEIIQIDNIPQHIKIDHAFECVGGKGSQQAIEQIINIINPEGSIALLGVSELPIQVNTRMVLEKGLTIIGSSRSGLKDFEKTIELYRKYPEVLNQLALLKGKEFEINTIEDLITAFEYDISNAWGKTVLKWNI

SEQ ID NO: 5413 - protein, 147 aa, Staphylococcus epidermidis
IRRIRMTNLTILTGRITKDLELKQAGQTQVTNFSMAVDNPFKKDDTSFFDIVAFGKTAQLLNDYCGKGSKVLIEGNLKQDRFQDKEGHNRSVVRVIANRIEFLDSKGSNQQNNQPQKQQEQTTETKSKNPFANASGPIDITDDMLPF

SEQ ID NO: 5414 - protein, 247 aa, Staphylococcus epidermidis
RCLILKIINLDSKNLASFYVACELFKQIQQHPHAKLGLATGGTMTDVYHYLVNLLIKNKVDVSQVETFNLDEYVGLKASHQQSYHTYMNKVLFEQYPHFVKNHIHIPDGLSENLEAEAERYNNLLDERGPIDIQILGIGENGHIGFNEPGTDFNSETHVVNLTESTIKANSRFFDNEKDVPRQAVSMGVKSILKAKRIILLAFGPKKKEAISKLLNEQVTEDVPATILHTHPNVEVYVDDEAAPDCL

SEQ ID NO: 5415 - protein, 269 aa, Staphylococcus epidermidis
LFVIEFDMNPIKILKKERIIMSEAAETLDGWYSLHLFYAVDWTTFRLIAEDDREAMITELETFIKDKTVARESHQGDHAIYNITGQKADLLLWFLRPEMKELNQIENEFNKLRIADYLIPTYSYVSVIELSNYLAGKSDEDPYENPHVKARLYPELPHSEYICFYPMDKRRNETYNWYMLPIEDRKTLMYNHGMIGRKYAGKIKQFITGSVGFDDYEWGVTLFSNDVLQFKKIVYEMRFDETTARYGEFGSFYIGHILNIEDFKQFFSI

SEQ ID NO: 5416 - protein, 193 aa, Staphylococcus epidermidis
ENQIMPSANQKRMIKHIHETVFILLHDYHFDEITVQKICDIAEINRSTFYRYFQDKYELLYTLPDFITQQIIAKSDTSADITTPESFEDFIYYIGNNKKIFKHLLVSSRQADVFRSLTNVSREMMLNNPTRKRAPLAQKIRESKHPEIVADFYSSGVIEVLRRWVENDYNYTVEEVFVTLNNVLETSLYCYDK

SEQ ID NO: 5417 - protein, 437 aa, Staphylococcus epidermidis
CGQINNKSKRLRWCISMMISIKLSELLPKHFHSLWKATKDREKLNIVAKGGRGSGKSSDISIIITQLIMRYPMNAVVVRKTDNTLATSVFEQIKWAIEEQKVSHLFKVKVSPMEITYVPRGNRIIFRGAQNPERLKSLKDSRFPFSIMWIEELAEFKTEDEVTTITNSMLRGELDDGLFYKFFFSYNPPKRKQSWVNKKYETSFQPDNTFVHHSTYLDNPFISKQFIQEAESAKERNEQRYRWEYMGEAIGSGVVPFNNLQIEKIPDELYDNFDNIRNGADFGYAADPLAFTRWHYDKKKRILYAMDEIYGVQMSNREFAKELWKRGYQSDEIYCDSAEPKSIDELKKEHGIKRVKGVKKGPDSVEYGEQWLNDLDAIVIDPNRTPNIAREFENIDYETDKDGNVKPRLEDKDNHSIDSCRYALSRDMRQNKLSILT

SEQ ID NO: 5418 - protein, 427 aa, Staphylococcus epidermidis
LEGIKVKTQVLYGKSEIEINVPDDSTIIEPQNIDAIQDYESTIKNVLRNPTNSKPLKEMVNSNDIVSIVISDITRPTPNHILVPLLIEELNHVPRENFVIINGTGTHRDQTRDELIQMLGEDIVNSVKIVHNHCSEKESLAKVGHSQYGCDVYLNKAYVESDFKIVTGFIEPHFFAGFSGGPKGIMPGIAGLETIQTFHNAKMIGDPRSTWGNLEDNPVQDMAREVNRMCKPDFLLNVALNKSKEITAAFAGEILDTHKEGCAYVKDHAMFKCEQRFDIVIASNSGYPLDQNLYQTVKGMSAASKVVKKDGHIIMVSECADGFPDHGKFAEIFKMADTPQGILELIHNPNFKEVDQWQVQKQASIQTFANVHVYSELTDQQLKDSMLIPTSNIEHTIQELEHRYGRKLTIGVMPQGPLTIPYVEDKE

SEQ ID NO: 5419 - protein, 111 aa, Staphylococcus epidermidis
LVVFILSEVGVYMTESSQRGDYERRIKRLEDNDEKIFNSLEQIKDGQHNQNLINQKMNFTLDSINRERELESQNKKENQKNIKDIKMWVLGLVGTIAGSLIVAVLRMFFGV

SEQ ID NO: 5420 - protein, 114 aa, Staphylococcus epidermidis
QMNFKQMHQFNYRLPELLTNYLHLIHSTSEPRMCHAMKKGEIHDYCISHYYIFYYSNFNNLATKRIRYRDFCSHRRAFSYRYWSSECLRYIRSDKYSLKCHTYLCRSYPYFINP

SEQ ID NO: 5421 - protein, 85 aa, Staphylococcus epidermidis
FVNVKKEGLIMRFKLKEDEILEFLDLNFPQQTFEKGRLLIGQNKRQPLHVYYFGKKFLALLNVNFNTFEYIKVDEVDYNDIKKSL

SEQ ID NO: 5422 - protein, 462 aa, Staphylococcus epidermidis
IGGVSMAKKKVIFECMACGYQSPKWMGKCPNCGAWNQMEEIVEKVAHPKHGVKTKETAGKVQKLNSVKHEATPRLLTESKEFNRVLGGGIVSGSLVLIGGDPGIGKSTLLLQICAALSQNKNVLYITGEESINQTKLRADRLEEDSSHLNVLAETDLEVIHQTVKEERPDLLVVDSIQTIYHPEISSAPGSVSQVRESTQSLMNIAKQMNIATFIVGHVTKEGQIAGPRLLEHMVDTVLYFEGDEHHAYRILRAVKNRFGSTNEMGIFEMKQSGLKGVLNPSEMFLEERSTNVPGSTIVPTMEGTRPLLIEVQALVTPTTFNNPRRMATGIDHNRLSLLMAVLEKKENYLLQQQDAYIKVAGGVKLTEPAVDLSIIVATASSFKDQAVDGLDCFVGEVGLTGEVRRVSRIEQRVQEAAKLGFKRAIIPQTNIGGWTFPEGIQVVGVSSVHEALKYALHSKQR

SEQ ID NO: 5423 - protein, 48 aa, Staphylococcus epidermidis
LFFVFQYKYYMIFNFATEPYLLLRKKYLRQQMMSQVLNLSLKLFFNWE

SEQ ID NO: 5424 - protein, 69 aa, Staphylococcus epidermidis
KFYVVGKCNTLEKLLVKIACIKEIYKKTGSVAKLKLYAHLYKTIKANIVLTVKSFISINYFSFFSINIT

SEQ ID NO: 5425 - protein, 484 aa, Staphylococcus epidermidis
HTYVNEVISINWPWDKPYHEQVVEQIKPKYETQEEMILRLVREHKENIDNITMGERYYNHHPDILDAPFKRDVNGDYDETKPDWRMYTNYHQNLVDQKVAYAVANPVTFGVDNDKALKQIQHTLNHKWDDKLVDILTAASNKGIEWVQPYVDEEGEFKTFRVPAEQAVPIWTNKERDELQAFIRVYELDGAERVEYWTKDDVTFYELKEGQLIPDFYRSEDHIQPHYYQGNKLMSWGRVPFIPFKNNPQEVSDLFMYKTIIDALDKRLSDTQNTFDESVELIYILKGYEGEDMKDFMHNLKYYKAISVAGESGSGVDTIKVEVPIDSVKEYTKMLRDYIIEFGQGVDFQQDKFGNSPSGIALKFMYSNLDLKANKLKNKTLTALQELLQYIIDFYRLDVKVQDIEITFNFNVMVNELENSQIAMNSTGLLSKETILSNHAWVEDPVAEMERIEQENIELNQQLPDIEEGLNGEQQRQSKNNQPE

SEQ ID NO: 5426 - protein, 135 aa, Staphylococcus epidermidis
DLNVAKHMNVKLLNPLTLAYMGDAVLDQHVREYIVLKLQSKPHRLHQVSKSYVSAKSQAKTLEYLLDIDWFTEEELSVLKRGRNAKSYTKAKNTDIQTYRKSSALEAVIGFLYLDHQSERLENLLETIVRIVDER

SEQ ID NO: 5427 - protein, 479 aa, Staphylococcus epidermidis
KDSLKKLRMERFKMITLYNTLTRRKETFEPIEPGKVKMYVCGPTVYNYIHIGNARPAINYDVVRRYFEYKGYEVIYVSNFTDVDDKLINRSKELNESVPEIAEKYIKAFYEDVGALNVKKATSNPRVMHHMGEIIDFIKELVDEGYAYESDGDVYFRTRQFDGYGKLSHQSLDDLKVGARIEAGEQKEDALDFTLWKKAKPGEISWNSPFGKGRPGWHIECSVMAYHELGSTIDIHAGGSDLQFPHHENEIAQSEAHNHAPFANYWMHNGFINIDNEKMSKSLGNFILVHDIIKEVDPDVLRFFMISVHYRSPINYNLELVGAARSGLERIRNSYKLIEEREQIASDLEEQSEYIQQIDKILNQFETVMDDDFNTANAVTAWYDLAKLANKYVLENTTSTKVLNRFKEVYSIFSDVLGVPLKSKETEELLDEDIEQLIEERNEARKNKDFARADEIRDMLKARHIILEDTPQGVRFKRG

SEQ ID NO: 5428 - protein, 183 aa, Staphylococcus epidermidis
TSSVRGKVMKKRYLIIDGYNMIGQSSTLSTVAKENLEEAREQLLDTIANYNALIADEIVCVFDAYEQSGIEREYFYHGVKTIFTKEKETADSFIERYVYELYNKHTTHITVVTSDMSEQHAIFGSGAYRISSREMWRELKENEVVVNKSLDDFSEKKPRIRIPLSNEILEEFEKIRRGNQKKD

SEQ ID NO: 5429 - protein, 362 aa, Staphylococcus epidermidis
EATVMSEKVKFEKRESLKEKPDTANLGFGQYFTDYMLSVDYDADQGWHDMKIVPYAPFEISPAAQGLHYGQAVFEGLKAYKHNGEVVLFRPDQNFKRINNSLARLEMPEVDEEALLEGLKQLIDVERDWVPEGEGQSLYIRPFVFATEGVLGVRSSHQYKLLIILSPSGAYYGGDTLKSTKIYVEDEYVRAVRGGVGFAKVAGNYAASLLAQTNANKLGYDQVLWLDGVEQKYVEEVGSMNIFFVENGKVVTPALNGSILPGITRKSIIQLAEDLGYEVEERRVSIEELFNAYDKGELTEVFGSGTAAVISPVGTLRYEDREIVINNNEPGKITQKLYDTYTGIQSGKLEDKYGWRVEVPKY

SEQ ID NO: 5430 - protein, 125 aa, Staphylococcus epidermidis
FKGVNVLEPIKEQEVLDLLTSYSNQPVYLHVETTNGAYANHFDQRVFNAGTFLRNIVVTFEHAQLKGGDKDPYRVGLKLKDGGWVYVQGLTHYEVNENNEFLIAGFNYEGQLAATIEISKQPFTI

SEQ ID NO: 5431 - protein, 41 aa, Staphylococcus epidermidis
ETLVISLVIGFVCSFVFLGVLSLEGLDGVLLGFDGFLVSAW

SEQ ID NO: 5432 - protein, 314 aa, Staphylococcus epidermidis
LLMVKQVRLGKSDVNVFPIALGTNAVGGHNLYPNLDEEQGKEVVRQAIDNGITLLDTAYIYGPERSEELVGQVVKEYPREKVQIATKGSHVIKENEEVVQNNDPEYLKQQVENSLERLQVDYIDLYYIHFPDDDTPKDKAVAALKELKDEGKIKAIGVSNFSLEQLKEANKDGYVDVVQLEYNLLHRENEEVMAYAAENNITFVPYFPLASGILAGKYDENQTFEDHRAERPDFQPDVFKDNVRRVKALTDIAEAHDTTIANVVLAFYLTRPSLDVVIPGAKRAEQVVENIDAANIELSQGEIDKIDSLFPIKK

SEQ ID NO: 5433 - protein, 41 aa, Staphylococcus epidermidis
NTAVIYIFIIRNSLVTIFLMNIVIISTIYVIRILRNVERIN

SEQ ID NO: 5434 - protein, 49 aa, Staphylococcus epidermidis
REAVNGFENVLDIVGTNPICDVTCAIADKLIIGSNQKAGIVVLSLALKA

SEQ ID NO: 5435 - protein, 163 aa, Staphylococcus epidermidis
SKKVKKEVISMHNMSDIIEQYIKRLFEEADEDVVEIQRAHIAQRFDCVPSQLNYVIKTRFTNEHGYEIESKRGGGGYIRITKIENKDATGYINHLLQLIGPSISQQQGYYVIDGLLDKGLINEREAKMIQTIIDRETLKMDVVARDIIRANILKRLLPVINYY

SEQ ID NO: 5436 - protein, 146 aa, Staphylococcus epidermidis
DMWVSVERYLFNKIYNKLKSNPIINKQLDGRVFDCVQKDAVYPYIVVGETNVTNKETTTSMFEDVGVTLHVYSQARNRDEASQIIQYLGFVLNSEIEINNYSFIKSRIDTQEVITDIDQYTKHGIIRLVFKYRHNTLQRSVTNGAE

SEQ ID NO: 5437 - protein, 56 aa, Staphylococcus epidermidis
WYLLNYTKAPYFSKYFNIKLHINTKYFGETLEGTGQAEDYRLKLSPKKASQQYELF

SEQ ID NO: 5438 - protein, 54 aa, Staphylococcus epidermidis
LSLFYKHCNIIKTYNINKTNKHLKIIYTKIHTTNYIYLFIIKKFKITSHLQTSL

SEQ ID NO: 5439 - protein, 158 aa, Staphylococcus epidermidis
RLILKRGKHVMLKRRSSKFLGLLATLALAIVLSACGNSGNGSGSSDDSQTSLGNKEIEISYIASDNSTPRSLVIAEVLKKAGYDVTTTPVTASGPLYAAVSENSDSFHASGIFPTTDKSYYDKFKSKLTIYDDKHLIDNAKVGLAVPKYVQDVDSISD

SEQ ID NO: 5440 - protein, 618 aa, Staphylococcus epidermidis
LPILLKTLQGIGQSLPVETKLNEKLNEDGSLEIEMVENKATFDAIGAITKMWTITGVGGADDLNEYRIVMLDKTTVGQKEKLTIKARPVELDDLNNLRVYEVYNGSFTGKRYFDLVFKDTGYKYELHAKVSSSKFENLGNHDTNLELFKKGLERYDLEYEYEPKTKTFHLFDVVQRKADYYIKAGVNANNVKVQEDASKCYTYIRGYGGFDDQQTFNEASLQYEYTHPLADLIGKRHAPPVVDGRMTKGDTLKKAMELVIQESLKTSVTLDFISLQKHFKEAVPRVGDIVNVVDDLIGLNEFVRIIEITTHRDIYNKIIKQDVVLGEFRLQDRYMKAVNTAANYVKAIKSNKSDPAKDLRSMQAQTQANTKTTQDLQKKTDDIKKRLESAHAKSVTTANGTIVHDFTPKSKIRKVKTIGTIGDSVAKGTGAKTNFTQMLAKKIKAKSTNLAVSGATISTNKDNSIYEQATKIKGDLIIVQGTDDDWTNDIKIGTDKTDIKTFYGAFYSAISKIKSNNPKSKIIVMTPTKQCYIKDGKVVRKDTTKNDLGYTLADYVDVQIDACNELDIPVYDAYHSTQFKPNIPSYRKSSMPDGVHPNEKGHEVIMYELVKNFYGFYG

SEQ ID NO: 5441 - protein, 574 aa, Staphylococcus epidermidis
NGIFKEKETTMTKQNIFIDDIYWERVQLFVKGHFEGVKPTRNFLLRNLTETKLLNANHVNIQGSTFEARFNIAILEKGNFLGTGNYILINRQEDEYVCQINPKFLNDKKNQMTLEELRDYNSLETQSLQKSYLLKKYGKSFQRYNNKEIKSYVIVPAISQEINEFIFKVQYKSEIKKISKLKQLSYILHKALRKISFNVRDKIYLSVFNISKTVYKNNKNHVLFTSDSRANMSGNFKFIYEEMLKQQLDKKLVIHSIFKPNIANRRSFIDKLKFPYFLGKSKYILVDDYHPMIYKLQFRENQEIVQVWHAVGAFKTVGFSRTGKKGGPFIDSIGHRNYSKAYVSSNNDILYYAEAFGIEEHRVIPTGVPRTDVLFDESYKTRIKQSLETKLPIIKNKKVILFAPTFRGNGHRTAHYPFFKINFARLASYCEEHQATVLFKMHPFVRNKLNIPAIYSKYFLDISNYREVNDVLFITDILISDYSSLIYEFSVFKKPMLFYAFDLEDYIYTRDFYEPYETFVPGKIVKTFDELILALENNDFELEKVKPFLNKNFKYKDGKSSERLVKDLFNKFFQ

SEQ ID NO: 5442 - protein, 94 aa, Staphylococcus epidermidis
FCVFLTITSPDCRLISSTCLNVLINKCLLFKVQFRHRILPPTLTVKHLYLTYKKKTLHKQCLMIMFCYLFEFMYSCHISMSHQYIKKLPVCSHG

SEQ ID NO: 5443 - protein, 128 aa, Staphylococcus epidermidis
RSTFKMMKVFIILGALNAMMAVGTGAFGAHGLEDKLSDKYMSIWEKATTYQMYHGLGLLVIGLISGTISINVNWAGWLLFFGIVFFSGSLYFLALTQVRILGAITPIGGVLFIIGWLVLVIATLKFAG

SEQ ID NO: 5444 - protein, 307 aa, Staphylococcus epidermidis
KIKFKHIKRNINSDILVKNMNSDVVQKSVDNAVKDNLSHKVVKDAMSIIRNIMKYIQRKYKLTDISYLDDIVIPKKATTREEVKAKRENYLEMDEVKAIVDNLHEIANSKRADYMKRSFIMTAYIMEFQALNGMRIGELLAIQPNNIDFDKKTLEIDGTIHWRNEGNAVGFKDTTKTESSYRTISLTTRSCDILRKVMLENKKAIQWESMYQDRGFIFTNYRGNPMSLSTINRNMQQSANNVGITKHITSHTMRHSHISLLSQLGISLKAIMQRVGHTDHKTTLQIYSHVTDQMDKDMMNKLEKVGN

SEQ ID NO: 5445 - protein, 267 aa, Staphylococcus epidermidis
IFFSLKSFPKKNSKQIKEGLKVNELQTFNFEDLPVRTLSIDDEPYFVGKDVADILGYSRGAKAIQDHIDKEDIRVVPIQDRTGRYQKASLINESGLYTLVIDAVRQSNNRDIKKKAKAFKRWITNEVLPSIRKTGSYQVPDNPMDALKLMFDAQKQTKEEIATVKADVIDLRENQKLDTGDYNLLSRTINQRVAHIQKIHAITNQKQRSELFRDINSEVKKMTGATSRTNVRQKHFDDVISMVANWFPSQATLYRIKQLESNLEKGQ

SEQ ID NO: 5446 - protein, 59 aa, Staphylococcus epidermidis
PRKFHIEIQQNRQVLFEVKRGQQIQFEFNLTTILFNKNTFQTKVKMTLLENDIYSITNL

SEQ ID NO: 5447 - protein, 87 aa, Staphylococcus epidermidis
IMKFTIEMVNEYLTIVNDENPIHRSIVPGQLICEKVFSELNVNWMNYKIKYLKPINIDEEVQFLIKENDEIVVFKTYDDTKLTITRS

SEQ ID NO: 5448 - protein, 262 aa, Staphylococcus epidermidis
SSVSYNCHVIYNTIVYVTIINIKIIFRRELKLEWILFDKDGTLIEFDSSWEKIGVRLVDQLLETFPVHDKEAAHRQLGIIDKKIKPDSVMGSGSLGEIIESFNGVTGKETSDWTKDTSQELIDSRVPENNWIDGVQETIQALRNEGYHIGIVTSDTKKGVDQFLEETQTRNLFDLVISTETHAEEKPHPKVLDPLFNAFDVKPEKVAIVGDTANDMKTAINAHLGLAIGVLTGVAKKEELYDADVIINSAKDVKQVIEQYGK

SEQ ID NO: 5449 - protein, 71 aa, Staphylococcus epidermidis
SSYSSRYTLGYLYRLNNFFKIKPLTINYRIYLHILIVVIVIILLMYNLQSILINIWLFIIHTINSRSENNE

SEQ ID NO: 5450 - protein, 102 aa, Staphylococcus epidermidis
VCYSSIKIDDQTKKYRKKETMIMDFVEQAVKEIKEKIGKELDLEKETYLLQTPSAYMQIGLEEDDDDERKLNVQVTGGNITCLKTDKDIFKDLYVNDDENDN

SEQ ID NO: 5451 - protein, 511 aa, Staphylococcus epidermidis
IMELEKVGKLDLNEEPYLQPISNRGIGFYNLDKNTAKFQFVVQKDNKPLLISDKNVKGYAFFKAANGTEEKRPSTSGVLDVEFIDPMKGLIGVTVPQWFLKNVVDSEVLGEIYLSLNDVNNVGKDDTVVLGTFKFTVRDSLINQIESDIKVSYIRMFDELRSELEKKVQQLKQDIGDTQTLIESIKQTAEEYLIKINKAQADAIVSITDALISSNQSIDLEREEALRQIDAKRDAIKTDYDLASDTFQKTYDSNVDAFNSNVNQANTTIDEKLQIFNETLERDGFTTPEYVESKFTEKDWQKFKLTNDDGTNFYDANLQIDFDNNEQLMSLPIGTRYVVLTLNNPAGTNNNGWLTKYKRNGDAVLIQYQPYNSTVIYQKRFYKSWSKWERVGSDVVDTGWIDLQLVNSASPHNDLVSKGGFTSAYRTITQNGVTKKMLRINATTIKHGQTIALLPKEFVKNLMFFSISAPRNKNSGRISLNTSGTVNFDATVDPSAWTDTDYIYGQYEWTE

SEQ ID NO: 5452 - protein, 133 aa, Staphylococcus epidermidis
SSGHYNKLKIISILKRRNNKMSNLEQNIKQMKNEVIEAELNTKINTVITMIGEHMDSNERFKSHLDAQGKVMESYMLKEYYQNYYVLMAVLNSILKDVNFMNDEITTFHDRALDELDKTKASSENFGEESLNA

SEQ ID NO: 5453 - protein, 52 aa, Staphylococcus epidermidis
NHCFINFYKFFPYTITHYDKRTYVLLNLRFNPLTKIKHLAFFSFYIGATHYM

SEQ ID NO: 5454 - protein, 69 aa, Staphylococcus epidermidis
MNNNQFKVIKEIYNTLQKTIEDKSTEYKHKIKDGNNEWIETVNREEHLQALIEWALQQIENNFDFEEEK

SEQ ID NO: 5455 - protein, 60 aa, Staphylococcus epidermidis
KLSKNRLIIFYNLPCMLLLFISSEEGITPFILFKGKSYRVTIIINQFCNSNSYPFFHKMK

SEQ ID NO: 5456 - protein, 215 aa, Staphylococcus epidermidis
MNMNIEIIANQFETRAATLLRYYTGLLESSRDNHFAFKIYNDPFDMVYVMMNGKLFGHVYIKDCKVRNSFELASSKHTEGQIRSIEGYYNGFEIHDDKHLSISDMMARQLFEDEYFMYGLETFAESNNTDMFTYIEGGLNVEELEGVQSSNADVIGNIEILYQLATGINEPASELVESLKLVTAFVQDENATQDDYKTLERKLSELKTSYYSVSK

SEQ ID NO: 5457 - protein, 291 aa, Staphylococcus epidermidis
KLSEIKLEYDTQVSVIWYGTLDSRSFKQFSQPKWSELVNRLSIPQNNTNKYARGVAVYGDMKDDTDENGNEYKKYRKDGNVIYRDVLVLDYDDIPKLRLLHDAITETLKGVSWMYHTTFNHRTESPRIRLYIALSERISADDYRKYTKVLANKIGHLVDEGSFQPSRAMALPVYIKGKHPFLHQYNDAPILNVEMLEKWSKETNIQTDQPSKTNFNKRDDTYWRDISFSVTKGNRNNSLASLIGHLFSRHVNEYIVYSYALLWGQNACNPPLNEREINATFQSILKKHRNK

SEQ ID NO: 5458 - protein, 54 aa, Staphylococcus epidermidis
SPVSPHLIFISGYSQTLVTAAFNEFSTRCTRIFYNRKPVLYEYSYKQLTLIKCH

SEQ ID NO: 5459 - protein, 145 aa, Staphylococcus epidermidis
KLSGDSLGTSTHFEKILKKFWRLHMDKEQLKQHMYDYVKEHKEIPIYQLEDLFKELDHDYKGKASVTNEHDKNIVFWSGWNKLTMYALIELVKGEHLDLIYRASYVMRYLLDGRVPSLPLAITYPEYGQQTEVPSWVPMLLRVTK

SEQ ID NO: 5460 - protein, 575 aa, Staphylococcus epidermidis
VERGKYMELTKDDILHEIEKTKQEKDAIHEVIPKGYEIEQHQNGVALYQIIPSKKDGEPDKKIFITNTIPQITERFEDIESNEVSYNMLFYDNQIPVNLGVSAEEIADSRQLLKLVNRKFDVTSTTSTRLVDYINKSKRHNPPVNIKVATRLGHVKGYFIYPYKEEMKNRNIKLFNNDKGFQKLIDSFQSKGTLESYSEHVFSKIKSLPMVMVMLYASLGSVLLREFELQPFIVEISGSTSTGKTFTLNLVSSVWGTSNLITTWSSTNNSIEAMASFLNSFPMFKDDTRNTHPKFVANATYNFSSGESKSRSNINLTLNAKKEWRNILLSTGEASISNMADEKAGVSARVVTLQDQPYPDNFDFTTLDKAFRDNYGTLGKVFIKQYQSKQESYKNAFESYQRYFNQKGSNEIMQRLGHAFALLQVSGEILNDIEGFEHDHFKIIEQAYNSMVRNNKTIDKPKQLLEELLQYLDANRNNIAGEGYSSVKNGDIKAIYKRDYLCILGETVKEKLRYEMQTITGQWDKKGYLIKGEKDRLQKQVKHETVKYRGFAIRQEVLEELGFDFSNSYNPNSDY

SEQ ID NO: 5461 - protein, 59 aa, Staphylococcus epidermidis
LLFIYSTSKNNPYADAKIKIAKAIKTSNIKATDKVIKIIIPIYRKCNFIFSTPFYIQSL

SEQ ID NO: 5462 - protein, 53 aa, Staphylococcus epidermidis
LYYSKFTLKTQTYVLVLTHFILCLTTLKIIVLSTFISFFHILSHTMIKERMFC

SEQ ID NO: 5463 - protein, 45 aa, Staphylococcus epidermidis
PSCSNLEIIESIESRDILARTVVVTGSKKDRAMFSVFSTPKCVTQ

SEQ ID NO: 5464 - protein, 61 aa, Staphylococcus epidermidis
DLISVELYYCTLENKKGASFNETPFCYSVLGGIRTPDRWLRRPLLYPAELPGHFQHKNYYI

SEQ ID NO: 5465 - protein, 48 aa, Staphylococcus epidermidis
ETISPASKLRFNPPKVEAQNVQPILHPTCVVTQTEFPYSCLIKTVSIV

SEQ ID NO: 5466 - protein, 220 aa, Staphylococcus epidermidis
NSSSLQTFKIFKSSICNNKTLIFYKYGYKSLLKFYLKGCHYMGIRSKLTNNITNKVGNSLLNIEEIKEKGDLPTTQEELRQRRERAETLVKKKSLLSSGASIVPIPGLDFGVDLKLMRDIIEDVNKIYGLDHDQVNSLSDQVKERIMSAAAIQGSQFIGRKVSEALLKVVIKDVAKRAAAKQTKWFPFVGQAVSASISYYFMSKLGKDHINKCEKVINNL

SEQ ID NO: 5467 - protein, 47 aa, Staphylococcus epidermidis
KFTSLIGFLFTQMFYPVILLINVCRTIDVFHDILKTIKRSSYIIILR

SEQ ID NO: 5468 - protein, 60 aa, Staphylococcus epidermidis
INDSNRFIHTSSPLFLQLPYIVSQYHITVDIYVYSSCKVIFLSLFYNHQKMTKARLPWSL

SEQ ID NO: 5469 - protein, 357 aa, Staphylococcus epidermidis
MKRFFQLIISAIVIGILCLMISHWFKSKDNTHSNEKLYVYNWGEYIDPSLIKKFEKETGIQVVYETFDSNEAMEAKIRNGGTHYDVAFPSEYTVQKLKKAKLLETLNHDKIPNIRNLDNDYMNLSYDPNNRYSIPYFFGTVGILYDKEKYPNETFDSWDDLYHSQFKNDILLVDGAREIIGMGLNKLGYSLNDKNPTHIYQAEKDLHNLAPQVRGIVGDEITMMLQQNEGHVAVVWSGVAAPLVQENTRYNYVIPKEGSNLWFDNMVIPKTAQNKEGAYKFMNFLLDAQNSAQNTEWVGYATPNKAARSKLPKKVRNDYRFYPSNQEQQRLEVYKDLGQTSLSEYNESFLNFKMSLK

SEQ ID NO: 5470 - protein, 318 aa, Staphylococcus epidermidis
FTISLYYMRNLRRGIMNKDQTLSHTTGRVSFKELQQIIKMALVQGNLIPAFAGAWLAIVMTNHSFLSSIPQILLMLVGSTLIMGGACALNNYYDQDIDRIMPSKQSRPTVNDRISDRNLLMLSFGMMLIGEACLFLLNIPSGVLGLIGIVGYVSYYSIWSKRHTTWNTVVGSFPGAVPPLIGWVAIDGSLSLAAVALFLVVFCWQPIHFYALAIKRSDEYALANIPMLPSVKGFKRTRVSMFIWLVLLLPLPFLLSNLGVTFVVIATLLNLGWLALGFTTFRKESNQTKWATQMFVYSLNYLVVFFALVVVVSLIKMI

SEQ ID NO: 5471 - protein, 457 aa, Staphylococcus epidermidis
VYGLECIKLLNYTELENKNVLVVGLAKSGYEAAKLLLKLGANVKVNDGKDLSQDAHAKDLESMGIEVISGSHPFSLLDDDPIIVKNPGIPYTVSIIKEAANRGLKILTEVELSYLISEAPIIAVTGTNGKTTVTSLIGDMFQKSVLTGRLSGNIGYVASKVAQEVKSDEYLITELSSFQLLGIEEYKPHIAIITNIYSAHLDYHETLENYQNAKKQIYKNQTKDDYLICNYHQRHLIESENLEAKTFYFSTQQEVDGIYIKDGFIVFNGIRIINTKDLVLPGEHNLENILAAVLASIIAGVPVKAIVDSLVTFSGIDHRLQYIGTNRTNKYYNDSKATNTLATQFALNSFDQPIIWLCGGLDRGNEFDELIPYMENVRVMVVFGETQDKFAKLGNSQGKYVIKATDVEDAVDKIQDIVEPNDVVLLSPACASWDQYHTFEERGEKFIDRFRAHLPSY

SEQ ID NO: 5472 - protein, 60 aa, Staphylococcus epidermidis
VLKSLGNPITSFISYTILFWANVFFITFLNALRENALEFVHNSNVPPGDKMLRAPSINKL

SEQ ID NO: 5473 - protein, 413 aa, Staphylococcus epidermidis
VKFLASQLFKGGFFIDYLGVDISKRSSVVAHYKNGKFQKEFFIQNNKNGYNYLLKYLNDLHHPQLIFESTGIYSRGMQRFCCVNQINYIQMNPLEAKFKTSTLRSWKTDQADAHKLACLGPTLKQTGNLPIHELIFFELRERVRFHLEIENEQNRLKFQILELLHQTFPGLERLFSSRYSIIALNIAEIFTHPDMVLDIDKDVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 5474 - protein, 574 aa, Staphylococcus epidermidis
IIMSKLIKGIAASDGVAIAKAYLIVEPDLSYDSNEKVTDIESEVEKFNDAIEASKIELTKIRNNAEAQLGADKAAIFDAHLLVLDDPELIQPIQDKIRNDKVNAATGLDEVTTQFISIFESMDNEYMKERAADIRDVSKRVLAHILGVDLPNPSLINESAVIVGNDLTPSDTAQLNKEFVQGFVTNIGGRTSHSAIMSRSLEIAAVVGTKSITEEVKQGDMIIVDGMSGDVIIDPTEDELIAYQNKRERFFEDKKELQKLRDADTVTVDGVHAELAANIGTPDDLSGVIDNGAQGIGLYRTEFLYMGRDQMPTEEEQFEAYKKVLETMDGKRVVVRTLDIGGDKELPYLDLPKEMNPFLGYRAIRLCLAQPEIFRPQLRALLRASVYGKLNIMFPMVATIKEFRDAKSMLLEEKENLLREGYEVSDDIELGIMVEIPATAALADVFAKEVDFFSIGTNDLIQYTLAADRMSERVSYLYQPYNPSILRLVKQVIEASHKEGKWTGMCGEMAGDQTAVPLLLGLGLDEFSMSATSILKARRQINGLSKNEMAELANRAVECSTQEEVVDLVNQLAK

SEQ ID NO: 5475 - protein, 684 aa, Staphylococcus epidermidis
FIMSKVHLIESPYALDKIKGIGPKRLALLEELNIKSVEDLVLYLPTRYEDNTVIDLNQADDQATVTVQGEVYSSPTVAFFGRNKSKLTVHLMINHIAVKCVFFNQPYLKKKLELNSIVTIKGKWNRNKQEINGNRIFFKDQKNQEDTHLEPIYRIKEGIKQKQLRDNIRQALSDVTIHEWLTDDLREKYKLETLAYTIQTLHHPINKQNLLRARRTYAFTELFMFELRMQWLNRLEKTSDEAIEINYDINKVKQFIDSLPFELTDAQKVSVNEIFRDLKAPIRMHRLLQGDVGSGKTVVAAICMYALKTAGYQSALMVPTEILAEQHAESLIQLFGNTMNVALLTGSVKGKKRRLLLEQLENGTIDCLIGTHALIQDDVVFNNVGLVITDEQHRFGINQRQILREKGAMTNVLFMTATPIPRTLAISVFGEMDVSSIKQLPKGRKPIKTSWAKHEQYDQVLAQMSNELKKGRQAYVICPLIESSEHLEDVQNVVALYESLQSDYGNEKVGLLHGKMSAEDKDQVMQKFSEHEIDILVSTTVVEVGVNVPNATFMMIYDADRFGLSTLHQLRGRVGRSEHQSYCVLIASPKTETGIERMTIMTQTTDGFELSERDLEMRGPGDFFGVKQSGLPDFLVANVVEDYRMLEVARDEAAELIQSGQFFEQQYSHLREFIKQNLRHIRFD

SEQ ID NO: 5476 - protein, 350 aa, Staphylococcus epidermidis
IYLFFIDSFPPYYVKSLRLKSLRLFLFRYRNNPIPCYALIIMKYGDDDMSIPIIIDTDPGIDDATAISIALSHPQFDVKMISTVNGNVGIEKTTANALKLKRFFNSSVPVHRGASQPLINDIFEATSIHGESGMDGYEFPQINQDDLTSIHAVEAMRNLLVNTQEPLTLIAIGPLTNIAILLTSYPEVQPFIKEIVLMGGSTGRGNVTPLAEFNIYCDPEAAQIVFNSGLPLTMIGLDLAREALFTHHFVKDFKDTNATSNMLYNLFQHYKSEDFEIGFKLYDVFTILYLLDPEAFNVKEAYTQIELNGNFTRGATVVDFNMEHPNCTVVLSPVERQYEDLFLNALSYCK

SEQ ID NO: 5477 - protein, 234 aa, Staphylococcus epidermidis
VSLLYEGKAKRVFTTNIDGQLRVEYKDEVTAGNGAKKDTMIGKGKLNNQITSIIFDYLTHNHIDNHFIKQLSQTEQLVQQVDIIPLEVVVRNIATGSITKRLGFKKGHTFEEPLVEFFYKKDELNDPLITDDHVKLLGIANDEEIKQLKQMAKDINQVLIQLMNEMSLRLVDFKVEFGKTNGGKILLADEISPDTCRIWDKNTDTNFDKDVYRNNTGSLIETYQTFLNKLEDLK

SEQ ID NO: 5478 - protein, 73 aa, Staphylococcus epidermidis
SQLFLRYFFFTLNPTPNVAMRSINVKIINGTLATPNAKLNKVKKMTANIEKIQKIPLDFFCCIPYPTFYLSFQ

SEQ ID NO: 5479 - protein, 68 aa, Staphylococcus epidermidis
NMSPSSKVYNSIVSEYISFSKSIMMYSLKLIYPLKINQICISFISAILILKRMIIVLKTEKIFNNYFI

SEQ ID NO: 5480 - protein, 249 aa, Staphylococcus epidermidis
RHMLNAQFFTDTGQHREKNEDAGGIFYNQTQQQMLVLCDGMGGHQAGEIASQFVTYELQKRFEEENLIEINRAESWLRSNIKEINFQLYNYAQENEDYRGMGTTLVCAIIYDKQVVVANVGDSRAYVINQRQMDQITSDHSFVNHLVMTGQITKDEAFHHPQRNIITKVMGTDKRVSPDLFIKRTHFYDYLLLNSDGLTDYVRDYEIQELLSSNNSLDVHGNELLDLALAHDSKDNVSFILLKLEGDKV

SEQ ID NO: 5481 - protein, 179 aa, Staphylococcus epidermidis
DIMLSVALDDIKKNGGTSLKKKYYISISLLMTIIVLVFDQVSKWLITISMKVGDSYEIIPNFLNITSHRNNGAAWGILSGKMLFFYIITIIILIVLVIFYIKEAQFNLFMQVAISLLFAGALGNFIDRVLHGEVVDFIDTNIFGYDFPIFNIADSSLTIGVIFVIIALIKDAIINKKEV

SEQ ID NO: 5482 - protein, 802 aa, Staphylococcus epidermidis
TIMLISNEWLKDYVNVDQSVQALAERITRTGIEVDDIIDYTKDIKKLVVGHVLSKTPHPDADKLNICQVDLGEEEPVQIVCGAPNVDEGQHVIVAKVGGRLPGGIKIKRAKLRGERSEGMICSLQEIGISSHVTPKNYESGIYVFPEAVKPGTDALEAIYLNDQVMEFDLTPNRADALSMVGTAYEVAALYQTKMNKPQLTSNESQESAKDELTIEVKNEDKVPYYSTRVVHDVTIGPSPVWMQFRLIKAGIRPINNVVDISNYVLLEYGQPLHMFDQEQIGSQSIEVRQAKKDETMRTLDGEERRLLDTDIVITNGKDPIALGGVMGGDFSEVTEQTRHVVVEGAIFDPVSIRHTSRRLNLRSESSSRFEKGIATEFVDEAVDRACYLLERYASGTVLKDRVSHGDLGSFVTPIEITADKVNRTIGFNLTDEEIIDIFEQLGFDTENKNGEITVNVPSRRKDISIKEDLIEEVARIYGYDEIPSTLPVFKDVTSGELTDRQFKTRTVKETLEGAGLDQAITYSLVSKNHATDFALQNRPTIELLMPMSEAHSTLRQSLLPHLIDAVSYNVARKNTNVKLYEIGRVFFGNGEGELPDEVEYLSGILTGDFVNNTWQGKKESVDFYLTKGVVERIAEKLNLQFDFRAGQIDGLHPGRTAIVSLNGKDIGFIGELHPTLAANNDLKRTYVFELNYDAMMEVSVGYINYEPIPRFPGVTRDIALEVNHEVTSSELLSIIHENGEDILNDTLVFDVYEGEHLEKGKKSIAIRLSYLDTENTLTDERVNAVHDKILEALKKHGAIIR

SEQ ID NO: 5483 - protein, 79 aa, Staphylococcus epidermidis
KNVTGGQKIMLNPPLNQLTAKVNSKYLIATTAAKRARELDEKRETALLDQYHSAKPVGKALEEIADGKIEPVVPKEYLG

SEQ ID NO: 5484 - protein, 44 aa, Staphylococcus epidermidis
YKSTLLFNLFYFTVDIYVKFSRIFIYPKEITQQFYDYFFERFAS

SEQ ID NO: 5485 - protein, 187 aa, Staphylococcus epidermidis
RYEFFYIKRGETMSERIILDEAAIQRTITRIAHEILEYNKGTKDLVLLGIKTRGAFLAHRIQDKINSIEQQLVPTGTIDITHFRDDVDKVVQQADQYAFDINVDINNKVVVIIDDVLYTGRTVRASLDAILLHTRPIKIGLAALVDRGHRELPIRADFVGKNIPTARDESVSVYLEEIDDRNAVVIE

SEQ ID NO: 5486 - protein, 44 aa, Staphylococcus epidermidis
LLATGPFALKTSIFEQPLSKISVPNNRSKDLNFDTFFDLLILQM

SEQ ID NO: 5487 - protein, 77 aa, Staphylococcus epidermidis
EDNTTMAVFKVFYQHNKDEVIVRENTQTIYVEGQTEEQVRRYLKDRNFNIEFITKLEGAHLEYEKEHSTHFNVENAE

SEQ ID NO: 5488 - protein, 97 aa, Staphylococcus epidermidis
RMNTIVKHTVGFIASIVLTLLAVFVTLYTNMTFHAKVTIIFGFAFIQAALQLLMFMHLTEGKDGRLQSFKVIFAIIITLVTVIGTYWVMQGGHSSHL

SEQ ID NO: 5489 - protein, 40 aa, Staphylococcus epidermidis
SVCTPTLLLGTMVMIPFTHDHFKIDKFKVIEFQYNFYHLG

SEQ ID NO: 5490 - protein, 79 aa, Staphylococcus epidermidis
TKLTRCLMYKDYNMTQLTLPMETSVLIPTNDISRHVNDIVETILETEFRHHRDAISYHPKIMLKVVLYAYTQSVFSGRR

SEQ ID NO: 5491 - protein, 41 aa, Staphylococcus epidermidis
TEPTLVMINSTSVGSTYTSSIVFISSIHSTMRIISDKSLMI

SEQ ID NO: 5492 - protein, 634 aa, Staphylococcus epidermidis
YNKTVAIKSGSIHKKGIYKMTNLREDVRNIAIIAHVDHGKTTLVDQLLKQSGIFRENEHVDERAMDSNDLERERGITILAKNTAIDYKGTRINILDTPGHADFGGEVERIMKMVDGVVLVVDAYEGTMPQTRFVLKKALEQNLKPVVVVNKIDKPAARPEGVVDEVLDLFIELEANDEQLDFPVVYASAVNGTASLDSEKQDENMQSLYETIIDYVPAPVDNSDEPLQFQIALLDYNDYVGRIGVGRVFRGKMRVGDNVSLIKLDGTVKNFRVTKIFGYFGLKREEIEEAQAGDLIAVSGMEDINVGETVTPHDHRDPLPVLRIDEPTLEMTFKVNNSPFAGREGDYVTARQIQERLDQQLETDVSLKVTPTDQPDSWVVAGRGELHLSILIENMRREGFELQVSKPQVILREIDGVLSEPFERVQCEVPSENAGAVIESLGARKGEMLDMMTTDNGLTRLIFMVPARGMIGYTTEFMSMTRGYGIINHTFEEFRPRVKAQIGGRRNGALISMDQGQATSYAIINLEDRGVNFMEPGTEVYEGMIVGEHNRENDLTVNITKAKHQTNVRSATKDQTQTMNRPRILTLEEALQFINDDELVEVTPESIRLRKKILNKSAREKEAKRVKQLMQDEQ

SEQ ID NO: 5493 - protein, 62 aa, Staphylococcus epidermidis
RIKTYPIVLELLTHLGVLIMKLFNAFKDILEAAITNDGTQLGASIVNIIESSVDMVNRFLGN

SEQ ID NO: 5494 - protein, 87 aa, Staphylococcus epidermidis
IMKTIELHITLQPQVLDTQGQALNRAVHDLGYEQVNDIRVGKVLYMTVNEPTDEAVDNIITTLSEKLFANTVIEEYSYKVIDEKEKA

SEQ ID NO: 5495 - protein, 155 aa, Staphylococcus epidermidis
NKETKGDNVMGEVKHLQINYKTDELFADFREFGNKNLYMIEELKGQMIDASSDSPFYGIFVGNKLVARMALLDKGEVEETYFPNSNDYILLWKLEVLDTYQRRGYAKQLLNFAKENKKPIKAIARNNSKEFFLKQGFKDVETKNPEGHDILIWNP

SEQ ID NO: 5496 - protein, 41 aa, Staphylococcus epidermidis
KKLTIEMQSSLNNYPFKTVRETEKGEVFLMDKSTYDYKKIM

SEQ ID NO: 5497 - protein, 46 aa, Staphylococcus epidermidis
IFMTNKEFEKKSAEKAKEVEEKLKEQNEEKTDDIEQTKKDIQDTLD

SEQ ID NO: 5498 - protein, 80 aa, Staphylococcus epidermidis
IIYLIRFEIISFIFEFLTKRSLELKVLKLVKRDNFYIISYRNCLFYNFQTIISLLIYYLTYISSFNTNHIPSITSQLFLV

SEQ ID NO: 5499 - protein, 47 aa, Staphylococcus epidermidis
LFKAQAPPIISVEPTSINSICGMEDRKEWFVITIASHAPAKAGIKLP

SEQ ID NO: 5500 - protein, 65 aa, Staphylococcus epidermidis
KLFYMTMHHLKEHSINKLKQYILLLTYLKSDTSYRHIIQLNSFYIRSYFSISNILFLYLIDKIYQ

SEQ ID NO: 5501 - protein, 52 aa, Staphylococcus epidermidis
VVFYTYLMKCFFKSNSNVIRINLKTTKYMQNKTALFIQKHHVKYNLTEILVN

SEQ ID NO: 5502 - protein, 46 aa, Staphylococcus epidermidis
LLLYLSFLTVRHAQLYCARFYRYKHMRFYIKLTFMYKNLYYSEKYK

SEQ ID NO: 5503 - protein, 303 aa, Staphylococcus epidermidis
IKLYFYRRRFMEHLLSMEHLSNSEIYDLITIACQFKSGERPLPQFNGQYVSNLFFENSTRTKCSFEMAEQKLGLKLINFETSTSSVKKGESLYDTCKTLESIGVDLLVIRDSQNSYYEELDQLNIPIANAGDGSGQHPTQSLLDIMTIYEEYGSFEGLNILICGDIKNSRVARSNYHSLTSLGANVMFSSPKEWVDNTLEAPYVEIDEVIDKVDIVMLLRVQHERHGISGEANFAAEEYHQQFGLTQARYDKLKEEAIVMHPAPVNRGVEIKSELVEAPKSRIFKQMENGMYLRMAVISALLQ

SEQ ID NO: 5504 - protein, 43 aa, Staphylococcus epidermidis
IFIYLYYVSEKKRKIKRRNTYIFFITALKKINIHFQQSNHLII

SEQ ID NO: 5505 - protein, 48 aa, Staphylococcus epidermidis
SLSYFIKNTPYQLFLLIGRIFMDCIQHLIVKHQSKPINIYMDRPFFVC

SEQ ID NO: 5506 - protein, 248 aa, Staphylococcus epidermidis
VKSYLLIQSLKNIAIKLSMKRRKHNMKFAVLVFPGSNCDRDMYNAAIKSGVDAAYVDYRETTLDGFDGVLIPGGFSFGDYLRSGAMASVAPIIKEVKRFAKEGKPVLGVCNGFQILTEIGLLPGALLHNDSHLFISRNETLKITNNQTPFTHLYVKNENVVYPVAHGEGHYYCTDEIYRELNDNNQIILKYTNNPNGSYEDIAGIVNKEGNVCGMMPHPERALETLLGTNSGVKLFESMVKSWREQNV

SEQ ID NO: 5507 - protein, 631 aa, Staphylococcus epidermidis
INIYKININKDWGITLSNCSSFILFSLINLIMERRSPLEEYQKKIKEKLNVVPLEPGCYLMKDRNDQVIYVGKAKRLRNRLRSYFTGAHDAKTTRLVGEIRNFEFIVTSSETESLLLELNLIKQYQPRYNILLKDDKSYPFIKITKEKHPRLLVTRTVKKNSGKYFGPYPNAYSAQETKKLLDRIYPFRKCDNMPDKLCLYYHIGQCMGPCVYDVDLEKYAQMTKEITDFLNGEDKTILHHLEDRMNKASEQLDFEQAKEYRDMIQHIHNLTKKQKIMSSDNTIRDVFGYSVSKGWMCVQVFFVRQGNMIKRDATMIPLQQTEEEEFYTFIGQFYSLNQHLLPKEVHVPKNLDKDIIQSVVDTKIVQPVRGAKKDMINLANHNAEVQLDNKFELIARDESRTIKAIEELGERMGIQTPIRIEAFDNSNIQGVDPVSAMVTFVDGKPHKKDYRKYKIKTVEGPDDYKSMREVVRRRYTRVLNEGLPLPDLIIVDGGKGHMNGVMDVLENELGLDIPVAGLQKNDKHQTSELLYGASAEIVPLKKNSQAFYLLHRIQDEVHRFAITFHRQTRQKTGLKSVLDDIDGIGTKRKTSLLRTFGSIKKMKEASFDELRQAGLPEKVAKNLQNALQNK

SEQ ID NO: 5508 - protein, 46 aa, Staphylococcus epidermidis
CFLYMNLKLMCSSFHLIHRYLVFLIHEPQAHVFVCSFSNITYTFHR

SEQ ID NO: 5509 - protein, 43 aa, Staphylococcus epidermidis
SFKYNNEFSSNSQYLLIEHLTLNSVSVNVFKQFTIYIIFIKVS

SEQ ID NO: 5510 - protein, 541 aa, Staphylococcus epidermidis
RSKYMKCNTLKLTEQDQFINKIKNSESQITSFYEYDAAKKESFYRRLKTPNNGREFHLSRVIKSYMNELKLTHQQLNNIDALADGAKVVIGGQQAGLFGGPLYTFHKIFSIITLSRQLSEEYDTPIVPVFWIAGEDHDFEEVNHTYAFNNKETTLKKVKYHTMTPPDSNVSRYTPDKNELKASLNHFFKEMKETVHTQDVYQMCVNIINQFDSWTDIFKGLIHEVFKDYGILLIDAQYPELRQMEKPLFKEILEKRNQVDQSFRETQIRTTQQQLPSMIQTETNTHLFIHEDGMRQLLNFDGTYFKLNKTEKRYTKQNLLDIIEREPERISNNVVTRPVVEEWLFNTVAFIGGPSEIKYWAELKGVFDTLNVEMPIVMPRLRITYLYARTKKLLKQYNLSIESVIANGVEQERQRFVREKASNNFINEVEEMKIQQQELYNNLFTYVENNHDNQLLLEKNNQIHLNQYDYLIKRYLLNIERENDISMRQFREISETLHPMGGLQERVWNPLQIMNDFGIDVFSPSTYPPLSYSFDHLIINP

SEQ ID NO: 5511 - protein, 42 aa, Staphylococcus epidermidis
IRTLSKSFLSLTMIIYKNIFIPCKLYTKLNNDIVNIALFSQR

SEQ ID NO: 5512 - protein, 48 aa, Staphylococcus epidermidis
FIKYTIALNCITLLIKLQLSSTFYCYKILLTNDYKIELNNLLFNSIFI

SEQ ID NO: 5513 - protein, 64 aa, Staphylococcus epidermidis
WVDFSHSSSPFNFYHKDYTFLIVNVMLSMTFVKALAVSSDVKQGTPFSTVVRRIWNPSRSISFP

SEQ ID NO: 5514 - protein, 68 aa, Staphylococcus epidermidis
KVGYGMQQKKSKGIFWIFSILAVIFLTLFSFALGVANVPLMILTFILLIATFGVGFSVKKKYRKNNWL

SEQ ID NO: 5515 - protein, 233 aa, Staphylococcus epidermidis
IGDLNMKFKNILFDFDDTLVDFYDAEKKAFYNLAQKYNHQPTQQDFEHFKKVNQAHWEAFQQNKLTKDEVLSQRFINYFNDYQIHVNGKEADKCFRAELAMAPVKLFDHTLEVIQQLKLNHSLYIVTNGVTETQLRRIAQTQFNEIFQDVFISEKAGFQKPMTEFFDFVFEHIGENNRNQTLIVGDSLTSDILGGKNANISTCWFNIRQKENHTSIQPDYIINDLSEMIRIVE

SEQ ID NO: 5516 - protein, 608 aa, Staphylococcus epidermidis
KRYHIDFQTLSNWSDVSMYYTNSNYEAFARPKKPENVDNKSAYLIGAGLASLAAACFLIRDGQMKGENIHILEELDISGGSLDGINMEHHGYVVRGGREMENHFECLWDLFRSIPSLEQTNASVLDEFYWLNKEDPNYSKCRAIESGGKRIDTDGDFTLTKKAIKEILNLCLMKEEDLDDVKITDVFSRDFLNSNFWLYWKTMFAFEPWHSAMEMRRYLMRFVHHIGGLADFSALKFTKYNQYESLVLPMIEYLKSHSVNFEFGVQVNNILVDATPSTKIAREIILTRDDKEESIPLTVNDLVFVTNGSITESSTYGDNDHPAPITHSLGGSWTLWKNLANQSPEFGRPEKFCDHIPAKSWFVSATATTDNKKIISYIEQLCKRDVLSGRTVTGGIISVANSSWQLSFTVNRQQQFKKQPKNQVSVWIYALYSDEKGDFIKKPITECTGSEICQEVLYHMGVPQEEIVELAQSECNTIPVYMPYVTAYFMPRAYKDRPLVVPNGSKNLAFIGNFAETARDTVFTTEYSVRTAMEAVYQLLDVDRGVPEVYASEFDARVLMDAFYELNDRKSLHELVNKNFIKRSVLNTVLKKIRGTFIEELLRKHKLL

SEQ ID NO: 5517 - protein, 311 aa, Staphylococcus epidermidis
MFHHVSVMLNETIDYLNIKEDGVYVDCTLGGAGHALYLLNQLNDKGRLIAIDQDLTAIENAKEVLKEHLHKVTFVHNNFRELTNILNELEIEKVDGIYYDLGVSSPQLDVPERGFSYHNDAKLDMRMDQTQSLSAYEVVNQWSYEALVRIFFRYGEEKFSKQIARRIEAHREQQPIETTLELVDVIKEGIPAKARRKGGHPAKRVFQAIRIAVNDELSAFEDSVEQAIECVKVGGRISVITFHSLEDRLCKQIFQEFEKGPDVPRGLPVIPEAYTPKLKRVNRKPITATDDDLNENNRARSAKLRVAEILK

SEQ ID NO: 5518 - protein, 202 aa, Staphylococcus epidermidis
VMSHDANTIDSRTHEGELNKLGFWIFLTAEFALFGTLFATLLTLQHGGGYGGKLTTDLFELHLILIMTFALLISSYTCGIAIYYMRQEKQNLMMFWMIITVILGLVFVGFEIYEFAHYASEGVNPTIGSFWSSFFILLGTHGAHVSLGIVWVICLLIQIGTRGLDSYNAPKLFIVSLYWHFLDVVWVFIFTAVYMIGMVYSG

SEQ ID NO: 5519 - protein, 297 aa, Staphylococcus epidermidis
HMIQKLLNDIQQDDYAWKMDVLKKWKVNTLFERWKKRHTFVDDVNIITKLLLGIALFFFIIFIHNFDFMIYIVILMFMFLLLFNGTEFKITAIFILVTTLFALMSSLFMILYGDGEHMLVKFGILQISTESIVRGLHLSMRTITVSIFGILIALTSQIVMIFYSLMQHLKVKPKFAYAFMAAIRMVPLIISSLIQLRRSLKMRYQMIDASNYKGIKRLNHLVIPLLSQNIRRAHQLSVAMESKGFKDGPRTYYYRVPFSYKDIVFIACILIIITLSFVLSSYLPITGIHDVRFGQLD

SEQ ID NO: 5520 - protein, 73 aa, Staphylococcus epidermidis
GTAHNDCYFHFVHPFETFGLLLGIVVYYTYSITIHLVFFNQKSNFNINLNINLRLLTIICFLINVKVKILINN

SEQ ID NO: 5521 - protein, 326 aa, Staphylococcus epidermidis
AMAQMTMVQAINDALKSELKRDEDVLVFGEDVGVNGGVFRVTEGLQKEFGEDRVFDTPLAESGIGGLALGLAVTGFRPVMEIQFLGFVYEVFDEVAGQIARTRFRSGGTKPAPVTIRTPFGGGVHTPELHADNLEGILAQSPGLKVVIPSGPYDAKGLLISSIQSNDPVVYLEHMKLYRSFREEVPEKEYKIDIGKANVKKEGNDITLISYGAMVQESLKAAEELEKDGYSVEVIDLRTVQPIDIDTLVASVEKTGRAVVVQEAQRQAGVGAQVAAELAERAILSLEAPIARVAASDTIYPFTQAENVWLPNKKDIIEQAKATLEF

SEQ ID NO: 5522 - protein, 310 aa, Staphylococcus epidermidis
EGGLVLENYNFNIIEQSQVGQRIDKLVSDLNKDWSRSQLQDWIKEGLVKVNGKVIKSNYKVKLNDKIVVTEKEVVEADIKPENLNLDIYYEDEDVAVVYKPKGMVVHPSPGHYSGTLVNGLMYQIKDLSGINGEIRPGIVHRIDKDTSGLLMVAKNDVAHRHLVEQLMSKTVKRKYTALVHGNIPHDYGTIDAPIGRNKNDRQSMAVVDDGKEAVTHFNVLEHFKDYTLIECQLETGRTHQIRVHMKYIGYPLVGDPKYGPKKTLDIDGQALHAGIIGFEHPVTHEYIEKHATLPNDFEKLLDDIRRRDA

SEQ ID NO: 5523 - protein, 244 aa, Staphylococcus epidermidis
VEKQKRTSYTFIIKHYLNSYQSRRIIMPFTPSEIKNKEFTRVKNGLEPTEVANYLEQLSNEIERLKEDKKQLEKVIEDRDSNIKSYKDVHQSVSDALIQAQKVGEETKQAATKEAEAVLSKAQVQADSIVNDAIEKARRLAFQTEDMKRQSKVFRSRFRMLVEAQLDLLKSEDWDYLLNYDLDAEQVTLEDIHHLHDNDLTPEERAMKQKQNQEISANQPSTSSSESVSQSNANNESSQSTSNN

SEQ ID NO: 5524 - protein, 400 aa, Staphylococcus epidermidis
IMKHILLAVTGGIAAYKAIDLTSKLIQSGYDVRVMLSDHAQEFVTPLAFQAISRNPVYTNTFKEENPEEIQHVSLGDWADAIIVAPATANTIAKLSVGIADDLITSTLLATTTPKFVAPAMNVNMYNNPRTKHNMKVLSQDGYYFIEPGSGYLACGYVAKGRMEEPMQILSVINKFFTQQKNVVKSSFSGKRALVTAGPTVEVIDPVRYVSNRSSGKMGYAIAEALRDKGAIVTLISGPTHLSLPEGINVVKVESADDMFQAVTERFAKQDIVIKAAAVSDYTPMDILEHKLKKQEGGLSVQFKRTKDILKYLGENKTHQYLVGFAAETQNIEQYALDKLKRKNADVIISNNVGDTSIGFSSDDNELTMHFKNNEKVNIKKGKKSALAHQIIEILETRWQ

SEQ ID NO: 5525 - protein, 45 aa, Staphylococcus epidermidis
IMEQLFDAIRSVVDAGINQDWSQLASGIAGIVENGVSIISKLLGQ

SEQ ID NO: 5526 - protein, 252 aa, Staphylococcus epidermidis
RWRHILMEQITSAQNSKIKNANKLKKKRERDKTGLALIEGIHLIEEAYQSQIEVIQLFIVDSDRMSSSIIDYAKEVYQINLKVAEALSGTVTPQGFFAIIKKPTYDKTLAKQVLLIDRIQDPGNLGTLIRTADAAGLDLIVMEKGTADPFQDKVIRASQGSIFHIPVIFDDINNYIHQFNGPVYGTALENAVSFNDVEAQVNFALILGNEGEGVNPDLLKETTQNLTIPIYGKAESLNVAIAGSILMYQLKG

SEQ ID NO: 5527 - protein, 210 aa, Staphylococcus epidermidis
LLTHNFPREGCAFFRRMFFMSKGLKLSEILVTVLISVVFAIIYNLWWFVYNIVQVAGIHLEQLTYGVWFMAAVVCYLIIPKPGIALLAEIAAGAGETIVMGKFDIPTIIYAILQGLACEIIFAIFKYKSRSAAVAMLAGLATALISFPVDYFYGYLNEVAGWNLLLFIVFRSISGIVLAGLVSYWIVKALDKTGVTKFFRPASQQDYDNL

SEQ ID NO: 5528 - protein, 407 aa, Staphylococcus epidermidis
SVRQTIKMKLNKFKIVFFIIVLLTLVVSIGILGVEWTRHLELKKQTLSQESGNTNYIEKRDKTVEKPKKIKTKYDKKDPTSKSINKYLEKTQFNGTVAVFDNGKVKMNKGYGYQDIEKGKKNTANTMYLIGSAQKFTTGLMLKQLEVENKVNLQDSVTKYIPWFKTNKEITIKDLMLHKSGLYKYEASTNIKNLEQAVRAIQARGIDDTVYHKHQYNDANYLVLAKVIENVTGKPYVKNYYERLGNKYNLKHTAFYDEKPLQSEMAKGYKFKNNTFSFLKPNILDQYYGAGNLYMTPHDMGKLIYTLQQNKIFNARQTRPILHEFGTQEYPEEYRYGFYITPYLNRVNGVFFGQIFTVYFNDRYIVILGTNVSNTPGLVSNEDKMRHIFYNILDQKKPYNTAGVKVE

SEQ ID NO: 5529 - protein, 99 aa, Staphylococcus epidermidis
NHFNPRSGEISMGEFKNRINVTINDQHFTIIGEDSPEHIRYVAHLVDEKMQELGQKSAGLDTTRKAILTSVNIMHEKVILEEENRRLQQEINQLKQRDE

SEQ ID NO: 5530 - protein, 222 aa, Staphylococcus epidermidis
INFKSLCYNIHNHIKRRHIMTQYTFSPKDFKAFEVEGLDQRMEALNDYVRPQLHQLGSYFEEYFTTQTGETFYAHVAKHARRSVNPPIDTWVAFAPNKRGYKMLPHFQIGLFRNQLFIMFGIMHEGRNKEEKVKIFDKHFDKLTSLPSDYSVSLDHMKTEKHYIKDMSNEELHAAIDRVKNVKKGEFFVARTLSPTDKRLKSDKSFLKFVEETFDEFLKFYQ

SEQ ID NO: 5531 - protein, 290 aa, Staphylococcus epidermidis
EWFKVVAKILDGKQIAKEYRQRLKNQVNDLKEYGFTPKLSVILVGNDGASQSYVKSKKKAAEKIGMISEIIHLDESTSEEVVLSELNRLNNDDTVSGILVQVPLPKQVSEQKVLEAINPEKDVDGFHPINIGKLYIDEQTFVPCTPLGIMEILKHADINLEGKNAVVIGRSHIVGQPVSKLLLQANATVTILHSRTKNMNAHLKQADVIVSAVGQPGLVTKENVKKGAVIIDVGNTPDENGKLKGDVAYDEVKEIASAITPVPGGVGPLTITMVLNNTLLAEKLRRGLTK

SEQ ID NO: 5532 - protein, 45 aa, Staphylococcus epidermidis
SSLKNIYKIEKASDIRNKQYARLTPILTRCTMFTVSYASVFISYQ

SEQ ID NO: 5533 - protein, 67 aa, Staphylococcus epidermidis
MEVNKVIYILLAVFLGSFGIHKFYAGKPIQGLLHILFCWTAIPHVLAIISAVLTLFKPADANGNVRM

SEQ ID NO: 5534 - protein, 370 aa, Staphylococcus epidermidis
MAPKLQAQFDAVKVLNETQSKFEMVQILDEDGNVVNEDLVPDLTDEQLVELMERMVWTRILDQRSISLNRQGRLGFYAPTAGQEASQLASQYALESEDFILPGYRDVPQIIWHGLPLTDAFLFSRGHFKGNQFPEGVNALSPQIIIGAQYIQTAGVAFGLKKRGKNAVAITYTGDGGSSQGDFYEGINFASAYKAPAIFVIQNNNYAISTPRSKQTAAETLAQKAISVGIPGIQVDGMDALAVYQATLEARERAVAGEGPTVIETLTYRYGPHTMAGDDPTRYRTSDEDAEWEKKDPLVRFRKYLEAKGLWNEDKENEVVERAKSEIKAAIKEADNTEKQTVTSLMDIMYEEMPQNLAEQYEIYKEKESK

SEQ ID NO: 5535 - protein, 46 aa, Staphylococcus epidermidis
EITKNTMSEIQVKTRCDFLDCKKPHVTQNDHKPLAKWKTTAMTQIM

SEQ ID NO: 5536 - protein, 281 aa, Staphylococcus epidermidis
VMANQSLKETPKTQSNPQTQVQGQNQQPKQKTVKLIIKRQDNSESKPYEESFEIPYKENLNVIACLMEIRRNPVNSKGEKTTPVTWDMNCLEEVCGACSMVINGRARQSCSAIVDQLEQPIRLEPMSTFPVIRDLQVDRSRMFDNLKRMKAWIPIDGTYDLGPGPRMPEKKRQTAYELSKCMTCGVCLEVCPNVTKNNKFVGAQAISQVRLFDLHPTGSMTKDERLDALMSAGGLQECGNSQNCVNACPKGIPLTTSIAAMNRETSFHMFKSFFGSDHQVD

SEQ ID NO: 5537 - protein, 246 aa, Staphylococcus epidermidis
VVANQKKKEMVHDFQQKFTDKMKSLGLHFKNIDLYQQAFSHSSFINDFNMNRLEHNERLEFLGDAVLELTVSRYLFDRHPHLPEGNLTKMRATIVCEPSLVIFANKIKLNELILLGKGEEKTGGRTRPSLISDAFEAFVGALYLDQGLDSVWTFAEKVIFPYVEDDELVGVVDFKTQFQEYVHSQNKGDVTYQLIKEEGPAHHRLFTSEVILENKAVAEGKGKTKKESEQKAAEQAYKLMKNKKSL

SEQ ID NO: 5538 - protein, 269 aa, Staphylococcus epidermidis
KENKMFHNKNANFVNGVTINIKDKETIKTFYENVLGFNLINESETAVQFEVGDSNQFITFIEIQNGREPLMSEAGLFHIGILLPTLTTLADLLVHLSDFEVPVNGGQQSVATCLFIEDPEGNAIKFYVDRETESWIDEKEGRIRMDIAPINVPRLLQNVSHTQWQGIPDETKLGSLHIKSIRISDVKSYYLNYFGLEESAYMDDYSLFLSSNEYYNHLAVNQWLSATKRVDNEHTYGLAMIDFHYPKTTHKNLKGPDGIYFRFNRIKEV

SEQ ID NO: 5539 - protein, 215 aa, Staphylococcus epidermidis
RNDNVKINLLCSQRLLPNHIFEKEKDSNWAGIDRGALILVKQGIQPIFSVGDFDSVNNEERLMLMKNLQIEPVEAEKDDTDLALGVAQAVERGYTEITIYGATGGRLDHFMGVLQILQKPQYLHQSIKIKVIDQQNHIQLLNEGKYVINRDSTYPYISFIPLNDKTILTLQGFKYNLNQEHLNLGSTLTISNEVKVNEAIIRVEQGTVLKIRSRD

SEQ ID NO: 5540 - protein, 210 aa, Staphylococcus epidermidis
VIDKESVMIFKEYLRLGTKMRGERLKLKKNDRRVAIKEAIELNPFITDYELCEKFDVSIQTIRLDRTHLNIPELRKRIKLVAEQNYGRIKSIEANEIIGDLIQVNPDVSAQSLIEITIDSVFAKSEIARGHVLFAQANSLCVALIHKPIVLTHESQVEFKEKVKLNDTVRADARVIDITDKHYIIEVNSYVSDMLVFKGKFKMYYTSEDE

SEQ ID NO: 5541 - protein, 208 aa, Staphylococcus epidermidis
GMDKEKGLLIVLSGPSGVGKGTVRKKIFEDPTTSYKYSISMTTRHMREGEIDGVDYFFKTKEEFEALIKDDQFIEYAQYVGNYYGTPVQYVKDTMEEGHDVFLEIEVEGAKQVRKKFPDALFIFLAPPSLDDLKERLVGRGTESDEKIQSRVNEARKEVEMMNLYDYVVVNDEVELAKNRIQSIVEAEHLKRERIEAKYRKMLLEVKK

SEQ ID NO: 5542 - protein, 516 aa, Staphylococcus epidermidis
FRRKNKRKRFRYQTKMGRGYSSMSNYSGLNEECGVFGIWNHPEAAQLTYMGLHSLQHRGQEGAGIVVSNHETLKGERGLGLLTEAIKDEHMSNIKGYPHAIGHVRYATSGNKGIENIQPFLYHFYDMSVGICHNGNLINAKSLRQNLEEQGAIFHSSSDTEVIMHLIRRSKAPTFEEALKESLRLIKGGFTFAILTKDALYGAVDPNAIRPLVVGKMENGAYILASETCAIDVLGAEFIQDIHAGEYVVITDEGIEVKTYTRQTTTAISAMEYIYFARPDSTIAGKNVHAVRKASGKRLAQENPAKADMVIGVPNSSLSAASGYAEEIGLPYEMGLVKNQYVARTFIQPTQELREQGVRVKLSAVKDIVDGKDIVLVDDSIVRGTTIKRIVKMLKDSGANRIHVRIASPEFMFPCFYGIDVSTTAELISASKSPEEIKNHIGADSLAYLSVDGLIESIGLDYDAPYHGLCVESFTGDYPAGLYDYEKNYKKHLSERQKSYIANNKHYFDSEGNLHV

SEQ ID NO: 5543 - protein, 473 aa, Staphylococcus epidermidis
WRGKNMVVGDFPIETDTIVIGAGPGGYVAAIRAAQLGQKVTIVEKGNLGGVCLNVGCIPSKALLHASHRFVEAQNSENLGVIAESVSLNYQKVQEFKTSVVNKLTGGVEGLLKGNKVEIVRGEAYFVDNNSLRVMDEKSAQTYNFKHAIIATGSRPIEIPNFEFGKRVIDSTGALNLQEVPNKLVVVGGGYIGSELGTAFANFGSEVTILEGAKDILGGFEKQMTQPVKKGMKEKGIEIVTEAMAKSAEETENGVKVTYEAKGEEQTIEADYVLVTVGRRPNTDELGLEELGLKFADRGLLEVDKQSRTSIENIFAIGDIVPGLPLAHKASYEGKVAAEAIDGQAAEVDYIGMPAVCFTEPELAQVGYTEAQAKEEGLSIKASKFPYAANGRALSLDDTNGFVKLITLKEDDTLIGAQVVGTGASDIISELGLAIESGMNAEDIALTVHAHPTLGEMTMEAAEKAIGYPIHTM

SEQ ID NO: 5544 - protein, 63 aa, Staphylococcus epidermidis
HEFKMEKCKLFFFFFIQGKDIERDGFQIRRTTVENGVPCLTSLDTASALTNVIESMTFTMRNV

SEQ ID NO: 5545 - protein, 46 aa, Staphylococcus epidermidis
KPPKSSVLVPKNSAAPSVSNKQLTTKAMDSCILESMVAYLIACAFS

SEQ ID NO: 5546 - protein, 106 aa, Staphylococcus epidermidis
VMNKLLQSLSALGVSATLVTPNLNAEATTNTEPQLKGVNDIVIEKGQEYNLLKGISAYDKEDGDLTHKIKIDGQVDTSKAGKYKVKYQVTDSDGAEKTSIRNIEVK

SEQ ID NO: 5547 - protein, 173 aa, Staphylococcus epidermidis
RVNNMSKWIILSDNHKETGILYHIYELHKDADKFLHLGDSEFSYNDTELSLYQRVKGNCDFYPEFLEEEITEENGIRAFYTHGHLYQVNQTRMKLAEKAKELGCLFAFYGHTHVAKYEQIGGIHVINPGSISQSRSQIEETFAELVYKEDENTIILNFRNRENQIIETVKIEF

SEQ ID NO: 5548 - protein, 42 aa, Staphylococcus epidermidis
IYLNLYQLLTINGYLNDAHEIINIYKVFILTVLSIYECHFEN

SEQ ID NO: 5549 - protein, 81 aa, Staphylococcus epidermidis
LLLNVTFKLDKEFLSDFKLVLYAIQLFYNLLVIKKPRTIFMSQALPILIKLYPKYSFGTTGSILPSAISSKAFPTGLAEWY

SEQ ID NO: 5550 - protein, 334 aa, Staphylococcus epidermidis
KELKLESEEKEIYMIFIYAIIALLITFILVPILIPTLKRMKFGQSIREEGPQSHMKKTGTPTMGGLTFLISIIITSIIAIIFVDHSNPIILLLFVTIGFGLIGFIDDYIIVVKKNNQGLTSKQKFLAQIIIAVIFFVLSDVFHLVHFTTDLHIPFVNFDIPLSFAYVIFIVFWQVGFSNAVNLTDGLDGLATGLSIIGFAMYAVMSYMLDSPAIGIFCIIMIFALLGFLPYNLNPAKVFMGDTGSLALGGIFATISIMLNQELSLILIGFVFVVETLSVMLQVASYKLTKKRIFKMSPIHHHFELSGWGEWKVVTVFWTVGLITGLIGLWIGVH

SEQ ID NO: 5551 - protein, 41 aa, Staphylococcus epidermidis
FLINSKDQLSHINKTSLQHMYSYVQTLHLLQGFFHFNQIII

SEQ ID NO: 5552 - protein, 356 aa, Staphylococcus epidermidis
LIINIILIVREIYMSKAYEESGVNIQAGYEAVERITSHVERTLRKEVLGGLGGFGATFDLSQLKMKAPVLVSGTDGVGTKLKLAIDYGKHDTIGIDAVAMCVNDILTTGAEPLYFLDYIATNKVVPSTIEQIVKGISDGCEQTNTALIGGETAEMGEMYHEGEYDIAGFAVGAVEKEDYIDGSNVEEGQAIIGLASSGIHSNGYSLVRKMIKESGVQLHDQFNGQTFLETFLAPTKLYVKPILELKKHIDIKAMSHITGGGFYENIPRALPKGLSAKIDTQSFPTLEVFNWLQKQGNISTNEMYNIFNMGIGYTIIVDKKDVQTTLTTLRAMDTTAYEIGEIIKDDDTPIHLLEVE

SEQ ID NO: 5553 - protein, 42 aa, Staphylococcus epidermidis
IEINLSEFVFDVNILTYFSNFEQLYKIIIEYFFCFQNNNHTF

SEQ ID NO: 5554 - protein, 48 aa, Staphylococcus epidermidis
GEINMSKLAEAIANTVKAAQDQDWTKLGTSIVDIVESGVSVLGKIFGF

SEQ ID NO: 5555 - protein, 48 aa, Staphylococcus epidermidis; identical to SEQ ID NO: 5554

SEQ ID NO: 5556 - protein, 43 aa, Staphylococcus epidermidis
NLVKLLEFNKYNAHNKNILMWRINFKTLKVRPLRSFLVTTTYF

SEQ ID NO: 5557 - protein, 1037 aa, Staphylococcus epidermidis
RISKKRSVKSMPKRDDIKTILVVGSGPIIIGQAAEFDYAGTQACLALKEEGYRVILVNSNPATIMTDKEIADKVYIEPLTHDFIARIIRKEQPDALLPTLGGQTGLNMAIQLHDSGVLEANNVKLLGTELESIQQAEDREMFRTLMNDLNVPVPESDIVNTVEQAFEFKEQVGYPLIVRPAFTMGGTGGGICHNDAELKEVVSNGLHYSPATQCLIEKSIAGYKEIEYEVMRDKNDNAIVVCNMENIDPVGIHTGDSIVVAPSQTLSDVEYQMLRDVSLKVIRALGIEGGCNVQLALDPHSLNYYIIEVNPRVSRSSALASKATGYPIAKLAAKIAVGLTLDEMLNPITGTSYAAFEPTLDYVISKIPRFPFDKFEKGERELGTQMKATGEVMAIGRTYEESLLKAIRSLEYGVHHLGLPNGESYELDYIKERIGHQDDERLFFIGEAIRRGTSLEELHNMTKIDYFFLNKFQNIIDIEHELKNHQGDLEYLKYAKDYGFSDKVIAHRWDKEEKDIYQLRMSQNIKPVYKMVDTCAAEFESTTPYYYGTYEYENESIVTDKEKILVLGSGPIRIGQGVEFDYATVHAVWAIQNADYEAIIVNNNPETVSTDFSISDKLYFEPLTEEDVMNIINLEQPKGVVVQFGGQTAINLADKLAQHGVKILGTSLEDLNRAEDRKEFEALLREIAVPQPQGKTATSPKEALENAREIGYPVVVRPSYVLGGRAMEIVDNDQELENYMTQAVKASPEHPVLVDRYLTGKEIEVDAISDGETVVIPGIMEHIERAGVHSGDSIAVYPPQTLTQDEINTLEDYTIKLAKGLNIKGLINIQFVIAHDGVYVLEVNPRSSRTVPFLSKITDIQMAQLAMRAIMGETLAEIGFKQGIQPYSEGVYVKAPVFSFNKLKNVDITLGPEMKSTGEVMGKDLTLEKALYKGLTGSGFEVKDHGTVLMTVSDKDKDEIVKIAHRLNEIGYKILATRGTAQKLKDHNIPVEVVGKIGGEDDLLTRIQNGEVQIVFFFFYSRKRYRTRWIPNSTYNS

SEQ ID NO: 5558 - protein, 318 aa, Staphylococcus epidermidis
KSTKKERIQLMGNVVYKLTSKEIQSLMAQTTFETTKLPQGMKARTRYQNTVINIYSSGKVMFQGKNADQLASQLLPDKQSTTGKHTSSNTTSIQYNRFHCIGSDEAGSGDYFGPLTVCAAYVSQSHIKILKELGVDDSKKLNDTKIVDLAEQLITFIPHSLLTLDNVKYNERQSIGWSQVKMKAVLHNEAIKNVLQKIEQDQLDYIVIDQFAKREVYQHYALSALPFPDKTKFETKGESKSLAIAAASIISRYAFVKHMDHISKKLHMEIPKGASNKVDLIAAKVIQKYDIQQLDTISKKHFKNRDKAIHLMNQKYNK

SEQ ID NO: 5559 - protein, 56 aa, Staphylococcus epidermidis
MKAKPKMIVTLAWNVILVYRVTKTAKSVSTIEAIKPTVCFTIVFIRYTPSLSYIRQ

SEQ ID NO: 5560 - protein, 338 aa, Staphylococcus epidermidis
RRANVMAFEGLSDRLQATMQKMRGKGKVTEADIKTMMREVRLALLEADVNFKVVKEFVKNVSERALGSDVMQSLTPGQQVIKIVQEELTSLMGGENTSIKMANKPPTVVMMVGLQGAGKTTTAGKLALLMRKKYNKKPLLVAGDIYRPAAIDQLQTVGKQIDIPVYSEGDQVSPQQIVENALKHAKEEHLDFVIIDTAGRLHIDEALMNELQEVKEISKPDEIMLVVDAMTGQDAVNVAQSFDEQLDVSGVTLTKLDGDTRGGAALSIRSVTQKPIKFVGMSEKLDGLELFHPERMASRILGMGDVLSLIEKAQQDVDQEKAKDLEKKMRESSSSLNL

SEQ ID NO: 5561 - protein, 138 aa, Staphylococcus epidermidis
RFKNKTLKFSGGTDMTLEISNDYGKIDISNDVIASVVGGKAVESYGIVGMASRQQVRDGIAEILGHDNYAKGIKVREDNGIIDVDMYIIVSYGVKISEVASNLQSTVKYTLEKTLNVKVNSINIFVQGVRVNETVKKV

SEQ ID NO: 5562 - protein, 46 aa, Staphylococcus epidermidis
EIKKSSKSQYRFTRFKDVKYYLDSFLCRLSNKSEDIKAIEPNTVVV

SEQ ID NO: 5563 - protein, 41 aa, Staphylococcus epidermidis
EAKNFTQPFSFHFPIHGFKNPTYYKRISKGESKADLFFIRI

SEQ ID NO: 5564 - protein, 203 aa, Staphylococcus epidermidis
MAKNIAKALLDIEAVSLSPNDLFTWSSGIKSPIYCDNRITLGYPEVRNAIRDGLIQLIKEHFSNVEIISGTATAGIPHAAYISEKLELPMNYVRSKSKSHGKQNQIEGAKSENKNVVVVEDLISTGGSSITAVEALEEAGANVLGVVAIFTYGLAKADKTFNKAHIPFYTLSDYNELIEVAKDEGKISLNDIQTLVDWRDNLS

SEQ ID NO: 5565 - protein, 40 aa, Staphylococcus epidermidis
YNKKFLHVSVYFKKINFKLLIKYNKKAQNEFHFGLIFVKL

SEQ ID NO: 5566 - protein, 373 aa, Staphylococcus epidermidis
QDKKKGKLEMITAEKKKRNKFLPNFEKQSIYSLRYDEMQQWLIDHGQQKFRAKQIFEWLYQKRVNTIDEMTNLSKELRQILKDHFAMTTLTTVVKQESKDGTIKFLFELQDGYTIETVLMRHEYGNSVCVTTQVGCRIGCTFCASTLGGLKRNLEAGEIVSQVLTVQKALDETNERVSQIVIMGIGEPFENYDEMMDFLRIVNDDNSLNIGARHITVSTSGIIPRIYDFAEEDIQINFAVSLHGAKDEIRSRLMPINRAYNVDKLMEAIRYYQEKTNRRVTFEYGLFGGVNDQLEHARDLAHLIKNLNCHVNLIPVNHVPERNYVKTPKDDIFKFEKELKRLGINATIRREQGSDIDAACGQLRAKERQVETR

SEQ ID NO: 5567 - protein, 74 aa, Staphylococcus epidermidis
KIKKEPHSMRLLFVIASWEGFEPPTDGLEGHCSIQLSYQDIFNTRIIISKYMSFSNRYLIKIIYIFHYNRGFYT

SEQ ID NO: 5568 - protein, 408 aa, Staphylococcus epidermidis
YMKNFKNIMRYIGKTSKFIDYPLLITYVVLCLIGLVMVYSASMVAATKGTLTGGVPVSGTYFYNRQLLYVIMSFVIVFFMAFIMNVKVLKKPNVQKGMMIGIFILLLLTLVIGKNINGSKSWINLGFMNLQASELLKISIILYIPFMIEKKMPAVRHNIKLILGPILFVVTCLILVLFQKDVGQTMLIVIIFFSIIFYSGIGVQNMLKWGALVAIGFIIVATFMFMLDMVPSYLQARFSTLTNPFSQESGTGYHISNSLLAIGNGGLFGRGLGNSIMKLGYLPEPHTDFIFAIICEEMGLIGGLIVLILEYFIVYRAFQLANKTQSYFYKLVCVGIASYIGSQTFVNIGGISATIPLTGVPLPFISFGGSSMISLSIAMGLLLITAKQIKQDDKRLKQRKVDIKRRYN

SEQ ID NO: 5569 - protein, 366 aa, Staphylococcus epidermidis
MLEKRYLVLEDGSYYEGYRLGSDDLSIGEIVFNTAMTGYQETISDPSYTGQIITFTYPLIGNYGINRDDFESLTPKLNGVVVKEASTHPSNFRHQKTLHETLAQYHIPGISGVDTRSITRKIRNYGVLRAGFTDNKDNIQELVEQLKTAELPRDEVQTVSTKTPYVSTGSDLSVVLLDFGKKQNIVRELNLRGCNVTVVPYDTSAEEILGMSPDGVMLSNGPGDPDEVDVALDMIRGILGKIPFFGICLGHQLFALSQGATSFKMKFGHRGANHPVKDLRTGKIDITSQNHGYSIDCDSLKNTDLEVTHIALNDGTVEGLRHKELPAFSVQYHPEARPGPSDSNYLFDEFIAMMKDFKEKERQINA

SEQ ID NO: 5570 - protein, 563 aa, Staphylococcus epidermidis
DSEKGLGGQREMISKINGKLFADMIIQGAQNLSNNADLVDSLNVYPVPDGDTGTNMNLTITSGREEVENNLSQNIGELGKTFSKGLLMGARGNSGVILSQLFRGFCKNIEEEKEISVQQFAESFQAGVETAYKAVMKPVEGTILTVAKDAAKAAMDYVDQAEDCVDLMAHLIEAASESLDNTPNLLAVLKEVGVVDSGGKGLLCVYEGFLKGLKGEKIEAQAPKLDTESFVNDDHDFHGVINTEDIVYGYCTEMMVRFGKNKKAFDEQEFRNDMSEFGDSLLVINDDEIVKVHVHTEHPGDVFNYGQKYGELIKLKVENMREQHREVIRKEQDGLQSKEANESKTVETAIVTISVGDGIAELFKSMGATHIISGGQTMNPSTEDIVKVIEQSQCKRAIILPNNKNIMMASEQAASIVEAETVVIPTKSIPQGISALFQYDLESSLEDNKRHMSDALETVQSGSITFAVRDTKIDGIEIKKDEFMGLAEDKIVTSDVNQFHAVKGLLSKLLNEDSEILTMISGEDADNSITNQIINWIESEYPDVEVEQHEGGQPIYQYFFAVE

SEQ ID NO: 5571 - protein, 52 aa, Staphylococcus epidermidis
IIRKGLIFLKYFNVKLHMNTKYFGETLEGTGQAEDYRLKLSSKKASQQYEVL

SEQ ID NO: 5572 - protein, 183 aa, Staphylococcus epidermidis
VVRKMDIGYKLRNLRRIKNLTQEELAERTDLSKGYISQIESNHASPSMETFLNLIEVLGTSASDFFKEPSDEKVLYKKKEQTIYDEYDKGYILNWLVANSNEFDMEPLILTLRPNASYKNFKPSESDTFIYCLNGEVSLQLGNQVYKACKEDVLYFKAKDKHRLYNETDKEVKVLIVATASYL

SEQ ID NO: 5573 - protein, 178 aa, Staphylococcus epidermidis
LNRKVEKRLAWIANILSLLFLIFGILSIFVINNTSNQQQYNELMKQFSGNNQDMSSEMFLVSLIASLVILGFSTLLGFVGTMVIEGIKNLAATLLIAAAIVGLFTTNLIAMVLWMIAAIRLFAKKDKTDVNENATAQLRQNHSKSQSDWNHQQNQQHKDAWDPEQEINKQKKDDPYIY

SEQ ID NO: 5574 - protein, 265 aa, Staphylococcus epidermidis
NILKERFIKKNHYLDYEFDEGSDIKLGFTTRENGLSPYPNHSFNMARYISDSAHHITHHQNILANLIGYTRDEWVFPIQTHDNRIVEVTSEHKGTNIDELTDDLHGIDGMYTFDSHILLTMCYADCVPVYFYSEPHGYIGLAHAGWRGTYGQIVKEMLKKVDFDYEDLKIVIGPATSNSYEINDDIKNKFEELTIDSTLYIETRGKNQHGIDLKKANALLLEEAGVPSKNIYVTEYATSENLDLFFSYRVEKGQTGRMLAFIGRK

SEQ ID NO: 5575 - protein, 140 aa, Staphylococcus epidermidis
YNLKIKEFDLFMKQSFIKIGEGLTDLFEFTTLIEYNHKRINRIVYFHTPHSEKQLSSVAIIMNPTAEKHFQAMYIMTNALKYPYPEGNKKFNMINSAAENYDIPVVGIDVQPPDVYPDLELYFNYLISVLRLQRWIPPLQ

SEQ ID NO: 5576 - protein, 320 aa, Staphylococcus epidermidis
MKLKWRRILTMSKIIFMGTPDFSTKILEMLIAEHEVIAVVTQPDRPVGRKKVMTPPPVKRVATKHQIPVYQPEKLKDSQELESLLSLESDLIVTAAFGQLLPESLLNAPKLGAINVHASLLPKYRGGAPIHQAIIDGEEETGITIMYMVKKLDAGNIISQQSIRIEEEDNVGTMHDKLSFLGAELLKKTLPSIIDNTNDSIPQDDALATFASNIRREDERVDWNMSAQAIHNHIRGLSPWPVAYTTMNEKNLKLFSAFIVKGKKGNPGTIIETTKHELIIATGSDDAIALTEIQPAGKKRMKVTDYLSGVQESLVGKVLL

SEQ ID NO: 5577 - protein, 186 aa, Staphylococcus epidermidis
SHMKWSITQLRKYQGKPFEFNQTVNFEHLRESLDLIDLSDINVEGQLTVKSNEVIADMHVTGTYTMPCARTLVPVDVPLDVSTSEVFDLEGYDGYTDSDDQEDEHYHLVTDGMINIKDIAEELVIIEKPMRAYSEHSDQMLTEGNGWEVIDEDQLTEVQKEQDSDSEQRKSDPRLQKLQQLNDKDN

SEQ ID NO: 5578 - protein, 269 aa, Staphylococcus epidermidis
RSMNKPIGVIDSGVGGLTVAKEIMRQLPNETIYYLGDIARCPYGPRPGEEVKKFTTELAQKLMEFDIKMLVIACNTATAVALNYLQNILPIPVIGVIEPGARTAIMTTKNQNVLVLGTEGTIKSEAYRTHIKKINPNVNVYSVACPGFVPLVEQMRYKDPTITNIVIHQTLKQWRNSDADTVILGCTHYPLLYQPIYEYFSGTKTVISSGLETAREVSALLTFSNEHASYTEHPQHRFFATGDTTHIKNIIDEWLNMKVEVQRITVDDS

SEQ ID NO: 5579 - protein, 210 aa, Staphylococcus epidermidis
QFMNFKKTVAIVLTSAVLLAGCTIDKKEIKKYDDQVQKAMDQEKTVNQVSKKINELEEKKQKLFKKVNDKDQSTRKKAAEDIVENVKQRQKEFEKEEKALDNSEKEFKQAKQYLEHVENKAKKKEVEQLDSAIKEKYKSHDAYAKAYKKALNKEKELFSYLNEDNATQSEVDGKSKDLSKAYKEMNNKFNAYSKAIEKVKREKQDVDQLK

SEQ ID NO: 5580 - protein, 427 aa, Staphylococcus epidermidis
FYMKLIKNGKILKNGILKDTEILIDGKRIKQISSKINASSSNIEVIDAKGNLIAPGFVDVHVHLREPGGEHKETIESGTKAAARGGFTTVCPMPNTRPVPDTVEHVRELRQRISETAQVRVLPYAAITKRQAGTELVDFEKLALEGVFAFTDDGVGVQTASMMYAAMKQAAKVKKPIVAHCEDNSLIYGGAMHKGKRSEELGIPGIPNIAESVQIARDVLLAEATGCHYHVCHVSTKESVRVIRDAKKAGIHVTAEVTPHHLLLTENDVPGDDSNYKMNPPLRSNEDREALLEGLLDGTIDCIATDHAPHAKEEKAQPMTKAPFGIVGSETAFPLLYTHFVRRGNWSLQQLVDYFTIKPATIFNLNYGKLHKDSYADLTIIDLNTEKEIKSEDFLSKADNTPFIGEKVYGNPTLTMLKGEVVFEEEK

SEQ ID NO: 5581 - protein, 133 aa, Staphylococcus epidermidis
NKMKIFLKKSLEIHPLNLKKVTKMGQNDLVKTLRMNYLFDFYQSLLTNKQKNYLELFYLQDYSLSEIADTFEVSRQAVYDNIRRTGDLVEDYESKLRLYQRFEKRRELYNLMKQSLNQPELLKQYITQLEELE

SEQ ID NO: 5582 - protein, 158 aa, Staphylococcus epidermidis
VRMKLMNVPILPTISTSCIVISAILVAIGWALIWKRQVHKHKNIMLWAAFFALTFFIIYAARTIFIGNTAFGGPSSIKVYYTIFLVFHIILATVGGVLGLIQIILAFKDKLHIHRKIGPWASIIWFFTAITGVAVYVLLYVLYPGGETTSLLKATLGL

SEQ ID NO: 5583 - protein, 223 aa, Staphylococcus epidermidis
WRTNMDKEYVVIGLGRFGGSIVRELNALDMDVMAIDRDENRVNEYSDIATHAVVADTTDEAVMKSLGIRNFDHVIVAIGENIQSSTLTTLILKELGVKKVTAKAQNDYHAKILNKIGADTVVHPERDMGRRIAHNVASASVLDYLELADEHSIVELKSTEKMAGQTIIELDIRAQYGINIIAIKRAKEFIVSPDPNINIEIGDILIMIGHDNDLGRFEKNISK

SEQ ID NO: 5584 - protein, 437 aa, Staphylococcus epidermidis
EDKNVAFEFRLPDIGEGIHEGEIVKWFIKAGDTIEEDDVLAEVQNDKSVVEIPSPVSGTVEEVLVDEGTVAVVGDVIVKIDAPDAEEMQFKGHGDDEDSKKEEKEQESPVQEEASSTQSQEKTEVDESKTVKAMPSVRKYARENGVNIKAVNGSGKNGRITKEDIDAYLNGGSSEEGSNTSAASESTSSDVVNASATQALPEGDFPETTEKIPAMRKAIAKAMVNSKHTAPHVTLMDEIDVQELWDHRKKFKEIAAEQGTKLTFLPYVVKALVSALKKYPALNTSFNEEAGEVVHKHYWNIGIAADTDKGLLVPVVKHADRKSIFEISDEINELAVKARDGKLTSEEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 5585 - protein, 351 aa, Staphylococcus epidermidis
KMKKLIIKVIGVILLVTFLIYLFYSPRLKFDVLENPNKNSKTTKTEQFKQVNKDAENPKPKEGIGTWIGKDIKTLTHHYGQADRSYPYKNGLKNYVFKQKDEYYIVSTNKGTITSVYATGKGVKVSPLKIGESSSHIFEDTSINPEPTVKTKGKTYKFEMSDEDLKTQTLIKYGDVYAQIYSDQQTNKILAVRFLDANTLATLQPYKLNRAEDEGQISESSDDKIPHEQNPNQLITLYEVTNKMREMKNLNSLKVNNDIARIAAINLYEATDKGSNSVEFTENALTQQLDERHVSYKSASQNVGYDFDDVPTLIHSWINSDIHRSRLLSNKYDEMGGEVMSDYYSLIFVEK

SEQ ID NO: 5586 - protein, 187 aa, Staphylococcus epidermidis
MKWKCESMRVIAGKHKSKALESLEGRNTRPTMDKVKEGIFNSLYDVSGLGLDLFAGSGALGIEALSRGMDKMIFVDQNFKAVKVIKANLNQLDLMSQAEVYKNNADRALKALAKREIQFDVIFLDPPYNKGLINEAISRIAEFNLLKENGIIVCEFSHNEKITIAPFQMIKRYHYGLTDTLLLEKGE

SEQ ID NO: 5587 - protein, 173 aa, Staphylococcus epidermidis
MLIDIVVLLIICYFIVIGFRRGIWLSILHFASSIVSLYIASQHYQSIAQRLVVFVPFPKTVAFDMVYTIPYDHLQYRFEKVIAFIIIFGMCKLILYLVVVTFDNIITYKKIHLVSRISSVVLSIISVFIYLQIGLYLLSLYPHSFIQYQLSQSLVSRVVIEQIPYLSQFILNL

SEQ ID NO: 5588 - protein, 608 aa, Staphylococcus epidermidis
FISEIKSRALDLNIQGSDISMAEKKIIVVGGGLAGLMSTIKAAEQGAHVDLFSIVPVKRSHSVCAQGGINGAVNTKGEGDSPWIHFDDTVYGGDFLANQPPVKAMADAAPKIIHLLDRMGVMFNRTKEGLLDFRRFGGTLHHRTAFAGATTGQQLLYALDEQVRSFEVDGLVTKYEGWEFLGIVKDEEDAARGIVAQNMTTSEIQSFGSDAVIMATGGPGIIFGKTTNSMINTGSAASIVYQQGAIYANGEFIQIHPTAIPGDDKLRLMSESARGEGGRIWTYKDGKPWYFLEEKYPDYGNLVPRDIATREIFDVCINQKLGINGENMVYLDLSHKDPHELDVKLGGIIEIYEKFTGDDPRKVPMKIFPAVHYSMGGLYVDYDQMTNIKGLFAAGECDFSQHGGNRLGANSLLSAIYGGTVAGPNAIKYVENVEKSYTDLDDSIFEARVKEEKERFDHLLNMRGTENAYKLHRELGEIMTANVTVVRENEKLLETDKKIQELMKRYEDIDMEDTQTWSNQAVFFTRQLWNMLVLARVITIGAYNRNESRGAHYKPEFPERNDEEWLKTTMARYKGRSEKPEFTYEPVDVSLIPPRKRDYTSKSKGGNK

SEQ ID NO: 5589 - protein, 79 aa, Staphylococcus epidermidis
CMTDTVIIYTQDDCPPCAFIKNYLVNKNIKFTEKNIKNQKYKNEMMDYDAFATPFILLKGMPMYQVDMEKLNDELNITP

SEQ ID NO: 5590 - protein, 149 aa, Staphylococcus epidermidis
IKDDSVITEETLDILDDIEDISDMIVQSDIYVSYRRAKMQLDADDEASLLYQAFLKVKDKYDDVMRFGKYHPDYKDIMLETRKRKRAYEMLPVVMEYKAKEVALQNLIDEVMSKIALAVSEHVKIETGNPFFQTGHDGCASGGTCNCSL

SEQ ID NO: 5591 - protein, 161 aa, Staphylococcus epidermidis
KKCDDMKKAIIVMFVVTVILTIAALIDEFMIQDAKHGQSRFTSHHPMKINTYKKGQCTYYVFERVKNDGNKINNTWSDAKHWDKKAIDDGYIVDRNPKKGSILQSSKGKYGHVAYIETINEDGSMQVSEMNYTQPYEITKRTIHTYDIKNYYYIHPQKIKT

SEQ ID NO: 5592 - protein, 258 aa, Staphylococcus epidermidis
ITIDIYQHFRKEEQDALDQFIDKCKQADANYAPVLTHFLDPRGQYILEVITRSYQDLHVTFFGGPHAERKRAIIAPLYFKPQPEDFELTLFELQYPKKFVTIQHQHVLGTLMSLGIQRDQLGDIIVGEDIQFVLTKQLESYIISELTRIKGASVKLNSIPTEDMIQSEENWKVHSTTVSALRLDVVLKEMIHKSRNIAQQLIIKKRVKVNHTVIDSTDFQLEQNDLLSIQGYGRAQIVEIGGKTKKNKLHIHYQTLFK

SEQ ID NO: 5593 - protein, 50 aa, Staphylococcus epidermidis
QLIDSKANKKIMKNYNWEYFKVQIIKKFSEPKTKSIYSQEKLMWSLFLDL

SEQ ID NO: 5594 - protein, 60 aa, Staphylococcus epidermidis
SNYDILFIHIRPPLYKRGMITNIPQSLIISFLPHMLCRKQIILIIILTMELIKVNLKQKQ

SEQ ID NO: 5595 - protein, 41 aa, Staphylococcus epidermidis
TINDDVFYFIEVFHVASPPFKESFDRLFYFPILLSKIQVEF

SEQ ID NO: 5596 - protein, 49 aa, Staphylococcus epidermidis
LQNDRIRFDSLSLSFCYLYYKVNLTQFVAFFILSNYEFLTVALFKFFNS

SEQ ID NO: 5597 - protein, 63 aa, Staphylococcus epidermidis
LQQDIDNMKRYTHKSRVFYYKVDRKVTLYTKYDKKVQVSERITLTTMGLNYNLCFVSNTMIEL

SEQ ID NO: 5598 - protein, 111 aa, Staphylococcus epidermidis
SHREYGATLRIRSSTMDIGLLSTIFRFIIFLVQIYYFGMIIYFFTSWVPSIRESKFGEFLGKLYEPFLEPFRKIIPPIGFIDISSIAAIFVLVLFQSGLVKIFNLILAYLS

SEQ ID NO: 5599 - protein, 465 aa, Staphylococcus epidermidis
MLMEENKNQPNKENMSNKDDNATHLNDSHRNEDLELFRRNKNARQRRRRRIDNQSKEKDATSTQSQLETKPMDKFIDNHKSHNQNKEIKSDLIEENVNDENDNQKNINDKLNDRIVQETNESRQSTEDDEEFPLDHRSEQQPKASRHSKKHKLLSKFTSKKEKETSTSFNSNEKVTQIKPLSLEEKRAIRRKKQKRIQYTIITLLILIIVLILLYMVTPLSKISNVNVKGNNNVSTSKIKKELNVTSRSRMYTFSKNKAIRNLKQNPLIKEVDIHKQLPNTLTVNVTEYQIVGLEKNKDKYVPIIEDGKELTEYKDEVSHDGPIIDGFKGDKKTRIIKALSEMSPKVRNLIAEVSYAPTKNKQSRIKIFTKDNMQVIGDITTIADKMQYYPQMSQSLSRDDSGELKTNGYIDLSVGASFIPYQGSSTVQSGTEQNVTKSTQEENDAKEELQNVLNKINKQSKENN

SEQ ID NO: 5600 - protein, 437 aa, Staphylococcus epidermidis
INMENEQMFERTVQPVLDVKDKPKPAQWAFLSLQHLFAMFGSTVLVPFLTHLPISAALLASGIGTLLYILITKAKIPAYLGSSFAFITPIITGLSTHSLGDMLVALFMSGLMYVIIGIFIKLSGTHWLMHLLPPVVVGPVIMVIGLSLAPTAVNMAMFENSAEMKGYNLSYLIVALITLAVTIIVQGFFKGFLSLIPVLIGIIVGYIVSIFMGIVKFAPIAQAKWIDFPHIYLPFKDYTPSFHLGLILVMIPVVFVTVSEHIGHQMVINKIVGRNFFENPGLDKSIIGDGVSTMFASMIGGPPSTTYGENIGVLAITKIYSIYVIGGAAVIAIILAFIGKFTALISSIPTPVMGGVSILLFGIIAASGLRMLVESQVDFASNRNLVIASVVLVVGIGNLLINLKGIGINLQIEGMALSALSGIILNLILPKDKNQIN

SEQ ID NO: 5601 - protein, 79 aa, Staphylococcus epidermidis
SDVENFDKVKDIIVDRLGVDADKVTEDASFKDDLGADSLDIAELVMELEDEFGTEIPDEEAEKINTVGDAVKYINSLEK

SEQ ID NO: 5602 - protein, 167 aa, Staphylococcus epidermidis
KFREWAFMIQIKGAVNFPISLDSTTWIFDDRKVTIDDLERGVFDGTRPINFDDNKEWNRAILEGQTNPPTLDSEIKYKKRSVLDETFVINMTPFFKNAEPMENASTIKLSNKDYSINVPMDLLPYLFFQFSSNGKRLYSDNAVDSFIYIPEEGYSHQFKYVTHIEVI

SEQ ID NO: 5603 - protein, 50 aa, Staphylococcus epidermidis
YYLLLIRKSFKKESLAYLEILSVIYPKVGYYDKITHAHAYGGPSCCYCTR

SEQ ID NO: 5604 - protein, 50 aa, Staphylococcus epidermidis
FTILIETSILIFINDMSRYVNDKIETIIDTEFNEIEYHCDAIYYIIVKYC

SEQ ID NO: 5605 - protein, 121 aa, Staphylococcus epidermidis
LGVLTMNKFIKYFLILLSFGLLVVPIIFATQLYQSSESAFESSQNTKDSQRKSTLRDSKVDPEKQPISILFLGIDDNEGREKNGQSVEHSRSDAMILSTFNQKKLQKRKLSIPRDTISYIP

SEQ ID NO: 5606 - protein, 48 aa, Staphylococcus epidermidis
YTPLISLTIRPVFKKTPLIYIFLIILYQNTSTYNITTQFKLNDLPTNI

SEQ ID NO: 5607 - protein, 172 aa, Staphylococcus epidermidis
QILCYLKKENNMSKTRAVIPGSFDPITYGHLDIIERSADRFDEIHVCVLKNSSKGGTFDSEERMTLIEESVKHLPNIQVHHFNGLLVDFCDQVGAKTIIRGLRAVSDFEYELRLTSMNKKLNSNIETMYMMTSANYSFISSSIVKEVAAYQADISPFVPPHVERALKKKFNV

SEQ ID NO: 5608 - protein, 68 aa, Staphylococcus epidermidis
RQLWLSKSISLVKRERNRIHNEFIIPPSRNMTLNRESNKIFITETQTLKRFILSTFQGSQSTAKRFNG

SEQ ID NO: 5609 - protein, 1154 aa, Staphylococcus epidermidis
GVSWLLKQIKKLLVANRGEIAIRIFRAAAELNISTVAIYSNEDKSSLHRYKADESYLVGSDLGPAESYLNIERIIEVALRAGVDAIHPGYGFLSENEQFARRCAEEGIKFIGPHLEHLDMFGDKVKARTTAINANLPVIPGTDGPIESFEAAEQFANEAGYPLMIKATSGGGGKGMRIVRESSELEDAFHRAKSEAEKSFGNSEVYIERYIDNPKHIEVQVIGDEFGNIIHLYERDCSVQRRHQKVVEVAPSVGLSNKLRERICDAAIQLMENIKYVNAGTVEFLVSGDEFFFIEVNPRVQVEHTITEMITGIDIVKTQILVANGESLFGDKISMPQQNEIQTLGYAIQCRITTEDPTNDFMPDSGTIIAYRSSGGFGVRLDAGDGFQGAEISPYYDSLLVKLSTHAVSFKQAEEKMERSLREMRIRGVKTNIPFLINVMRNDKFRSGDYTTKFIEETPELFDIAPTLDRGTKTLEYIGNVTINGFPNVEKRPKPEYESTKIPKISQKKINQLFGTKQILEQHGPTGVTNWVREQEDVLITDTTFRDAHQSLLATRVRTKDMMNIASKTAEVFKDSFSLEMWGGATFDVAYNFLKENPWERLERLRKAIPNVLFQMLLRASNAVGYKNYPDNVIKKFVHESAKAGVDVFRIFDSLNWVDQMKVANEAVQEAGMVSEGTICYTGDILNAERSNIYTLDYYVKMAKELEREGFHILAIKDMAGLLKPKAAYELIGELREATHLPIHLHTHDTSGNGLLTYKQAIDAGVDIIDTAVASMSGLTSQPSANSLYYALNGFPRNLRTDIDGLEELSHYWSVVRPYYADFESDIKSPNTEIYQHEMPGGQYSNLSQQAKSLGLGERFDEVKEMYRRVNFLFGDLVKVTPSSKVVGDMALYMVQNDLDEDTVINDGYKLDFPESVVSFFKGDIGQPVNGFNKKLQDVILKGQQPITERPGEYLEPVDFEAIRQELSDIQQDEVTEQDIISYVLYPKVYKQYIQTKEQFGNVSLLDTPTFLFGMRNGETVEIEIDTGKRLIIKLETISEPDENGKRTIYYAMNGQARRIYIQDENVKTNANVKPKADKSNPNHIGAQMPGSVTEVKVSVGDEVQANQPLLITEAMKMETTIQAPFDGIIKQINVANGDAIATGDLLVEIEKQS

SEQ ID NO: 5610 - protein, 42 aa, Staphylococcus epidermidis
ANTCRIYHYKCWLSLVDIYYCYDIMDSILRCRAPQDFWFLHL

SEQ ID NO: 5611 - protein, 77 aa, Staphylococcus epidermidis
LANCFWFRFRKFLKVIFLYSNQKIQIMCRHIELLLTIFYDDIIDCITMIFNFIKFSIYNCFNFIIHISRHIIYEDEY

SEQ ID NO: 5612 - protein, 450 aa, Staphylococcus epidermidis
LFKWCTRVVSWESSIMMKSVRTYALETINDVLNKGAYSNLKINEVLSTNNINTVDKNLFTELVYGTIKRKYTLDYLLKPFIKTKIKSWVRQLLWMSLYQYLYLDKIPNHAIIHEAVDIAKKRGGFHTGNIVNGILRTVMRTELPSFEDIDDTKKRIAIQYSLPKWIVDHWVTHFGVEKTENIARSFLEPVTTTVRANISRDSIDSIISKLEQEGYHVKKDDMLPFCLHISGMPVVNSNAFKEGYISIQDKSSMMVAYVMNLGRDDKVLDACSAPGGKACHMAEILSPEGHVDATDIHEHKINLIKQNIKKLKLNNIKAFQHDATEVYDKMYDKILVDAPCSGLGVLRHKPEIKYSQSQNSIKSLVELQLQILENVKDNIKPGGTIVYSTCTIEQMENENVIYTFLKRHKDFEFEPFQNPATGEQVKTLQILPQDFNSDGFFISKIKRKES

SEQ ID NO: 5613 - protein, 383 aa, Staphylococcus epidermidis
SQKWRKCKMNFSKLKFGATIGIIGGGQLGKMMAQSAQKMGYKVIVLDPNEDCPCRYVAHQFIHANYDDEQALNQLGENSDVVTYEFENISSEQLKKLTQLYHIPQGYQAIELLQDRLTEKQTLLEANTQIVPFVQIHTNQDLLKAIEKLGFPCIVKTRFGGYDGKGQILVRNDSELDEAYQLVEKQECVAEQYLDIQKEVSLTVTIGNEQQTTYFPLQENEHQNQILFKTVVPARSDKENEARKEVEKITRAIHFVGTFTVEFFIDKENNLYVNEIAPRPHNSGHYSIEACDYSQFDTHILAITGQKLPQAIELLKPTVMMNLLGRDLDLLENEFSRHPDWHIHIYGKKERKPDRKMGHMTLLTDDVNQTEQYMLMKFEGRDK

SEQ ID NO: 5614 - protein, 668 aa, Staphylococcus epidermidis
SWRWTLMNFPWDQLLVKGNWMIISAQIAAPFLVIGLIAVISYFKLWKYLYKEWFTSVDHKKIGIMYLISAVLMFVRGGIDALMLRTQLTIPDNKFLEANHYNEVFTTHGVIMIIFMAMPFIFGLWNVVIPLQLGARDVAFPVMNNVSFWLFFAGMILFNLSFIVGGSPAAGWTNYAPLAGEFSPGPGVNYYLIAIQISGIGSLMTGINFFVTILRCKTPTMKFMQMPMFSVTTFITTLIVILAFPVFTVALALMTADRIFGTQFFTVANGGMPMLWANFFWVWGHPEVYIVILPAFGMYSEIIPTFARKRLFGHQSMIWATAGIAFLSFLVWVHHFFTMGNGALINSFFSISTMLIGVPTGVKLFNWLLTLYKGRITFESPMLFSLAFIPNFLLGGVTGVMLAMASADYQYHNTYFLVAHFHYTLVTGVVFACLAGLIFWYPKMMGYKLNETLNKWCFWFFMIGFNVCFLPQFILGLDGMPRRLYTYMPSDGWWLLNFISTIGAVLMAIGFLFLVASIVYSHIKAPREATGDNWDGLGRTLEWSTASAIPPKYNFAITPDWNDYDTFVDMKEHGRHYLDNHNYKDIHMPNNTPVGFWMGIFMTIGGFFLIFESIVPALICLAGIFITMIWRSFQIDHGYHIPASEVAETEARLREARIKEREAVSHES

SEQ ID NO: 5615 - protein, 56 aa, Staphylococcus epidermidis
KLLRIEIRIKAIDPGTNKTVPKYLAESGKKPINPTKKKTKKTFVTSQTGLRYLWIK

SEQ ID NO: 5616 - protein, 566 aa, Staphylococcus epidermidis
CGERRIMKQLHSNEVGVYALGGLGEVGKNTYAVEYKDEIVIIDAGIKFPDDNLLGIDYVIPDYTYLEQNQDKIVGLFITHGHEDHIGGVPFLLKQINVPIYGGPLALGLIRNKLEEHHLLRTTELHEIDESSVIKSKHFEISFYLTTHSIPEAYGVIVDTPEGKIVHTGDFKFDFTPVGEPANIAKMAQLGHEGVLCLLSDSTNALVPDFTLSEREVGQNVDKIFRNCKGRIIFATFASNIYRVQQAVEAAIKYNRKIVTFGRSMENNIKIGMELGYIKAPPETFIEPNKINSVPKHELLILCTGSQGEPMAALSRIANGTHKQIKIIPEDTVVFSSSPIPGNTKSINRTINALYKAGADVIHSKISNIHTSGHGSQGDQQLMLRLIQPKYFLPIHGEYRMLKAHGETGVQCGVDEDNVFIFDIGDVLALTHDSARKAGRIPSGNVLVDGSGIGDIGNVVIRDRKLLSEEGLVIVVVSIDFNTNKLLSGPDIISRGFVYMRESGQLIYDAQRKIKGDVISKLNSNKDIQWHQIKSSIIETLHPYLYEKTARKPMILPVIMKVNEDK

SEQ ID NO: 5617 - protein, 58 aa, Staphylococcus epidermidis
DKWRVSIYLSINRPSKYHINLDGHFNYDCFSISTNKSPVAMASPLATLICLIIPSNGA

SEQ ID NO: 5618 - protein, 466 aa, Staphylococcus epidermidis
PNILFRLIYSHILMGVILLNSNNNNHEQQRSLDEINNTINFNHNDSASQKFLAFLGPGLLVAVGYMDPGNWITSMQGGAQYGYTLLFIILISSLSAMLLQSMTVRLGIATGMDLAQMTRHFLNKPVAIMFWIIAELAIIATDIAEVIGSAIALDLIFGIPLIVGALITVFDVFLLLFIMKFGFRKIEAIVGTLIFTVLAIFVFEVYISSPHIIDMLNGFVPHKEIITNQGILYIALGIIGATIMPHNLYLHSSIVQSRKYDRHSIHEKAQAIKYATIDSNIQLSIAFVVNCLLLTLGAALFFGTKTEDLGGFYDLYLALKTEPALGATLGGIMSTLFAVALLASGQNSTITGTLAGQIVMEGFLKLSIPNWLRRLITRSLAVIPVIICLIVFKGNTEKIEQLLVFSQVFLSIALPFSLIPLQLATSNQNLMGPFKNKTWINIISWLLIIVLSGLNVYLIIQTFQEL

SEQ ID NO: 5619 - protein, 77 aa, Staphylococcus epidermidis
VDKLGAILTIIKNYQYRLKLYMIINHRLSYFYNYNDFLFFISLYACSAAFCSDSFFVFPLPSATALFSKITSDVNSL

SEQ ID NO: 5620 - protein, 299 aa, Staphylococcus epidermidis
VCILNQKQYTSWYQVKLKKNLISELKVMRTIIMHNINKWLLVPYLLWMVIFIIIPVILLVYFSFIDIHGHFSFTNYEQVFSTRYLKMFIDSIWYAALITMITLIISYPAAYFISYSRFQNILLMLLIIPTWINLLLKTYAFIGLLGHDGVINQALHIFQIPKLNLLFTSGAFLLVASYIYIPFMILPIFNSMKAIPNNILQASNDLGASTFTTFRKVIVPLTREGIKTGVQVTFIPALSLFMITRLIAGNKVINVGTAIEEQFLTIQNYGLGSTIALFLIIFMAFLLIITKSKSSNGKG

SEQ ID NO: 5621 - protein, 55 aa, Staphylococcus epidermidis
LEYRNITLRNFLNLNQKQLASYRRNMICIKGTYISKIVYQQAYYSLKIIKETISI

SEQ ID NO: 5622 - protein, 100 aa, Staphylococcus epidermidis
KVFRTKNKKHLQSRKIDVEPVFGFMKAILGFTRMSVRGINKVKRELGFVLMALNIRKVTAQRAENNQKNNKKDNFYIISIEIVFFIYLGTLSPTLFIYVR

SEQ ID NO: 5623 - protein, 42 aa, Staphylococcus epidermidis
VHFRVVNLLRRDLMAKTSHLYFRFIDDLFIIIIHKLIIKLKK

SEQ ID NO: 5624 - protein, 591 aa, Staphylococcus epidermidis
HEVRTNSNVNVMSWSSFYGVILMTKKDVIQLLEKIAIYMELKGENTFKVSAYRKAAQSLEVDERTLEEIDDVTELKGIGKGVGEVINEFKTQGQSSTLQTLQDEVPEGLVPLLKIQGLGSKKIAKLYHELQITDKETLQQACEEGKVSTLKGFAKKTEQNILEAVKSIGAKKDRYPIELMRGLNQEIVKFIEQLEGVEQYSTAGSFRRYKEMSKDLDFIISTSEPKKVQQQLLRIPNKVKDVAVGDTKISLELAYDDETIGVDFRLIEPAAFYHTLQHFTGSKDHNIRIRQLAKARDEKVSEYGIEQQDGKLLQLQSEEAIYHHFGVDWIAPAMREDGSEFDKDLSQIIQLDDINGDLHMHTTYSDGAFSIKEMIEANIEKGYEFMVITDHSQSLKVAHGLQVDRLLRQNEEIKQLNEEYKEIDIYSGTEMDILPDGTLDYDDEVLAQLDYVIAAIHQNFNQSEDEIMKRLETACRNPYVRHIAHPTGRIIGRRKGYKANIEKLMNLAEETNTILEINANPHRLDLNAEIVRKYPKVKLTINTDAHHTNHLDFMKYGVATAQKGFVNKERVINTMTKEAFRSFVETNKYKK

SEQ ID NO: 5625 - protein, 573 aa, Staphylococcus epidermidis
KSIRWQIIMAYDGLFTKKMIESLQGLVSGRIHKINQPENDTIIIVIRQNRKNHQLLLSIHPSFSRLQLTTKKYDNPFTPPMFARVFRKHLEGGFIKAIRQVGNDRRIEIDIESKDEIGDTIYRTIILEIMGKHSNLILVDDQRKIIEGFKHLTPNTNQYRTVMPGFKYEAPPNQNKINPYELTGQEVLKYIDFNAGKIAKQLLNICEGFSPLIANEIVNRRQFMTQETLPDAFDEVMAETKSAPTPVFHKNHETGKEDFYFMKLNQFYDDIVEYHSLHELLDRFYDARGERERVKQRANDLVRFVQQQLQKQQNKLSKLIDEYESAKNKETQQLYGELITANIYRIQQGDDSVIALNYYTGEEVKIPLNPTKSPSTNAQYYYKQYNRMKTREHELTHQIKLTKENIDYFDNIEQQLKHITVDDIDDIRDELAEQGFMKQRKQSKKKKQSKIQLQTYHSTDGDTILVGKNNKQNDYLTNKKARKNHLWFHTKDIPGSHVVILNESPSETTIKEAAMLAGYFSKAGSSAQIPVDYTEIRHVHKPSGAKPGFVTYDNQKTLFATPDYDHIQQMKES

SEQ ID NO: 5626 - protein, 52 aa, Staphylococcus epidermidis
LSTSILKPLAAIIPNNKIETPPITGVGIEDIKAVNLPINARMIAITAAPPIT

SEQ ID NO: 5627 - protein, 170 aa, Staphylococcus epidermidis
QSKSFERVYKVKVAVIMGSSSDWKIMKESCSMLEEFEIPYEKKVVSAHRTPQMMFNFASQARQNGFDIIIAGAGGAAHLPGMVASMTTLPVIGVPIESKSLKGLDSLLSIVQMPGGIPVATTAIGKSGAKNAGILAARMLGITNESVQNNLENYEKSLVAKVEEMQNELQ

SEQ ID NO: 5628 - protein, 53 aa, Staphylococcus epidermidis
FNMRKVQCIICDTKVFIDEHTVEAKRLKNNPIRTFMCDDCKSRLDTPKQSKRD

SEQ ID NO: 5629 - protein, 204 aa, Staphylococcus epidermidis
ENRSEPPLALKDLFNNFFVVEEEEEVEGPEERESSRSRERVQEREDYNRNENQATPQTFNNKQQAIKSVPQKNTLRSNTTSEERNYRMNNNSKNNSRNVVTMNQASQSYAAQESSKMCLFEPRVFSDTQDIADELKNRRATLVNLQRIDQVSAKRIIDFLSGTVYAIGGDIQRVGTDIFLCTPDNVEVAGSITDHIENMEQHYE

SEQ ID NO: 5630 - protein, 471 aa, Staphylococcus epidermidis
FVRRCLSMEEHYYVSIDIGSSSVKTIVGEKFHNGINVIGTGQTYTSGIKNGLIDDFDIARQAIKDTIKKASIASGVDIKDVFLKLPIIGTEVYDESNEIEFYEDTEIDGTHIESVLEGIRDKNDVPETEVINVFPIRFVVDKDNEVSDPKELIARHSLKVDAGVIAIQKSILINMIKCVEACGVDVLDVYSDAYNYGSILTPTEKELGACVIDIGEDLTQVAFYERGELVDAESIEMAGRDITDDIAQGLNTTYDTAEKVKHQYGHAFYDSASDQDVFSVDQVDSDEHVQYTQKDLSDFIEQRVEDIFFEVFDVLQELGLTKVNGGFVVTGGSANLLGVKELLQDMVSEKVRIHTPSQMGIRKPEFSSAISTISSSIAFDELLDYVTISYQDNEEFEEEVIETDKDTETKSSGFDWFKRKSNKKENDEVAPEAPREESYEDRENHLEDEQQTEGKAKEESKFKKLMKSLFE

SEQ ID NO: 5631 - protein, 111 aa, Staphylococcus epidermidis
KLRRIGIMAIVKVTDSDFDSKIESGVKLVDFWATWCGPCKMIAPVLEELAGDYDGKADILKLDVDENPSTAAKYEVMSIPTLIVFKDGEPVDKVVGFQLKENLAEVLDKHL

SEQ ID NO: 5632 - protein, 74 aa, Staphylococcus epidermidis
MVRRRLMEQNNDNNHLYTLIKHCNEFLYRRDDYRIPSDSQSDHSNNENILKTMNDEVFKHSIEIFKRAKKNLNH

SEQ ID NO: 5633 - protein, 49 aa, Staphylococcus epidermidis
INAGLLCKTLGHFAYKFLRISNLNYMFRRGDSFWLNQRMNFTLEDYIRY

SEQ ID NO: 5634 - protein, 54 aa, Staphylococcus epidermidis
  MOD_RES (3)..(3): Variable amino acid
IMXFLNKSLFQNISPPNNIYTFHYTLNFKLKSSKNNLNIKCPIMKQLYIILKFI

SEQ ID NO: 5635 - protein, 51 aa, Staphylococcus epidermidis
YLDGLFILKYIETRHLSYRYGILSGVFLFNCYKFIEKYIILDFSSFLTLVK

SEQ ID NO: 5636 - protein, 384 aa, Staphylococcus epidermidis
RMLGEQYTQIKRPANRLTEKILGWFSWVFLLILTIVSMFIALVSFSNDTSIANLENTLNNNELVQQILANNDLSTTQFVIWLQNGVWAIIVYFIVCLLISFLALISMNIRILSGFLFLIAAIVTIPLVLLIVTLIIPILFFIIAMMMFARRDRIETVPSYYNEYDQPYYDERGFYEPESRNEHGYNDDVYEPMHTKKEDRNTRRQFNRNAQQQDSYNGITDNQPDEDTSSDQLYSDEYVDNEDKYSQFPKRAVESEYASQQTEDEPTVMSRQAKYNKKSKNTDFEDAQQEHMEGNQFDDVGVVEPQIDPKELKAQRKREKAEIRAKKKEKRKAYNKRMKERRKNQPSAVNQRRMNYEERRQMINNEQEDTDNNLNQQEDSKKEN

SEQ ID NO: 5637 - protein, 668 aa, Staphylococcus epidermidis
SMIGKVINERYTITDKLGGGGMSIVYLAVDSILNRKVAIKAISIPPSEKEETFKRFEREVHNSSQLSHENIVSMIDVDEEDDCFYIVMEYIEGPTLAEYIHSHGPLSVETAIQFTEQILSGIKHAHDMRIVHRDIKPQNILIDKNKKLQIFDFGIAKALSETSLTQTNHVLGTVQYLSPEQAKGEATDESTDIYSIGIVLYEMLVGEPPFNGETAVSIAIKHIQDSIPNITTDKRDDVPQSLSNVVLRATEKDKYHRYHTVQEMCDDLTSALHENRLNEEKYELDKTKTVPLTKDDLNHKIYDEQNQNDLNKTMQIPIVNDSIKQQEFQSSEPRYYQKSDKKRSKMKIAILSIIFVILLIGLFSFVAMAVFGNKYEEMPDLKGKTEKQAEKVLDSHHLKVGDISRNYSDKYPENQIIKTNPDSGERVEQGNRVDIVLSKGPEKVKMPNVLGMSKNDALKKLKAIGFKDIHVEQAYSQTYEKGLISEQSVVANSEVAVNNHHITIYESLGVRQVYVNNYENKSYESAKKELEDKGFKVQVTKENNDDVEKGNVISQSPKDKTVDEGSTILLVVSKGEKSEEDDDEEDKDTTTKNETVKVPYTGKKSKSQKVEVFIRDIENKGDSAVQTFNIKSDKTINIPLKIKKGSDAGYTIRVDNKIVADKDVSYDG

SEQ ID NO: 5638 - protein, 53 aa, Staphylococcus epidermidis
KWIGCQQKTTKKSATAAKLNDPSIATQPINGGTAPGKLPTTVFQVVWRLDQIE

SEQ ID NO: 5639 - protein, 95 aa, Staphylococcus epidermidis
LYKGEFNMEQKSYVITDETGIHARPATMLVQTASKFDSDIQLEYNGKKVNLKSIMGVMSLGVGKDAEITIYADGSDETDAIQSITDVLSKEGLAE

SEQ ID NO: 5640 - protein, 415 aa, Staphylococcus epidermidis
GYEGGTSMSFFKRLKDKFSSKSEDDIQKDLDETVDSNANSDSDSMDPNDSDEQVKPKKKPKKLSEADFDEDGLISIEDFEEIEAQKIGAKFKAGLEKSRQNFQEQLNNLIARYRKVDEDFFEALEEMLITADVGFNTVMKLTDELRTEAQRRNIQETEDLREVIVEKIVEIYHQEDDYSEAMNIEDGRLNVILMVGVNGVGKTTTIGKLAYRYQQEGKKVMLAAGDTFRAGAIQQLNVWGERVGVEVVSQNEGSDPAAVVYDAINAAKNKGVDILICDTAGRLQNKSNLMQELDKMKRVINRAIPDAPHEALLCLDATTGQNALSQARSFKEVTNVSGIVLTKLDGTAKGGIVLAIRNELHIPVKYVGLGEKMDDLQPFNPESYVYGLFADMIEQNEDIPEEISRNSSVESEEGN

SEQ ID NO: 5641 - protein, 382 aa, Staphylococcus epidermidis
RSEGFNRCHSFIFIGGNCMNPLLSFKDVSKGFEDVQILNEINIDIEPGYFYTLLGPSGCGKTTILKLIAGFEYPDSGDIIYKDKPIGKMPPNKRKVNTVFQDYALFPHLNVFDNIAYGLKLKKLSKSEIKRKVTEALQLVKLSGYEHRQIQGMSGGQKQRVAIARAIVNEPEILLLDESLSALDLKLRTEMQYLLRELQSRLGITFIFVTHDQEEALALSDYIFVMKDGKIQQFGTPIDIYDEPVNRFVADFIGESNIVHGTMVEDFVVNIYGQNFDCVDMGIKENKKVEVVIRPEDISLVSQNDGLFKAKVDSMLFRGVHYEICCKDRKGYEWVIQSTKKANVGSEVGLYFEPEAIHIMVPGETEEEFDKRIESYEDYHHA

SEQ ID NO: 5642 - protein, 202 aa, Staphylococcus epidermidis
FIEGENDMEDIVIATNNQGKINDFKAIFKNQHVIGISELIEDFDVEETGATFEENARLKSEAAAHALNKRVIADDSGLEVFALNGEPGVYSARYAGLGKNDEDNIEKLLTNLEDVQDRRAQFVCVISMSAPNEKTKTFKGTVSGVITTERHGKNGFGYDPIFFVPELNKTMAEITNDEKGKISHRGNAIRLLKEYLEGEQHV

SEQ ID NO: 5643 - protein, 735 aa, Staphylococcus epidermidis
KVGGNKMSKFIEPSNEEIKLEKLYQDIGLSDKEYDKVVEILGREPNFTEVGIFSVMWSEHCSYKHSKPFLKQFPTTGEHVLMGPGEGAGVVDIGDNQAVVFKVESHNHPSAIEPYQGAATGVGGIIRDIVSIGARPINLLNSLRFGELTVKQNQRLLKGVVSGIGGYGNCIGIPTTAGEIEFDERYDGNPLVNAMCVGIIDHDMVQKGTAKGVGNSVIYVGLKTGRDGIHGATFASEELTEESESKRPSVQIGDPFVGKKLMEATLEAITFDELVGIQDMGAAGLTSSSSEMAAKGGSGLHLRLDQVPTREPGISPYEMMFSETQESMLLVVEKGTEQKFLDLFNKHELDSAVIGEVTDTDRFVLTYDDEVYADIPVQPLADEAPVYILEGEEKEYNTSKNDYSNIDVHDTFIKLLQHPTIASKHHLYEQYDQQVGANTIIKPGLQASVVRVEGTQKAIASTIDGEARYVFNQPYEGGKMVVAEAYRNLIAVGATPLAMTDCLNYGSPEKKEIYQQLIDSTKGMSEACKVLQTPVVSGNVSLYNETRGTSIFPTPVVGMVGLIEDVSYLKEFKPKAGDKIYLVGETRDDFGGSQLEKLLYGSVNHEFESIDLSDEVSKGKLIKQAIRNGIASHVQTVGKGGLLVTLAKISAHYDLGMQAQLDVTNAQLFSETQGRYIVVVKEGQTLDIDQAQEIGHLTHQQLFDISNSDVKIKENVSDIKQKWEGAIVQCLTTQD

SEQ ID NO: 5644 - protein, 48 aa, Staphylococcus epidermidis
DKTGKNTVISRIYNQMIKRVRKWWIGGGTEHIYPKIIHNLKWIPNSFL

SEQ ID NO: 5645 - protein, 62 aa, Staphylococcus epidermidis
INKGVLIFRKNLRKYANLSKECTVIGVSNRIEIWDRETWNDFYDESEESFEDIAEDLIDFDF

SEQ ID NO: 5646 - protein, 419 aa, Staphylococcus epidermidis
KERGNLLKVLIVGAGGREHTLASKINQSPIVDKVYAIPGNDAMVNIAEVHSEIAESDHQAILHFAQHNAIDWVIIGPEQPLIDGLADLLRNANIKVFGPGQDAAQIEGSKLFAKQLMDKYRIPTAEYKEVSSRNEALQYVETCDLPIVIKKDGLAAGKGVIIAFTREDALEGVKKIYQEEKGKVVFESYLEGEEFSLMTFVNGDYAVPFDCIAQDHKRAFDNDQGPNTGGMGAYCPVPHIDASVLEQTNKEIAQPIAKAMAQEGHDFFGLLYIGAILTKDGPKVIEFNARFGDPEAQVLLTRLESDLMQLIIDLENCQPIHFNWKDEAVVGVMLASKGYPGSYEKGHEISGFNLDSHYYVSGLKKEGQCFVNSGGRVILAIGEGPTVEKAQANAYEHARQIKSDNLFYRNDIGNKAITK

SEQ ID NO: 5647 - protein, 73 aa, Staphylococcus epidermidis
CVFIFIKGGTFMGKQCFVTGRKASTGNHRSHALNANKRRWNANLQKVRILVDGKPKKVWVSARALKSGKVTRV

SEQ ID NO: 5648 - protein, 391 aa, Staphylococcus epidermidis
TKIIGKPYICSIRRSKKVSKFKSLLLLFGTLILLSGCSNIEVFNAKGPVASSQKFLIIYSIIFMLVIVAVVLSMFAIFIFKYSYKKNSESGKMHHNSLIETIWFVVPILIVIALAIPTVKTLYDYEKPPEKDKDPLVVYAVSAGYKWFFAYPDQHIETVNTLTIPKDRPVVFKLQSMDTMTSFWIPQLGGQKYAMTGMTMNWTLTADQLGTFRGRNSNFNGEGFSRQTFKVHSVSQNDFDKWVKEAKGKKTLSQDTFDKQLLPSTSNKELTFSGTHMAFVDPAADPEYIFYAYKRYNFEQKDPNFTAEEDLYKDVKDKPIKPARKVHITNPNYERHGMKPMILGNNEKYDNEFKKEEDHNSKEMEKISKGAKDENASKLHKKEHDDHGGGH

SEQ ID NO: 5649 - protein, 42 aa, Staphylococcus epidermidis
PKVIRLSQYIGDLIPELQVNKSFGDNETASMSNNALAIFLAI

SEQ ID NO: 5650 - protein, 44 aa, Staphylococcus epidermidis
AGIFAFVINMYKSVPIPDANKAADIGRCVKNGTSTVDPNIANKC

SEQ ID NO: 5651 - protein, 58 aa, Staphylococcus epidermidis
GKSIHFACAIGANLTMPMKMDTIYPTIIPISTGISDKNPLKNPWTMMVTANVIKATIK

SEQ ID NO: 5652 - protein, 361 aa, Staphylococcus epidermidis
RDYIRRNSVMTQNDLMSELKQQALVDINEAKDAQALQEVKVKYLGKKGSVSGLMKNMKDLPNEDKPAYGQKVNELRQTIQSELDERQKLIKEEKLNQQLSEETIDVTLPSRHIEIGSKHPLTRTVEEIEDLFLGLGYEIVDGYEVEQDYYNFEALNLPKSHPARDMQDSFYITEEILMRTHTSPVQARTMEKRKGQGPVKIICPGKVYRRDSDDATHSHQFTQIEGLVVDKDIKMSDLKGTLELVAKKLFGADREIRLRPSYFPFTEPSVEVDVSCFKCKGQGCNVCKHTGWIEILGAGMVHPNVLEMAGFDSKEYSGFAFGMGPDRIAMLKYGIEDIRHFYTNDVRFLDQFKAVEDRGEQ

SEQ ID NO: 5653 - protein, 84 aa, Staphylococcus epidermidis
EMNIIPRTSLIIYLKHMKHERQIRKYGHIVHSNRQRKYVVMYINEADADNIVHKLMQLKYVHEIQGSPYKYLKKTYEKEKHEIQ

SEQ ID NO: 5654 - protein, 41 aa, Staphylococcus epidermidis
IYFILVSLHSTDCKETFFMKGNESTWKMSKCLSVPFSQFLM

SEQ ID NO: 5655 - protein, 442 aa, Staphylococcus epidermidis
TIFIYNNFEVNSMSFLRKHTEIIFSYIIGIVSLFTGLIIFINLPLIKQFKGDKKVDTHVHNVWEFLNAFFAEIIKVMSKFIGGFPITSAIVIIVFGILVMLLGHTLFRTIKYDYDISIFFLVIGIMYFIITLLLMTQVYGFFAIVFIIPFTVHIGYIVYKDELNQDNRKNHYMWIIVTYGMSYLITQISLYGRIDANEIESIDILSVNTFFIIMWLLGQMAIWNFLFLRRSLPLTKEELGEEEPELSRTNKGNVSNQTKVHLKQLQNKTTEYARKTRRSVDLDKIRAKRDKFKQKINSIVDIQEDDIPNWMKKPKWVKPMYVQLFCGVIILFFAFLEFNNRNALFLTGEWELSQTQYVVEWVTLLLLLFIIIIYIATTLTYYLRDKYYYLQLFMGSILFFKFLTEFINIMVHGLLLSIFITPILLLMLIAMIVAYSLQLREK

SEQ ID NO: 5656 - protein, 101 aa, Staphylococcus epidermidis
KMFMGEFDHQLDTKGRMIIPSKFRYDLNERFIITRGLDKCLFGYTLEEWQQIEEKMKTLPMTKKDARKFMRMFSSGAVEVELDKQGRINIPQKFKEICQFK

SEQ ID NO: 5657 - protein, 47 aa, Staphylococcus epidermidis
VKIILINVKKLSITYRSVIIVSRCKIYMLKTILNELNLAIGFGKVKL

SEQ ID NO: 5658 - protein, 571 aa, Staphylococcus epidermidis
DNYIQRRDYIMKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQTGGKPAATKPEGASAETAPAPNNADENHAQPSPQTGGTTATQAGQVKPSGDSTPTGEPNKADDQDTQIKPTSNQGTTATTNEIGNQKPSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPGSAPNQDTEATPNPDQNNTPTNGQDGDQTNQSTQDDNDNQNTQQGNTKQNNQNAEQGNTGGTDKDAKVNTNDDETKTDVKNDTELPETGLSNEYDYTTTVFGSIALISSLLLLRRQRKESK

SEQ ID NO: 5659 - protein, 136 aa, Staphylococcus epidermidis
HMDIPKITTFLMFNDEAEEAIQLYTSLFEDSEIITMVKYGEEGPGTPGSVQHSIFTLNGQVFMAIDANSGEELPMNPAMSLYVTVKDTMEMERLFNGLKNEGAILMPKTEMPPFREFAWVQDKFGVSFQLALPENK

SEQ ID NO: 5660 - protein, 785 aa, Staphylococcus epidermidis
RDCMRQKTLDVLEFEKIKSFVADETISDLGREKVQEMAPASNFDTVEFQMNETDEISQIYNKHRLPSLSGLAKVSPLVHRASIGGVLNVGELNRIKRLVQVQNQFKTFYNQMLEEDEEVKYPILHDKMNHLPILTDLFKEINEKCDAHDLFDHASYTLQSIRSKISRTNQRIRQNLDRIVKNQGNQKKLSDAIVTVRNDRNVIPVKAEYRQDFNGIVHDQSASGQTLYIEPNSVVEMNNQISRLRNDEAVERERILTELTGLVSAESDALLVAESVMGQIDFLIAKARYARTIKGTKPTFKEDRTIYLPNAFHPLLDKDTVVANTIEFIDDVETVIITGPNTGGKTVTLKTLGLIIVMAQSGLLIPTLDGSQLSIFENVYCDIGDEQSIEQSLSTFSSHMKNIVEILQDADQNSLILFDELGAGTDPSEGAALAMSILDYVRRLGSLVMATTHYPELKAYSYNREGVMNANVEFDVDTLSPTYKLLMGVPGRSNAFDISKKLGLSLNIINKAKTMIGTDEQEINAMIESLEHNSKRVDQQRIELDRLVREAQETHDALSKQYQQYQNYEKSLMEEAKEKANQRVKSATKEADEILKELRNLRDHKGAEVKEHELIDKKKQLDDQYEAKSIKQHVQKKKYDTIHAGDEVKVLSYGQKGEVLELVGNEEAVVQMGIIKMKLPIEDLEKTKKKKEKPTKMVTRQNRQTIKTELDLRGYRYEEALNELDQYLDQAVLSNYEQVYIIHGKGTGALQKGVQQHLKKHKSVRQFRGGMPSEGGFGVTVAELK

SEQ ID NO: 5661 - protein, 61 aa, Staphylococcus epidermidis
GGLIMAVPKRRTSKTRKNKRRTHFKISVPGMTECPNCGEYKLSHRVCKNCGSYNGEEVVSK

SEQ ID NO: 5662 - protein, 1211 aa, Staphylococcus epidermidis
FLIIVNIAPSLSTQHDCDKENTMVYLKSIDAIGFKSFADHTNVQFDKGVTAIVGPNGSGKSNITDAIKWVLGEQSAKSLRGAKMEDIIFSGAEHRKAQNFAEVKLKLDNHSQKLQIDSEELVVTRRLYRSGESEYYLNNDRARLKDIIDLFLDSGLGKEAFSIISQGRVDEILNAKPINRRQIIEESAGVLKYKKRKAESIQKLDHTEDNLNRVEDILYDLEGRVEPLKEEAAIAKEYKQLSKEMEQSDVIVTVSDIDHYTEDNQRLDERLNHLKSQQAEKEGQQAQINQLLQKYKGKRQQNDYDIEKLNYELVKATENYEQLSGKLNVLEERKKNQSETNARYEEELDNLESQIDSIKNEKAQNEKLLADLKNKQKQLNKEVQELESLLYISDEQHDEKLEEIKNSYYTLMSEQSVVNNDIRFLEHTINENEAKKSRLDSRLVEAFNQLKDIQQNITQTQKEYQSSKKSMEKVEQNIQQLEQQLTDSKRLLSEYENKLYQAYRYNEKLKSRIDSLATQEEDYTYFFNGVKHILKAKDKELRGIHGAVAEVINVPSEMTQAIETALGASLQHVIVDNEKDGRQAIQYLKQRGLGRATFLPLNVIQPRHVAADIKDVARGSQGFINIASDAINVSAKYQNIIENLLGNTIIVENLKHANELARAIRYRTRIVTLEGDVVNPGGSMTGGGARKTKSILSQKDELSTMRNQLEDYQRQTAEFERQFKEQKTQAEQLSEQYFSASQQYNNLKEQVHHHELELDRLKTQEAHLKNEHEEFEFEKNDGYQSDKSKETLKEKQNHLIEIQQQLKQLESDIERYTQLSKEGKASTHQTQQQLHQKQSDLAVVKERIKSQKQVYERLDKQLSDSERQKIEVNEKIKLFNSDEMMGKDAFEKLKEQIQQQENVRQNLNQQLSEIKQQRKDLNEKIEINESQLQKCHQDILSIENHYQDIKAKQSKLDVLINHAIDHLNDTYQLTVERARMEYDSDETIDNLRKKVKLTKMSIDELGPVNLNAIEQFEELNERYTFLNEQRTDLREAKETLEQIIHEMDKEVEGRFKTTFHAVQDHFTTVFKQLFGGGQAELRLTEDDYLSAGVDIIVQPPGKKLQHLSLLSGGERALSAIALLFAILKVRSAPFVILDEVEAALDEANVIRYAQYLNELSTETQFIVITHRKGTMEFSDRLYGVTMQESGVSKLVSVNLNTIDEVMKEEQA

SEQ ID NO: 5663 - protein, 778 aa, Staphylococcus epidermidis
CVIMAKRKIKIKKNKIGAVLLVGLFGLLFFILVLRFSYVMITGHSNGQDLIMKANEKYLVKNSQQPERGKIYDRNGKVLAEDVERYKLVAVVDKKASKESKKPRHVVDKKKTAKKLAEIIDMDADEIEKRLNNKKAFQIEFGQKGTNLTYQEKEKIEKMKLPGIALYPETERFYPNGNFASHLIGMAQKDPDTGELNGALGVEKIFNSYLNGSRGALKYIHDIWGYIAPNTKKEQQPKRGDDVHLTIDSNIQVFVEEALDDMVERYAPKDLFAVVMDAKTGEILAYSQRPTFNPETGKDFGKKWANDLYQNTYEPGSTFKTYGLAAAIQEGKFKPDEKYKSGHRNIMGSEISDWNKTGWGRIPMSLGFTYSSNTLMMHLQDLVGADKMKSWYERFGFGKKTGGMFDGEAAGNIGWANELQQKTSAFGQSTTVTPAQMIQAQSAFFNKGNMLKPWFVSSIDNPITKKNYYSGKKEFAGKPVTEETANKVEEELDKVVNSKKSHAMNYRVKGYDIEGKTGTAQVADSNGGGYVKGENPYFVSFIGDAPKKKPKVIVYAGMSLAQKNDQEAYEMGVSKAFKPIMENTLKYLNVGKSSDTSSKTDFSKVPNVQGDEVQKAEDSVNAQSLKPITIGNGKQIKQQSVKSGTKVLPHSKVMLMTDGELTMPDMTGWTKEDVLAFEDLTKIKVSTKGNGFVTNQSISKGQIIKNKDKIEVSLSAEDTDDDQEKTDEDSSDNKSKKDKADEDHSNTSSSTKNDKSNADSKNDSDDSTNETSGSERNN

SEQ ID NO: 5664 - protein, 281 aa, Staphylococcus epidermidis
YVVIGDDTMALYDFAKGLILEAGNKVRLMMQEELDIKTKSNPNDLVTNVDKATENYLYETILHNYPDHQVIGEEGHGHNLEYLKGVIWVIDPIDGTLNFVHQKENFAISIGIYHDGKPYAGFVYDVMKDVLYHAKVGQGAFENTHKLEMIQNTELKRSIIGINPNWLSKPILSDIFSSIVNEARSARAYGSAALEIISVAKGQLAAYLTPRLQPWDFAGGLLILNEVGGIGTNLLGDKLDFNQPNSILIANPSLHREILNHHLNQQRDTLITLHEKRFGKR

SEQ ID NO: 5665 - protein, 805 aa, Staphylococcus epidermidis
VAVMIAKVIVDIPSKSVDFKFDYIVPKNLERVIQIGVRVVVPFGPRTIQGYVMNIQQEPDGNMDISKLKEIKEVRDIKPELTSELIQLSEWMSHYHVMKRISVLEAMLPSAIKAKYKKAFSIIDPKNLSSKTKALFNNDGYYLYKEAQQNNDLEEMLTLLNQGLIEEVTILSQNTKKKTQKAVGVVNTLNGDEVLAKLEKYTKQYDLYAFLLEESHRTVFLKEINDMGFSHSSLDSLIKKGYIEKYTAEVFRDPYANRIFEQEQKRILTKEQQDAFEAIQHYIHDEKERTFLLHGVTGSGKTEVYLQTIEEVLNKGKEAMMLVPEIALTPQMVLRFKRRFGDDVAVLHSGLSKGERYDEWQKIRDGRARVSVGARSSIFAPFKNLGIIIIDEEHESTYKQEDYPRYHARDIAQWRSQFHHCPVVLGSATPSLESYARAEKNVYELLSLPHRVNQQALPHIDIIDMREELSEGNRSMFSIALRQAIQERLDKKEQIVLFLNRRGYASFMLCRDCGYVPQCPHCDISLTYHKTTDQLKCHYCGYQENPPSQCPNCEGDHIRQVGTGTQRVEELLQQEFPHARIIRMDVDTTSRKGAHEKLLNDFEAGKGDILLGTQMIAKGLDYPNITLVGVLNADTMLNLPDFRASERTYQLLTQVSGRAGRHEKEGQVIIQTYNPDHYSIKDVKLNDYLSFYQKEMNYRKLGKYPPYYFLINFTISHTDIKKVMMASKHIHQILVQHLSEKAFVLGPSPAALARINNEYRFQILVKYKSEPQLHPALQYLDDYYHDQYVKDKLSLKIDINPQMMM

SEQ ID NO: 5666 - protein, 44 aa, Staphylococcus epidermidis
NPSIEYLTIRYPIEGFFDWMIKRWQPISYIELNDCYTPLYVQLP

SEQ ID NO: 5667 - protein, 42 aa, Staphylococcus epidermidis
SIPIHRTIVLHLQCIFEIIIFKSINSTRIIYDKSKVIIITQN

SEQ ID NO: 5668 - protein, 46 aa, Staphylococcus epidermidis
LFQICIEGEVQLYDELEYSSDFSSQLISTIHSDFIIKIYYDFEVNS

SEQ ID NO: 5669 - protein, 74 aa, Staphylococcus epidermidis
SFKIISIIIIIEKLHYKFIINLSLVVTHLAIIAHIFISYNFIINSYGVPSVTSFFNFQRNINCFITFNIKRLNC

SEQ ID NO: 5670 - protein, 44 aa, Staphylococcus epidermidis
MIKIYLFVDLIKHIATKKRSYLLYTSTYLLNKYKQIDLPLKPMI

SEQ ID NO: 5671 - protein, 214 aa, Staphylococcus epidermidis
MVKILPSLLSIDFLNLKEELQLLETAKVDGLHFDVMDGKFVPNISIGIPILDAVRQQSHLPIDVHLMIEQPENYINLFAEHGADMISVHVESTTHIHRAIEQIKQLGKKAGVVINPGTSVETILPILSIVDYVLVMTVNPGFGGQTFIEQCVTKIEQLNQLKHENHLTFDIEVDGGINDQTSKRCVEQGATMLVTGSYFFKQEDYAKVTSLLKE

SEQ ID NO: 5672 - protein, 210 aa, Staphylococcus epidermidis
SNKIFEYLLMYLCLSYLIYYLIRKVYDMITMKDIIRDGHPTLREKAKELSFPLSNNDKETLRAMREFLINSQDEETAKRYGLRSGVGLAAPQINEPKRMIAVYLPDDGNGKSYDYMLVNPKIMSYSVQEAYLPTGEGCLSVDENIPGLVHRHHRVTIKAQDIDGNDVKLRLKGYPAIVFQHEIDHLNGIMFYDYIDANEPLKPHEEAVEV

SEQ ID NO: 5673 - protein, 311 aa, Staphylococcus epidermidis
VSKMGKIAVVFPGQGAQKVGMASDLYNEEERSTRVLNLAQETVDFDLLETMFTDNDGKLGETENTQPALLTHSVALLESLNHLKVDYTMGHSLGEYSSLVSSDVLSFEDAVRIVRKRGQLMAQAFPNGVGGMAAVLGLDYDDVDKICQTLSTKEQLIEPANINSPGQIVVSGHKSLIDELVEKGKELGAKRVLPLAVSGPFHSSMMKVIEEDFANFINQFEWHNANYPVVQNVNAKGETDAEVIKRNMVKQLYSPVQFIQSTEWLINQGVDHFIEIGPGKVLSGLIKKINRDVKITSIQTLEDVKGWNNHE

SEQ ID NO: 5674 - protein, 382 aa, Staphylococcus epidermidis
KGEMQMKSVGLITEYNPFHNGHLFHATLSKQRSETNVTIAIMSGNFVMRGEPAIYHKFKRTKMALSAVDLVVELPLIGSLSSSDTFAEIAIKTAQYLDIDIISFGSESASLKDLQYLATQMIDYEKHPDFKEKLKQGKSYPRILSELTHNDTLLQSPNNILGISYLKAMQQFAPHMSALTIKREGSLHHQKVIDHHHFASGTSIRRSLMNDNVDWKNVVPNQIQSLYCKPHTTVEDTFPFIKHQLITQPKESLHSIYTINEGFENRLQTMIHRSDSFESLLSNLKTKRYTQTYIQRVLMNVLLNITKDDVNKEINAVRVLGMSEKGRSYLKYLKANYPNRHYITNVNQKTAHYFKNEIKATHVYNLLSNQSQTDFNTPLVRI

SEQ ID NO: 5675 - protein, 249 aa, Staphylococcus epidermidis
KDGIIMNKSALVTGASRGIGRSIALQLAEEGYNVAVNYAGSKDKAEAVVEEIKAKGVESFAIQANVAKGDEVKEMIKEVVSQFGSVDVLVNNAGITKDNLLMRMKEQEWDDVIDTNLKGVFNCIQKVTPQMLRQRSGAIINLTSIVGAMGNPGQANYVATKAGVIGLTKTAARELASRGITVNAVAPGFIVSDMTNALSDDLKDQMLEQIPLKRFGEDTDIANTVAFLASDKAKYITGQTIHVNGGMYM

SEQ ID NO: 5676 - protein, 46 aa, Staphylococcus epidermidis
YSLILNLIDSSIKIGGVVMLIHYGVPLLIFALVLLIGWLMTKMFIR

SEQ ID NO: 5677 - protein, 76 aa, Staphylococcus epidermidis
NGLIENQMEFYNHLVYKETHYNVLLKCKDDYYHYFVPLDASSPFIYYDKLSRQSTNVWISFKEILPSSFATSISSL

SEQ ID NO: 5678 - protein, 340 aa, Staphylococcus epidermidis
NKMIYAYIGITVLWVFLFCYIIIASIDFGAGFFALHSKMTGNEKKVNHLIHRYLNPVWEVTNVFFVFFFVGFIGFFPDSAKYLGTVLLVPGSIALILISIRSSFYAFENYGQDTKLPWIVLYGLTGLLIPASLATALTISEGGYIYEHGTHIDLDWIQLLLSPFAWSVVFLAIVSVLYISSGFLTYYAHKANDQPAYDMTRQWHIFWGPPMIVISLFVFLSLRIQNSDHFRTAIFNYWWMFAISFIFFIIAGLLTIFKKKHGLAFIMVILQMLFAFFGYGMSKLPYLLYPFIKITDSHVNPEMGLSLVIVFVLGLLLLIPSLILLLRLFVFDKAYVEGKK

SEQ ID NO: 5679 - protein, 312 aa, Staphylococcus epidermidis
EDSIMAHSKKWFINGTLATAGIISSLFYFLKNKNKSPQQLKSIPPFFSGQAPYIFAHRGGMAMRPEQTQLAFDNAVEYGLDGFETDVRLTKDEQLIVFHDALVDRTTNGSGKVSEHTLAELKRLDAGYHFTDINNQTPYRGHDKAKILSFEELLELYPNMYINVDLKDAPDTYEGRIAPKVIYDNIIKHGAQHRVLVTSFHKKQIQRFTEYNQADIAIGASEGEVAEGFIKFNGMLGHTFKPQADTFQMPVAYKGISLTSKRFIQWLNLNNIVPGYYGVNSIDLMTDLYHKGVHTLVTDRPDLGQQFKETLK

SEQ ID NO: 5680 - protein, 42 aa, Staphylococcus epidermidis
YISMVIYSFYVEKFLKHYDYNTVNNKSYDKTRSKSSYFASLC

SEQ ID NO: 5681 - protein, 235 aa, Staphylococcus epidermidis
KEKMSVRNLPIIALDFKSADEVHTFLNKFNEPLCVKIGMELFYQTGPALIKSIKKRGHDIFLDLKLHDIPNTVSKAMEGLARLDVDLVNVHAAGGIKMMEEAKKGLRKHNADIKIIAVTQLTSTTERQLHEEQNIQTSIEEAVLNYARLTKKAGLDGVVCSPLEAEMISKELGTDFLKVTPGIRPKGAARNDQQRITTPEEAKTLGSTHIVVGRPITQSEHPIDSYHKIKESWLS

SEQ ID NO: 5682 - protein, 48 aa, Staphylococcus epidermidis
KNDFKLMYIFLLLTYYIKNHIFKCVTKLTISNVVKVSQFNFIKPNLFV

SEQ ID NO: 5683 - protein, 67 aa, Staphylococcus epidermidis
DGTVSILSLLANIIIAMIKNKIGMIRVTINNTSGIVTIAAIKKRKPDKILIFIEINAKNEMSKQTIK

SEQ ID NO: 5684 - protein, 163 aa, Staphylococcus epidermidis
VMTVKKLVKSTHPILNKTIQPVSTYDQKLKVLLEDLEDTLYHEEAAAISAPQIGVDQSVALIDMEQEGLLQLINPVVKSQSQETVSDLEGSISLPHIYGEVKRSKMITVQSYDINGNAVELTAYDDIARMILHMIDHLNGIQFTKRAHHILNETEVEAYFDNE

SEQ ID NO: 5685 - protein, 95 aa, Staphylococcus epidermidis
GEYVMSNQSKLNSAAYDQLNKDADRILHLIKVQMDNLTLPSCPLYEEVLDTQMFGLQKEVDFAVQLGLVDKEDGKQLMLRLEKELSKLHEAFTNV

SEQ ID NO: 5686 - protein, 223 aa, Staphylococcus epidermidis
FMDVKENLAKIEKEIDASIKKSAHSAQPHVIAVTKYVTIERAREAYKVGIRHFGENRLDGFKEKKESLPSDVKLHFIGSLQSRKVKDIINEVDYFHALDRLSLAKEINKRANHVIKCFLQVNVSGEESKHGIALEEVNQFINQIKEYENIQIIGLMTMAPLTDDLSYIRNLFKELRHKRNEIQQFNLAHAPCTELSMGMSNDYQMAVEEGATFVRIGTKLVGE

SEQ ID NO: 5687 - protein, 467 aa, Staphylococcus epidermidis
LLRVKNLRLKYPNGDRKIFNNLNLEIKNKEKVLLLGPSGSGKSTLLNVLSGIVPNLIELPMKYDELNIDHDSGVIFQDPDNQFCMPKVYEELAFVLENRNIPRSEMDQEIEDALKSVDLNVTHKTYVNNLSGGMKQKLAIVETILQKSKTLFLDEPTAMLDVKATEDLWKKLINLWEDQTVLIVEHKVEHIWQHVDRVLLLNYDGEIVADDTPEQILDHYEALLTEYGVWHPRAWHSAPRPIPLPNQTKNLLFHFDDGQIIRGKKTLFSSKELKLYSGEWLTITGKNGAGKTSLLEAMLQLIKYEGDMFYRDQLLSKIKQAAKHMYLVYQNPELQFITNSVYDEVYIHYNHLDPKHANDETMDLLKLLHLDQVKDHHPFEISTGQKRRLSVATALSSKAEIILLDEPTFGLDSHNTFQLIKLFQERVNQGQTIIMVTHDPEIIKRYPTRRLRVEDGCLKEMEGEHIV

SEQ ID NO: 5688 - protein, 137 aa, Staphylococcus epidermidis
GVSVMAVEKIYQPYDEATQTSIPQRQPQSSPEKQTVKRKVVVQLTRFEKILYIALITVIALISIYMLSLKMDAYDTRGKIADLDQKIEKQSSENSALKSEIKKNSSYERIYDKAKKQGMSLENDNVKVVRNNGEAKN

SEQ ID NO: 5689 - protein, 296 aa, Staphylococcus epidermidis
MRGVFLKTGRIVKLISGVYQVDVEGERFDTKPRGLFRKKKFSPVVGDIVDFEVQNTKEGYIHHVHDRNNELKRPPVSNIDELVIVMSAVEPEISTQLLDRYLVIAHSYHLKPRILITKHDLASEQEILKIKDTIKIYQKIGYATQFIGKDSNYTATVDEWSDGLIVLSGQSGVGKSTFLNSYQPQLKLETNDISKSLNRGKHTTRHVELYDRKGGYIADTPGFSALDFNHIEKEQLKDFFIDIHEAGEQCKFRNCNHIKEPQCHVKALVEKGEIPQFRYDHYQQLYNEISNRKVRY

SEQ ID NO: 5690 - protein, 73 aa, Staphylococcus epidermidis
NKCLYIFLAKMIMTFLFNHTTTLKRLKDFKYFNCNLIILWLSVTHPVTFKNYNATNIMIFIMSTNTNTCSRTL

SEQ ID NO: 5691 - protein, 927 aa, Staphylococcus epidermidis
SSFLSLQGVNLMNYKDTLLMPKTDFPMRGGLPNKEPQIQEMWDNDEQYRKALEKNKNNPSFILHDGPPYANGNLHMGHALNKIIKDFIVRYKTMQGFYAPYVPGWDTHGLPIEQALTKKGVDRKKMSVAEFREKCKEFALKQIDIQKKDFKRLGVRGDFNNPYITLTPEYEAAQIRLFGEMADKGLIYKGKKPVYWSPSSESSLAEAEIEYHDKRSASIYVAFDVKDSKGKVDSDAQFIIWTTTPWTIPSNVAITVHPELKYGQYNVDGHKYIVAQALSEEVAEALGWDKDSIQLEKEFTGKELEFIEAQHPFLDRVSLVINGEHVTTDAGTGCVHTAPGHGEDDYIVGQKYDLPVISPLNDKGVFTEEGGPFEGMFYDKANKAVTDLLKEKDALLKLDFITHSYPHDWRTKKPVIFRATPQWFASINKVRQDILDAIEDTNFKVDWGKTRIYNMIRDRGEWVISRQRVWGVPLPVFYAENGDIIMTKETVNHVADLFEKYGSNIWFEKEAKELLPEGFSHPGSPNGEFTKETDIMDVWFDSGSSHRGVLETRPELSFPADLYFEGSDQYRGWFNSSITTAVATRGQAPYKFLLSHGFFMDGEGKKMSKSLGNVIVPDQVVKQKGADIARLWVSSTDYLSDVRISDEILKQTSDVYRKIRNTLRFMLGNINDFNPETDSIAETNLLEVDRYLLNRLREFTASTINNYENFDYLNIYQEVQNFINVELSNFYLDYGKDILYIEKKDSHKRRSMQTVLYQILIDMTKLLAPILVHTAEEVWSHTPHVKEESVHLSDMPKVVDVDEELLEKWNTFMNLRDDVNRALEQARNEKVIGKSLEAKVVIGNNETFNTAEFLQQFNDLQQLFIVSQVEVKDKVNDGVSYQYGDIHIKHAEGEKCERCWNYTEELGSVGELEHLCPRCQEVVKTLV

SEQ ID NO: 5692 - protein, 451 aa, Staphylococcus epidermidis
MDSVEIARLLTGMTLAVHIIFATIGVGMPLMFAIAEFIGIKKNDANYITLAKRWSKGYTITVAVGVVTGTIIGLQLSLVWPTFMKMGGHVIALPLFMETFAFFFEAIFLSIYLYTWERFKNKWTHFFISIPVIIGGSFSAFFITSVNSFMNTPAGFEIKNGRMVNVQPLEAMFNSSFMVRALHVVATAGMTMAFILAAIAAFKLLRHNHTEDRTYHTKALNLSMIVGFINTVLSMIAGDLSAKFLHKVQPDKLAAYEWHYDTQSHANLVLFGVLNEKTHEVSGALEIPGLLSFLADNSFNTKVKGLNEFPKNELPPMIVHYFFDLMVSMGIFCFIISGLYMLFLIVKKLRKYVTSNMMLYAILLTGPASMLAIEFGWFLTEMGRQPWIIRGYMRVSEAATQAGGITLVTTLFGLLYLLLLVTSAYVLIRMFKNQPAYKDVEKVIKERGETK

SEQ ID NO: 5693 - protein, 48 aa, Staphylococcus epidermidis
SCSVNFNVLHFMYLLLHYHYSSYSIKIIFLIDNLTAYKLIYLNFLQIN

SEQ ID NO: 5694 - protein, 102 aa, Staphylococcus epidermidis
KIKVYEGEDTMEYQYPLDLHWTNDEMMKVIHFFNKIENYYEASVKGDEVLNAYKNFKHIVPGKADEKQIFKEFENKSGYNSYKVVQEIKKNPNQTLFSKDFD

SEQ ID NO: 5695 - protein, 341 aa, Staphylococcus epidermidis
FLKVNSKCTIQVRMNEMVKIAVDMMGGDDAPGIVLDAVKKAVEDFKDLEIILFGDESQYNLSHERIEFRHCTEKIEMEDEPVRAIKRKKDSSMVKMAEAVKSGEADGCVSAGNTGALMSAGLFIVGRIKGVARPALVVTLPTTDGKGFVFLDVGANADAKAEHLLQYAQLGNIYAQKIRGIQNPSVSLLNIGTEAAKGNSLTKKAYDLFEKNQSFNFTGNIEAKTLMDGNVDVVVTDGYTGNMVLKNLEGTAKSIGKMLKETIMSSFKNKLAGAVLKKDLETFAKKMDYSEYGGSVLLGLDGTVVKAHGSSNAKAFYSAIRQAKIAGEENIVQIMKDTVGE

SEQ ID NO: 5696 - protein, 276 aa, Staphylococcus epidermidis
WEGVISVKWYGKLYIALLISVLYIPIFFLMIYSFNSAGNMSHFEHFTLEHYHSLFHNDRLMSVIFNTVAVALLSASIATVIGTFGAIALYYLRNKRFKVTLLTMNNVLMVSSDVVIGASFLIMFTAIGHFTGLGLGFSTVLASHIAFCIPIVVIIVLPQLYEMNDNMLNAARDLGANESQLLTSIIIPNIMPSIIGGFFMALTYSLDDFTVSFFVTGNGFSVLSVEVYAMARKGISMEINAISTIIFIAIMFGVFGYYFIQHIVNRQKKMKRGVNE

SEQ ID NO: 5697 - protein, 503 aa, Staphylococcus epidermidis
LKSLNRGVSYRMKKAILSVSNKSGIVEFAKALTNLDYELYSTGGTKRVLEDANINIKSVSELTQFPEIMDGRVKTLHPAVHGGILADRDKEHHLEQLREQHIDLIDMVVVNLYPFQQTVAQPDVTETDAIENIDIGGPTMLRAAAKNFKHVTTIVHPSDYNEVIERIKNHQLDEAYRKSLMVKVFQHTNEYDHAIVNYFKDNKETLRYGENPQQSAYFVRTSDSKHTIAGAKQLHGKQLSFNNIKDADAALSLVKKFNEPTAVAVKHMNPCGVGIGQSIDEAFQHAYEADNQSIFGGIIALNRTVDVKLAEALHSIFLEVVIAPQFTEEALKILTQKKNIRLLQIDMTIDNAEQEFVSVSGGYLVQDKDNKDVTRNDMTVATDIQPTEAQWEAMLLGWKVVSAVKSNAVILSNNKQTVGIGAGQMNRVGSAKIAIERAIEINDNVALVSDGFFPMGDTVEYAAEHGIKAIIQPGGSIKDQDSIDMANKYGITMVMTGMRHFKH

SEQ ID NO: 5698 - protein, 131 aa, Staphylococcus epidermidis
RNTLSASLNASIIGVDLSTISNKRSFGITINVSTAAFIDSTPAAACVWRLRPSKPNGRVTTPTVKAPISFAILATTGAAPVPVPPPIPAVTNTISAPWIASSICSLDSSAAFFPISGLAPAPNPRVNFSPI

SEQ ID NO: 5699 - protein, 51 aa, Staphylococcus epidermidis
KDTFSKSDIECRFEYHIGFYIFTNWTLFIIAISAFIYTVPIISIASKSSCD

SEQ ID NO: 5700 - protein, 312 aa, Staphylococcus epidermidis
YFKLMMGCLSLFRKQNLKWLGVLATIIMTFVQLGGALVTKTGSEDGCGSSWPLCNGALLPENLPIQTIIELSHRAVSAISLIVVLWLVITAWKNIGYIKEIKPLSIISVGFLLVQALVGAAAVIWQQNPYVLALHFGISLISFSSVFLMTLIIFSIDKKYEADILFIHKPLRILTWLMAIIVYLTIYTGALVRHTKSSLAYGAWPIPFDDIVPHNAHDWVQFSHRGMAFITFIWIMITFIHAIKNYSDNRTVRYGYTASFILVILQVITGALSVITNVNLIIALFHALFITYLFGMIAYFILLMLRTTRSLK

SEQ ID NO: 5701 - protein, 216 aa, Staphylococcus epidermidis
QFKLYVSQGGLFLAQSKNEFYLRRLHSLLGVIPIGAFLIVHLMVNHQATQGAEAFNRASGFMESLPFLIVMEFILIYIPLLYHGLFGLHIAFTAKENIGHYSLFRNWMFFFQRVSGILAFVFIAMHLWQTRLQKAFYGKSVDYNLMHETLQHPLWAIFYIICVIAVVFHFANGLWSFCVTWGFLQSKKSQRVFTWISLIVFLVISYIGVAAVIAFI

SEQ ID NO: 5702 - protein, 42 aa, Staphylococcus epidermidis
IIKLQFECYFINHITNARLHFRLKFRAFVIYNLLKTNLVNME

SEQ ID NO: 5703 - protein, 59 aa, Staphylococcus epidermidis
ISTSLIKGFCFKFLIALFLLKVYIRDREVTLSSFFILLVLTLLLPLTFTFDILLSGVTI

SEQ ID NO: 5704 - protein, 394 aa, Staphylococcus epidermidis
MLEFEQGFNHLATLKVIGVGGGGNNAVNRMIDHGMNNVEFIAINTDGQALNLSKAESKIQIGEKLTRGLGAGANPEIGKKAAEESREQIEDAIQGADMVFVTAGMGGGTGTGAAPVVAKIAKEMGALTVGVVTRPFGFEGRKRQTQAAAGVESMKAAVDTLIVIPNDRLLDIVDKSTPMMEAFKEADNVLRQGVQGISDLIAVSGEVNLDFADVKTIMSNQGSALMGIGVSSGENRAVEAAKKAISSPLLETSIVGAQGVLMNITGGESLSLFEAQEAADIVQDAADEDVNMIFGTVINPELQDEIVVTVIATGFEDKPSSQGRKATSTGFGSSVNSSSNHQSGASAKEDSFSAHTSHSQSSESVNERSHTTKDDDIPSFIRNREERRSRRTRR

SEQ ID NO: 5705 - protein, 46 aa, Staphylococcus epidermidis
KNYSSYSSSKQKIQQPHMRLLDLFLVFYYLETTSSPLYEPQFLHTR

SEQ ID NO: 5706 - protein, 198 aa, Staphylococcus epidermidis
YTYSFIGGRIVTNIAIFASGSGSNFENIVKHIQTGQLSGINVTALYTDNEGVPCIDRAKNLNIPIHINKPKDFSSKSLYEQHLLKLLSSEEVQWIVLAGYMRLVGQDLLQAYEGRILNIHPSLLPKFKGLDAIGQALESGDTVTGSTVHYVDSGMDTGEIIEQQQCDIKPDDTKEQLEDRVKHLEYELYPRVIAKIIK

SEQ ID NO: 5707 - protein, 395 aa, Staphylococcus epidermidis
ERYSFMKLATLNKGKETKYLNHYPLIDEEDLFEHDHLKEGDLITLVTEQQQYIATGYIGRQHKGLGWVLSYNQNEEINTLFFKRLFEAALEERQYYFNIEGTNAFRLFNAEGDGVGGLTIDNYNGHLLIQWYSKGIYKFRFPILEAIKEVYEYTSIFEKMRFKGTSYTGGFVEGNAPEFPIVVEENFTFYNVDLNDGLMTGIFLDQKEVRKKLRDQFSERRHVLNLFSYTGAFSVIAAENANSTTSVDLANRSRGLTEENFGLNGINPKSQYIYVMDTFDFYNYAGRHGHQYDTIVIDPPSFARNKKKTFSVQKDYNLLIEGALNILSPGGTLLLCTNSSAFSLKAFKNVIKKTLAQNNIVYEINEVMGLPKDFKTHPHYKPSKYLKAVFVTIKH

SEQ ID NO: 5708 - protein, 75 aa, Staphylococcus epidermidis
CNNSMNVGQARVAHYIHLQYLKHELLLKIRLVAFDILHLTVFDSVQQRLNLQYECLQDLCSPYYILRLRYHFYHA

SEQ ID NO: 5709 - protein, 413 aa, Staphylococcus epidermidis
VKFLASQLFKGGFFIDYLGVDISKRSSVVAHYKNGKFQKEFFIQNNKNGYNYLLKYLNDLDHPQLIFESTGIYSRGMERFCCVNQINYIQMNPLEAKFKTSALRSWKTDQADAHKLACLGPTLKQTDNLPIHELIFFELRERVRFHLEIENEQNRLKFQILELLHQTFPGLERLFSSRYSIIALNIAEIFTHPDMVLDIDKDVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 5710 - protein, 273 aa, Staphylococcus epidermidis
KELSTMDPSLILPYLWVLLVLVFLEGLLAADNAIVMAVMVKHLPPKQRKKALFYGLLGAFIFRFIALFLISIIANFWWIQAAGAVYLIYMSIKNLWQFFHQSNEKHHKETGDEHHFDETGNEKEVGPKSFWGTVFKVEFADIAFAIDSMLAALAIAVTLPKVGIHFGGMDLGQFIVMFLGGMIGVILMRFAATWFVELLNKYPGLEGAAFAIVGWVGIKLIIMVLAHPDIGVLPEAFPHSALWQTIFWVVLVGLVLIGWLTSAIGNKKKGNQK

SEQ ID NO: 5711 - protein, 53 aa, Staphylococcus epidermidis
YQRSHHHFRYTIYRNFKIYIKAFITVFQTKYLNIIRFKNEYLCKIMVLFSLSI

SEQ ID NO: 5712 - protein, 41 aa, Staphylococcus epidermidis
LNGSAVHLDKQMNPEFYSELEQIQEQKNQKRIEVCIYNMHI

SEQ ID NO: 5713 - protein, 271 aa, Staphylococcus epidermidis
VRLLMLHYNFYESKNQSKQLLVMLHGFISDATTYHSHIERLVEHTNVLTIDLPGHGLDTSSMDEVWDFPFITRQLDEVLIQYQTYDVFLLGYSMGGRVALYYAIHGNETLSGLLLVSTSAGIQNETDKVERAQVDAARAKVLEIAGLDIFVNDWEKLPLFRSQYNLAPEIRQSIRNNRLNQDANKLAKALRDYGTGHMPNLWPHLSLIRIPTLILVGEKDKKFVQIGQQLENHLQDSHKVQISNVGHTIHVEDSTEFDTIILGFLKEEQND

SEQ ID NO: 5714 - protein, 55 aa, Staphylococcus epidermidis
RGAPAKGVGRESGARVRIPPFPLFVYTSLNPVKQNVDLTGFCYILLSIVKPRKLN

SEQ ID NO: 5715 - protein, 274 aa, Staphylococcus epidermidis
YMQPYLICLDLDGTLLNDNKEISPYTKQVLTELQQCGHYVMIATGRPYRASQMYYHELNMSTPVVNFNGAFVHHPKANDFKVIHEVLDVEISKNIITALQQSHITNIIAEVKDYVFINSYDPRLFEGFSMGNPKIQTGNLLENLNEAPTSLLVEAEEENIPEIKDMLTHFYAENIEHRRWGAPFPVIEIVKRGINKARGIKHVQNYLNIADDHIIAFGDEDNDIEMIKFATHGIAMANGLKDLKEIANETKFSNNEDGIGRYLNDFFNLKMRYY

SEQ ID NO: 5716 - protein, 373 aa, Staphylococcus epidermidis
CIRPKNAKIKEVKVMTETVLEVNDLHVSFDIAAGEVQAVRGVDFHLNKGETLAIVGESGSGKSVTTKAITKLFQKDTGRIKKGEILFLGEDLAQKSEKELIQLRGRDISMIFQDPMTSLNPTMQIGKQVMEPLIKHKKLSKAKAKQRALEILNLVGLPRAEKRFKAYPHQFSGGQRQRIVIAIALACEPKILIADEPTTALDVTMQAQILDLMKELQNKIETSIIFITHDLGVVANIADKVAVMYGGQMVETGDVNEIFYDPKHPYTWGLLSSMPDLTTSNDTDLIAIPGTPPDLLHPPIGDAFARRSRYALDIDFKEEPPWFKISPTHFVKSWLLDARAPKVTPPSMVQKRLRTMPSNYEQPHRVERVAFNE

SEQ ID NO: 5717 - protein, 79 aa, Staphylococcus epidermidis
IKKPVNEFMKTHLLSILIGIMSQAHRSVEKPSVLSLILLRGDNNKHTHLFVEFEEFDRANEEKHAKVEYHSSKNKTDTL

SEQ ID NO: 5718 - protein, 42 aa, Staphylococcus epidermidis
VYYTRFIIVDKFIIISLINLFLIIIDVIYPNHVLLDSDKIIH

SEQ ID NO: 5719 - protein, 79 aa, Staphylococcus epidermidis
NNHTEVDIMKVNKTIYIIVALILGGLGVHKFYADQVGQGILHLVFFWTGIPSVVAIIHAIIVIFTKKADEYGYITFDKK

SEQ ID NO: 5720 - protein, 206 aa, Staphylococcus epidermidis
SRRLIKMKNVSKALIWFVISFIIFHAILFVMWGEHQEYWYLYTGIMLIAGISYVFYQRDIASKRLLTSIGMGIITSVALIIIQLIFSLISSELSYASLIKELSRTGVYFKWQMLVTLLFVIPCHELYMRTVLQKELIKYNLPKWASILIVAICSSSLFIYLDNWWIVFFIFVAQFILSLSYEYTRRIATTTIGQIVAIILLLIFHG

SEQ ID NO: 5721 - protein, 573 aa, Staphylococcus epidermidis
TKLTRCLMYKDYNMTQLTLPMETSVLIPTNDISRHVNDIVETIPETEFDEFRHHRGATSYHPKMMLKVVLYAYTQSVFSGRKIEKLLNDSIRMMWLSQNQKPSYKTINRFRVNPKVDALLESLFIQFHSQCLKQNLIDDQAIFIDGTKVEANANRYTFVWKKSIQNHESRMNENSKALYHELVINKIIPEIKKDHDNDLTKEEIDLIGSHLDKEIEDLNQHIDNEKCTKIRKQIRLKRTKIKKYKKQINDYSQRKHKYEVQKSILKDRNSYSKTDHDATFMRMKEDHMKNGQLKPGYNLQIATNSQFVLFYDVYQNPTDTRTMIPFLNTIQETYGHLPEYIVADAGYGSEANYMAIIDNFNRTPLITYGMFIKDKTKKYKSDIFNTQNWDYDEINDEFICPNNKRLGFKRYAYRHDKYGFKRDFKLYECDDCSECPLKQQCMNFNSKTNKKIMKNYNWEYFKAQINKKLSEPKTKTIYSQRKIDVEPVFGFMKAILGFTRMSVRGIDKAKRELGFVLMALNIRKVTAQRAENNQKNNKKDNFYIISIEIVFFYLSWDFMSHTHYEQKEICFNK

SEQ ID NO: 5722 - protein, 50 aa, Staphylococcus epidermidis
NKLTKFLMYKDYNKTQLTLPIETSVLIPTNDIHDMYLTHSFFGDELIMNL

SEQ ID NO: 5723 - protein, 451 aa, Staphylococcus epidermidis
VLITGGNKMTHIQLDYGKTLEFFDKHELDQQKDIVKTIHQTIHKGTGAGNDFLGWLDLPVDYDKEEFSRIVEASKRIKSNSDVLVVIGIGGSYLGARAAIEMLTSSFRTNTEYPEIVFVGNHLSSSYTKELLDYLQGKDFSVNVISKSGTTTEPAVAFRLFKQLVEEKYGKDEAKKRIYATTDKSKGALKQLADNEGYETFVVPDDVGGRYSVLTAVGLLPIATAGINIESIMIGAAKAREELSSDDLDQNIAYQYATIRNILYSKGYTTEMLINYEPSMQYFNEWWKQLYGESEGKDFKGIYPSSANYTTDLHSLGQYVQEGRRFLFETVVKVNHPKHDIKIEEDADDLDGLNYLAGKSIDEVNTKAFEGTLLAHTDGGVPNIVVNIPQLDEETFGYVVYFFELACAMSGYQLGVNPFNQPGVEAYKQNMFALLGKPGFEDKKKELENRL

SEQ ID NO: 5724 - protein, 41 aa, Staphylococcus epidermidis
NEKTSMKLICIRACYKFKSIISIDTIVLTLQGSIGLCRSLK

SEQ ID NO: 5725 - protein, 55 aa, Staphylococcus epidermidis
TLETLYQTVKIEELDEFIFIIFNQLFSHPRFFQYKNVEHHNKKFYTSKDLALSVI

SEQ ID NO: 5726 - protein, 54 aa, Staphylococcus epidermidis
KLMTVFQFKICGTLILNKCKCSVYFFNITLEKFNKIDIIILVLDRDRLIIIYPQ

SEQ ID NO: 5727 - protein, 44 aa, Staphylococcus epidermidis
LTKTKLLERYRSDIGLSVNLNLTLIQITLKIKYQSTLEISIHAF

SEQ ID NO: 5728 - protein, 340 aa, Staphylococcus epidermidis
KRRAFMTAIKDRDYFFDNARAILIFLVVLGHLLQPYTSEDKFLQALYLLIYSFHMPTFLFISGYFAKNLDKPNYLEKIAKKLLLPYVIFFAFFSLYYYFTGKEDAIQLDPFNPVFALWFLLTLFFFHVVLVIVRRYNPYIVLFISILVSVLAGFSGNIDSYMSISRTIVFFPIFFIGHLVTQSHTEKLRNKKWIPISIIILITFFIGYTIHPINGDWLLGSTPYTSLESNGEDVYSPLKRLLLYIIILLTMCAFLNLMPQTKRIYTYIGQRTMFVYLLHGIVIGVIRGFDLYPFKDQISIFTYLYLFISASVIVLILSSKWVCKWTNPFINLKRPSQFKN

SEQ ID NO: 5729 - protein, 267 aa, Staphylococcus epidermidis
KYMAEELRIMENKSREDTNLSPVSKIEIYSFFDPFSKDCFKLSAILSKLRIEYNKYIKIRHILNPSLKVLTKCQAQSTSDFDNIALAYKAAELQGRIRAERFIHLMQNEIIPKRDIITEDMISDCINNAGIDYQVFKEDLQKDKLTDSLKVDLHIAREMEIEQAPSLVFFSENVHEEGLKVEGLYPYHIYTYIINELMGQPIEKNLPPKLEYYIQKKQLVTMEELLTIYEWPEKLLNKELKKLTLQQKVEKLQYPEGEFWKSKMPQC

SEQ ID NO: 5730 - protein, 75 aa, Staphylococcus epidermidis
ALNFVRKGDRFVVESIDRLGRNYDEVIHTVNYLKDKEVQLMITSFPRMDEVIGKPLLYIESHALCVWFRKGFTVI

SEQ ID NO: 5731 - protein, 46 aa, Staphylococcus epidermidis
IQNFFEQAKEFLEQEYGKDNLLYAKLHMDKRLTCTLKLYQLQKMDD

SEQ ID NO: 5732 - protein, 41 aa, Staphylococcus epidermidis
LVFYCYPLEDHSYSFFNSFFICKIQVILILYIIIILNSFII

SEQ ID NO: 5733 - protein, 123 aa, Staphylococcus epidermidis
EALYFGATGVLSYRKFFPFIYNLFQKGYFENSLTIIGSGLNELTTDEFREKVKNAIQNNIENSKEIGAFLKRLFYKQQDANSKDSYQKFLEMSLELDDKFDLKENRLFYLAMSPKFLELQQTT

SEQ ID NO: 5734 - protein, 52 aa, Staphylococcus epidermidis
VTIYSHPPLIFKIYNNCNVFSCIVKGKEVYHLLYLNTINKAYNTMLCRKFAL

SEQ ID NO: 5735 - protein, 301 aa, Staphylococcus epidermidis
MKFLSFKHNDRTSYGVKVKREDAVWDLPMVFAEFGDKDFNPKTLIAGLQQNQTLDFQEQVRKAVVAAEESGRDEEFKLLFTDIDFLPPVTPPNNVIAFGRNYEDHASELNHEVDSLYVFTKAASSLTGDEATIPNHKDITEQLDYEGELGIVIGKSGEKIPRGLALDYIYGYTIINDITDRTAQSSHDQAFLSKSLTGACPMGPYIVTKDELPAPENVNIVTKVNNEIRQDGNTGEMILKIDELIEKISKYVALHPGDIIATGTPAGVGAGLQPPQFLQPGDEVKVTIDNIGTLTTYISKN

SEQ ID NO: 5736 - protein, 81 aa, Staphylococcus epidermidis
RASYSVETKYKAVEMKAAEFSTKEIMKELNIRNRTQVKSWWLWYQNEESMFVLYLYPQSLIICLSLHFSTNQCYNLDNEND

SEQ ID NO: 5737 - protein, 270 aa, Staphylococcus epidermidis
IMRYTILTKGDSKSNALKHKMINHMKDFQMVEDSENPEIVISVGGDGTLLQAFHQYSHMLSKVAFVGIHTGHLGFYADWLPHEVEKLIIEINNSEFQVIEYPLLELIVRYNDNGYETRYLALNEATMKTENGSTLVVDVNIRGKHFERFRGDGLCISTPSGSTAYNKALGGALIHPSLEAMQIAEIASINNRVFRTVGSPLVLPKHHTCLITPVNHDTIRTTIDHVSIKHKNVNAIQYRVANEKVRFARFRPFPFWKRVHDSFISSDDER

SEQ ID NO: 5738 - protein, 333 aa, Staphylococcus epidermidis
KHEYVKLIPGIKNFLRRCTTMNVGIKGFGAYAPKNIIDNAYFEQFLETSDEWISKMTGIKERHWADEDQDTSDLAYNASIKAIEDAGIQPVDIDMIIVATATGDMPFPSVANILQERLGTGKVATMDQLAACSGFMYSMITAKQYIQSGDYKHILVVGADKLSKITDMTDRSTAVLFGDGAGAVVMGEVAEGRGIISYEMGSDGSGGKYLYLDRETGKLKMNGREVFKFAVRIMGDASTRVVEKAGLSSEDIDLFVPHQANIRIMESARERLGIEREKMSVSVNKYGNTSAASIPLSINQELQNGKIKDDDTLVLVGFGGGLTWGAIVIKWGK

SEQ ID NO: 5739 - protein, 41 aa, Staphylococcus epidermidis
ITRYNKTPSNQRFVLRDLTRYKQITETEGFEPSRRSRDLHP

SEQ ID NO: 5740 - protein, 141 aa, Staphylococcus epidermidis
NNMYKQLEKLITLTNNDLNLVNRRFGQRTDITSEQLELLRILYNYDRLSQYDLTMKISREQSIVSRWIKKLVQKGYIMSQQSHEDLRCKELILTEEARALIQQINTARCELIEARCQCLSSDEIASLNQLLNKLNSRHIFI

SEQ ID NO: 5741 - protein, 412 aa, Staphylococcus epidermidis
VTHLNRMKSMERFLCMQDSSSSNYSSNRNFVMMLVILFLMEFARGMYILSYINFLPTVTSIAIAITSFAFSIHFIADAATNFVIGFLLKKFGSKLVLTSGFLLAFISLFLVIWFPASPFIIIFSAIMLGIAVSPIWVIMLSSVDERNRGKQMGYVYFSWLLGLLVGMVIMNLLIKFHPTRFAFLMALVVLIAWVLYYFVNINLTNYNTKPVKAQLKQIVDVTQRHLILFPGILLQGAAIAALVPILPKYATQVVKVSTVGYTVAIIIGGIGCAFSMLFLSKIIDNNSKGFMYGVIFSGFILYTILIFGLSTITNIYIVWAIGLFIGLMYGILLPAWNTFMAGHINPNEQEETWGVFNSVQGFGSMIGPLVGGLITQFTNNLNNTFYFSAMIFLALAVFYGYYFIKTNRRVKP

SEQ ID NO: 5742 - protein, 70 aa, Staphylococcus epidermidis
KLSQASPKLWFNWSRISKTSTKSRKSIIKRQRIKIVIKNNSHLKLQKFNFVLSYQSLYKKNVKFPFILSN

SEQ ID NO: 5743 - protein, 391 aa, Staphylococcus epidermidis
MVTQNKKILIITGSFGNGHMQVTQSIVNQLNEMNLNHLSVIQHDLFMEAHPIMTSICKKWYINSFKYFRNTYKRFYYSRPNELDKCFYKYYGLNKLINLLIKEKPDLILLTFPTPVMSVLTEQFNINIPIATVMTDYRMHKNWITPYSQRYYVATKDTKDDFIEAGVPASYIKVTGIPIADKFEESIDKEEWLSQQHLDPSKPTILMSAGAFGVSKGFDYMINNILEKSPNSQVVMICGRSKELKRSLKAKFKDNPSVIILGYTNHMNEWMASSQLMITKPGGITISEGLSRCIPMIFLNPAPGQELENAYYFESKGFGKIADTPNEAIDIVSDLTNNEETLKVMSSKMLESKVGYSTRKICKDLLDLIGHSSQPDEIYGKVPLYARFFVK

SEQ ID NO: 5744 - protein, 397 aa, Staphylococcus epidermidis
FFSHHGYNDIIQYFIYCFDLYCRHFIWCYRSKNSCTRGQEIMSNKEDVTNINGDISNATMSHTSNDISNTDFIIRDLDLNQEPEMPRQSKNFWQDAWSQLKRNKLAVIGMIGLLLIVIMAFIGPLMNKHDFAEQNVDHRNLPAKIPLLDHVSFLPFDGKGTDGKNAYKEAGAKENYWFGTDQLGRDLWTRTWKGAQISLYIGVVAALLDICIGVVYGAVSGFFGGRVDDVMQRILEIIASIPNLIVVILFVLIFEPSIWTIILAMSITGWLGMSRVVRGEFLKLKNQEFVLASQTLGASKFKLIFKHILPNTLGAIVVTSMFTVPSAIFFEAFLSFIGIGVPAPKTSLGSLVNDGRAMLLIHPHELFIPAIILSLLILFFYLFSDGLRDAFDPKMRK

SEQ ID NO: 5745 - protein, 40 aa, Staphylococcus epidermidis
ASLQKRLGHANIEITWRVYSHLLKVLKSEEVAMPDNIIYF

SEQ ID NO: 5746 - protein, 48 aa, Staphylococcus epidermidis
NIKQNIRGVNMQNIIKRVIRILVSGYIVKMIRNLIFKNSNDSNKNNHK

SEQ ID NO: 5747 - protein, 174 aa, Staphylococcus epidermidis
NMKHLIKYLISFTFAIIIVIFIQSFIIVGAVISNNSMTPTLQTGDRVIVNKIKVTFDLIQRGDIIMYRHNNKTYFSRIIGKPGESVSIKSQRINIDDRQVNEPYMKDRHIKDITLREIKNSDGDTIPPGAFFVLNDNNNKHSDSRTYGLIDKKDIIGDVSLKYYPFKEFNYQFK

SEQ ID NO: 5748 - protein, 42 aa, Staphylococcus epidermidis
NMLQPLIHGLLLALGLILPLGAQNVFVFNQGANQKKLVKHYL

SEQ ID NO: 5749 - protein, 317 aa, Staphylococcus epidermidis
EVVHIMSDQYQQYSTVKKYWQLMRPHTLTAAVVPVLVGTAAAKIYLLGSEDHLKFSLFLAMLLACLLIQAATNMFNEYYDFKKGLDDHTSVGIGGAIVRNGMSPKQVMNLAIAFYIIAALLGIFLAIQSSFWIIPVGIVCMAIGYLYTGGPIPISWTPFGELFSGLFMGMIIILLSFFIQTGNVQGYAVWLSIPIVITIGLINMGNNIRDRVKDKASGRKTLPILLGKRASVIFMAIMYAIAYIIVIITAFFKPAGSLFYLLVLLSFPMPIKAVRRFNKNDTPETMMPAMAATGKTNTFFGLLYALGIYISALLGAI

SEQ ID NO: 5750 - protein, 42 aa, Staphylococcus epidermidis
MYFNLILEKGRFLYCKSKRIKQKKSFIYIYYSTVMQNDIAIV

SEQ ID NO: 5751 - protein, 200 aa, Staphylococcus epidermidis
YNPKKGFDVLSLSQLEEWFDAFRQFGYIPGFIMLYLRAIVPVLPLTLYVVLLIHAYGLFPGIIISWLGIVSGTFTVFLICKKFVNTIRMKKLKSRKSVQRLISFIDRQGLIPLFVLLCFPFTPNTLINIIASLSHIKIKYYFFVLVISKLISITILGVMGKEIFTIFTNPLRALIMIVLLVVLWFISKKVEKHFMGSTKE

SEQ ID NO: 5752 - protein, 41 aa, Staphylococcus epidermidis
TLYKANLRQSMVLYALFIVFKYNKWYTSFPFTMHENTLQLL

SEQ ID NO: 5753 - protein, 46 aa, Staphylococcus epidermidis
ESHKLYNYKSLLEIDGRLDLKSNFDNPKLILNTKVNNKSLNQYLIF

SEQ ID NO: 5754 - protein, 60 aa, Staphylococcus epidermidis
NSNNSLNNILHVNSPYILFDILYPVFVGAKSKICYFGKYEEIFLDVIFYQKLCSRIHLLF

SEQ ID NO: 5755 - protein, 415 aa, Staphylococcus epidermidis
RMNKNNRVVITGIGALSPIGNDAKTTWDNALKGVNGIDKITRIDTDDYNVHLAGELKDFNIEDHIDRKEARRMDRFTQYAVVAAREAVKDAQLNINEKNADRIGVWIGSGIGGMETFEVAHTTLVERGPRRVSPFFVPMLIPDMATGQVSIDLGAKGPNGSTVTACATGTNSIGEAFKIIQRGDADAMVTGGTEAPITHMAIAGFSASRALSTNNDPETACRPFQEGRDGFVMGEGAGIVVLESLDSAKERGAEIYAEVVGYGSSGDAHHITAPAPEGEGGSRAMQAALDDAGIKAQDVQYLNAHGTSTPVGDLYEVQAIKNTFGDAAKSLKVSSTKSMTGHLLGATGGIEAIFSALSIRDSKVAPTIHAITPDEECDLDIVLNVAQDLDITYAMSNSLGFGGHNAVLVFKKFED

SEQ ID NO: 5756 - protein, 132 aa, Staphylococcus epidermidis
LSCNSIIAFYWRFVGYLIYWCKENFKEVILMEEALKDSILGALEMVIDPELGIDIVNLGLVYKVDVDDEGLCTVEMTLTSMGCPLGPQIIEQVKSVLAEIPEISDTEVMIVWSPPWNKDMMSRYAKIALGIG

SEQ ID NO: 5757 - protein, 45 aa, Staphylococcus epidermidis
LDVLGFFIHVSNETCPLIKLRHFYCLYGIMHLIKFITSDTFLTTK

SEQ ID NO: 5758 - protein, 73 aa, Staphylococcus epidermidis
RINKWRLYNMRYLMTFIWAVLLLQMVNFVLNSLNSGPELNVINPIIIAVIFTIVVAILDPILKPSKGSNQYES

SEQ ID NO: 5759 - protein, 104 aa, Staphylococcus epidermidis
SGNNRSIIYLKEGSQKLMIINRGPIVDIDNQKYIFDYSACNYPVGVVEDQIYYFNEDNIDKVVFEGYSDQDEMRFQELFKEMKNNLDDDIQQGIVQKQDNLGLI

SEQ ID NO: 5760 - protein, 49 aa, Staphylococcus epidermidis
NQCNYNINCFVNFHYVYLRMVILVFSLIFIFTDNYLVYQSKSIKEDVMI

SEQ ID NO: 5761 - protein, 276 aa, Staphylococcus epidermidis
RRSKMTRQWETLREYDEIKYEFFEGIAKVTINRPEVRNAFTPKTVAEMIDAFSRARDDQNVSVIVLTGEGDKAFCSGGDQKKRGHGGYVGEDDIPRLNVLDLQRLIRVIPKPVIAMVRGYAIGGGNVLNVVCDLTIAADNAIFGQTGPKVGSFDAGYGSGYLARIVGHKKAREIWYLCRQYNAQEALDMGLVNTVVPLEQVEDETVKWCKDIMQHSPTALRFLKAAMNADTDGLAGLQQMAGDATLLYYTTDEAKEGRDAFKEKRNPDFDQFPKFP

SEQ ID NO: 5762 - protein, 55 aa, Staphylococcus epidermidis
YLLNFTKGPYFFKVFQCEITYKHKVFGETLEGTGQAEDYRLKLSPKKARKQYEVL

SEQ ID NO: 5763 - protein, 44 aa, Staphylococcus epidermidis
LDVKNPKNIAILKNVYKLDSQYTISKDIRAPLLIVFLFRMISMR

SEQ ID NO: 5764 - protein, 85 aa, Staphylococcus epidermidis
VFKNHVQRENINYENEDIDHSKKHLNYDLINDGKQNFNDLIDEKIERNYTGKRKIRKDAVKHIDGMITSDNEFFSNQTPVNTKFF

SEQ ID NO: 5765 - protein, 130 aa, Staphylococcus epidermidis
SLKNPMQFYYSNCEQNASNLLVINVQPNEGFSLCVNGKKSNQNNEMQKVKLSYTMPIKDKMNTVDAYENLIYDTLIGEQTNFTHWEELKILGNLLMILKMYGNKNSHSFLIMPLDAMGLKKVKNYLVKTD

SEQ ID NO: 5766 - protein, 192 aa, Staphylococcus epidermidis
TLKKEILEWIVAIAVAIALIAIITKFVGKSYSIKGDSMDPTLKDGERVVVNIIGYKLGGVEKGNVIVFHANKKDDYVKRVIGTPGDSVEYKNDTLYVNGKKQSEPYLNYNEKRKQTEYITGSFKTKNLPNANPQSNVIPKGKYLVLGDNREVSKDSRSFGLIDKDQIVGKVSLRYWPFSEFKSNFNPNNTKN

SEQ ID NO: 5767 - protein, 1335 aa, Staphylococcus epidermidis
MAKKFNYKLPSMVALTLFGTAFTAHQANAAEQPQNQSNHKNVLDDQTALKQAEKAKSEVTQSTTNVSGTQTYQDPTQVQPKQDTQSTTYDASLDEMSTYNEISSNQKQQSLSTDDANQNQTNSVTKNQQEETNDLTQEDKTSTDTNQLQETQSVAKENEKDLGANANNEQQDKKMTASQPSENQAIETQTASNDNESQQKSQQVTSEQNETATPKVSNTNASGYNFDYDDEDDDSSTDHLEPISLNNVNATSKQTTSYKYKEPAQRVTTNTVKKETASNQATIDTKQFTPFSATAQPRTVYSVSSQKTSSLPKYTPKVNSSINNYIRKKNMKAPRIEEDYTSYFPKYGYRNGVGRPEGIVVHDTANDNSTIDGEIAFMKRNYTNAFVHAFVDGNRIIETAPTDYLSWGAGPYGNQRFINVEIVHTHDYDSFARSMNNYADYAATQLQYYNLKPDSAENDGRGTVWTHAAISNFLGGTDHADPHQYLRSHNYSYAELYDLIYEKYLIKTKQVAPWGTTSTKPSQPSKPSGGTNNKLTVSANRGVAQIKPTNNGLYTTVYDSKGHKTDQVQKTLSVTKTATLGNNKFYLVEDYNSGKKYGWVKQGDVVYNTAKAPVKVNQTYNVKAGSTLYTVPWGTPKQVASKVSGTGNQTFKATKQQQIDKATYLYGTVNGKSGWISKYYLTTASKPSNPTKPSTNNQLTVTNNSGVAQINAKNSGLYTTVYDTKGKTTNQIQRTLSVTKAATLGDKKFYLVGDYNTGTNYGWVKQDEVIYNTAKSPVKINQTYNVKPGVKLHTVPWGTYNQVAGTVSGKGDQTFKATKQQQIDKATYLYGTVNGKSGWISKYYLTAPSKVQALSTQSTPAPKQVKPSTQTVNQIAQVKANNSGIRASVYDKTAKSGTKYANRTFLINKQRTQGNNTYVLLQDGTSNTPLGWVNINDVTTQNIGKQTQSIGKYSVKPTNNGLYSIAWGTKNQQLLAPNTLANQAFNASKAVYVGKDLYLYGTVNNRTGWIAAKDLIQNSTDAQSTPYNYTFVINNSKSYFYMDPTKANRYSLKPYYEQTFTVIKQKNINGVKWYYGQLLDGKYVWIKSTDLVKEKIKYAYTGMTLNNAINIQSRLKYKPQVQNEPLKWSNANYSQIKNAMDTKRLANDSSLKYQFLRLDQPQYLSAQALNKLLKGKGVLENQGAAFSQAARKYGLNEIYLISHALVETGNGTSQLAKGGDVSKGKFTTKTGHKYHNVFGIGAFDNNALVDGIKYAKNAGWTSVSKAIIGGAKFIGNSYVKAGQNTLYKMRWNPANPGTHQYATDINWANVNAQVLKQFYDKIGEVGKYFEIPTYK

SEQ ID NO: 5768 - protein, 57 aa, Staphylococcus epidermidis
GVEKYGSLVTVYSIFADSQGNLESATERVKKDNPNLNSLGLIPLASYCIAFINLIIG

SEQ ID NO: 5769 - protein, 52 aa, Staphylococcus epidermidis
IIRKGLIFLKYFNVKLHMNTKYFGETLEGTGQAEDYRLKLSPKKASQQYEVL

SEQ ID NO: 5770 - protein, 518 aa, Staphylococcus epidermidis
HLMNGTCYTKFKERSGSMEKNENKIVDVIATSDMHSHFLNGDYGSNIYRAGTYVNEARKNNENVILLDSGGSLAGSLAAFYYAVVAPYKRHPMIKLMNAMQYDASGISPNEFKFGLSFLTRSVALSRFPWLSANIEYTVTREPYFSTPYTIKMYSDLKIAIVGLTSDGLMKNEYAEMEEDVCIEKTLVSAKRWIRYIHEVEEPDFLIVIYHGGLNKISSANKRNEKNANEAEKIMEELGVIDVIITAHQHQTVVGKDHGTIYVQAGQNAEELVHLSIKFKKRTTSYEIEHIDSKVIDLNDYHEDEQLLKETYYDRKAVKHWANSVVSNKNNGLTVQCIEDIICKPHPFTQLLHDAIRLAYNYDISCVHIPKNGEEGLKGTIRNRDIYDAYPHPDKPIDITVKGKNIKDILEYSYAHIDFNKRQLSMTMIDETLFTVWQGFDYCIDMSQSPFNRVKLNGLNEEDSYRITMTDYCYRNYKMYLQEAIVHDTYSETMGGLIRKNLKCDMYSVKLNHNFKVY

SEQ ID NO: 5771 - protein, 213 aa, Staphylococcus epidermidis
NKMNQWDQFLTPYKQAVDELKVKLKGLRKQYEVGEHNSPIEFVTGRVKPISSVIDKANKRGIPFDCLHEEMYDIAGLRIMCQFVDDIDIVVDILRQRQDFKVIEERDYIRNTKASGYRSYHVIIKYPIETLSGQKHILAEIQIRTLAMNFWATIEHTLRYKYDGAYPDEIQHRLERAAEAAYLLDEEMSEIKDEIQEAQKYYTQKRAKKHEND

SEQ ID NO: 5772 - protein, 420 aa, Staphylococcus epidermidis
KEANRIMTENNNLVTSTQGIIKEALHKLGFDDGMYDLIKEPIRFLQVRIPVRMDDGTVKTFTGYRAQHNDAVGPTKGGVRFHPEVDEEEVKALSMWMTLKCGIVNLPYGGGKGGIVCDPRQMSIHEVERLSRGYVRAISQFVGPNKDIPAPDVFTNSQIMAWMMDEYSALDKFNSPGFITGKPIVLGGSQGRDRSTALGVVIAIEQAAKRRGMDIKDAKIVIQGFGNAGSFLAKFLYDLGAKVVGISDAYGALHDPNGLDIDYLLDRRDSFGTVTNLFEDTISNKELFELDCDILVPAAISNQITEDNAHDIKASIVVEAANGPTTPEATRILTERDILLVPDVLASAGGVTVSYFEWVQNNQGYYWTEEEVNDKLREKLVTAFDTIYELSQNRKIDMRLAAYIVGIKRTAEAARYRGWA

SEQ ID NO: 5773 - protein, 121 aa, Staphylococcus epidermidis
IKKNIYNNVIALLFDWFVIFSSILISVTFNNILIYLVAIILIGSRMRAFDNLMHEACHRSLFTNKFWNKWITCLFVAFPVFTSYTAYRNAHHCTGFFKTTLPGFYSVVKDIFTPNYERKES

SEQ ID NO: 5774 - protein, 381 aa, Staphylococcus epidermidis
LSFDIYLLSMKKNKIGGSQSMFNKVWFRTGIFFIMLFILIKLFMEVHEVFAPIATIIGSVFLPFLISGFLFYICLPFQNILEKWGFPRWASITTIFIGLIAIIAIVVSFIAPIIISNINNLIKQTPSLQKEAEQLINFSLRQMDKLPDDVTHRINKAVKSMGDGATSILSNSVSYITSFISTVFLLIMVPFFLIYMLKDHEKFIPAIGKFFKGERKVFVVDLLKDLNFTLKSYIQGQVTVSIILGIILYIGYTIIGLPYTPLLVLFAGVANLIPFLGPWLSFAPAAILGIIDGPSTFIWVCVVTLIAQQLEGNVITPNVMGKSLSIHPLTIIVVILAAGDLGGFTLILVAVPLYAVIKTLVSNIFKYRQRIVDKANSNVKD

SEQ ID NO: 5775 - protein, 463 aa, Staphylococcus epidermidis
NQIEINVEVKIMSVLSQLLKKSSPQQGIILYYLFAIVVAFLLLNLPYVHKQGVEVNPIDTLFVAVSGISVTGLSPITIVDTYSTFGQIIILIILNIGGIGVMAIGTMLWVVLGKHIGIRERQLIMLDNNRDTMSGTVKLILEIVRTIFIIEFIGALLLAFYFYRDNPDLKNALMQGIFVSVSATTNGGLDITGESLVPYAKDYFVQTIVMFLIVLGSIGFPVLLELKAYIKNRVTNFRFSLFTKITTTTYLFLFLFGVIVVLILEHSNAFKGLSWHQSLFYALFQSSTTRSAGLQTIDVSHFSDATNIVMGLLMFIGSSPSSVGGGIRTTTFAILILFVINFNNTGDKTGIKIFNREVHIMDVQRSFAVFTMASLITFISMIIISATEQGKLSFLQIFFEVMSAFGTCGLSLGVTSDVNDITKAVLMILMFIGRVGLISFIIMLAGRKEPEKYSYPKERIQIG

SEQ ID NO: 5776 - protein, 56 aa, Staphylococcus epidermidis
RRIDTITYLKSLETLRKPLNVLYKVETEKVGGLFDKELQETANVVINKDEFNQFQE

SEQ ID NO: 5777 - protein, 61 aa, Staphylococcus epidermidis
FILDGIFVCCCIDFSDWFGAGEWFEVSAIEGELKLAKPSVTVDKVEMIIFLDLNIKTSFQK

SEQ ID NO: 5778 - protein, 203 aa, Staphylococcus epidermidis
NMIEVTFMSTNNEIEFKQILNQDTYSKIYELYFKNQSPFKQTNFYIDTENFKLKQHQAALRIRVKDYMYEMTLKVPAEVGLTEYNHSVNIEPKLDMSLQLSQLPNDIRNILEQDFNILENELKVLGNLTTYRLETEYQNELLVLDKSEYLGKTDYELEFEVHSYDEGYSKFKSLLQHFNLQHQKPLNKVQRFFQEKQNASDKD

SEQ ID NO: 5779 - protein, 332 aa, Staphylococcus epidermidis
WGEEMLMAINQQGQKILAQHANKFDKYQCPHCKSEVILKQGMTLIAHFAHKTRFNHRCSKSESVEHYEAKLYLARIYKALNFNVEIEPYYKEVLQYPDIVINQENAIEVQFSKISISKIIRRTTGLKRIGLNVIWIIKDVPLKYKYVKLSPFQSAFIHPINRTLVTWDSKKFVLILYSQLQHVGGKNFVAQRKVLKFEDIINMTFQSNNVPNFRLSASNIQRYINYCRKRHSVLEPTLSAMYQLNMYDSDVICKLGYVVPHQIYLITHPIEWQLKYLLLRRTLNDNELCKQLLSQVKFRVFATFQYDKRQILSTILREFDYLYEHESLNVQK

SEQ ID NO: 5780 - protein, 871 aa, Staphylococcus epidermidis
NNLDINQMTYAVQGALQKAVAYSKEYELQNIEVEALLKAAMNENDSLFKSILERANIDVDQLIKAYDNQLSHYPTVQGDNVQYGQYISAKTNELLDKAEKYMKSYEDEFISMEHILRAAIDTDETTQKWVGNKVEVIKEIITKVRGGNHVTSQNPEVNYEALEKYGRDLVEEVRQGKMDPVIGRDEEIRNTIRILSRKTKNNPVLIGEPGVGKTAIVEGLAQRIVRKDVPESLLDKTIFELDLSALVAGAKYRGEFEERLKAVLKEVKESEGRIILFIDEIHMLVGAGKTDGAMDAGNMLKPMLARGELHCIGATTLNEYREYIEKDSALERRFQKVGVSEPDVENTISILRGLKERYEVYHGVRIQDRALVAAAELSDRYITDRFLPDKAIDLVDQACATIRTEMGSNPTELDQVNRRVMQLEIEESALKNESDNASKHRLEELQEELSNEKEKQSSLKSRVEQEKEKIAKVQEKRAELDSSRQALEDAQTEGNLEKAAELQYGTIPQLEKELQEFEEAFQDETGEDSERMIREVVSDEEIGDIVSQWTGIPVSKLVETEREKLLSLSDILHKRVVGQDKAVDLVSDAVVRARAGIKDPNRPIGSFLFLGPTGVGKTELAKSLASSLFDSEKHMIRIDMSEYMEKHAVSRLIGAPPGYVGHDEGGQLTEAVRRNPYSVILLDEVEKAHSDVFNVLLQILDEGRLTDSKGRSVDFKNTIIIMTSNIGSQVLLENVKDAGEISDDTEKAVMDSLHAYFKPEILNRMDDIVLFKPLSVDDMSMIVDKILTQLNMRLLDQHISIEVTEEAKKWLGEEAYEPQFGARPLKRFVQRQIETPIARMMIKESLPEGTIIKVDLNDNKELDFKVVKPTS

SEQ ID NO: 5781 - protein, 45 aa, Staphylococcus epidermidis
TCLDTITYDLYLLKYEHHIIPKKKTKMNSKNSFWSFYMKIISSFS

SEQ ID NO: 5782 - protein, 209 aa, Staphylococcus epidermidis
NKMDYVYTIYKNPRYNIIQKDNRYLMVDLEQNWYSYLCPMLNWFIPIKFTELTYQEFNNINIFHNGGQKSHGMMAAGVGVTISVLLRSLVGYIDINISRIWIVFMFLIGFVAVITLRLSIRKKLNHPAFNKKSKQKVILIPSFKNMILVVFCYFMMLFFSIAPFQMIFEEKKNILGYILWVGVLFIFTTLNMASISDRKVHAKIKNIRR

SEQ ID NO: 5783 - protein, 462 aa, Staphylococcus epidermidis
NSEEKEVKKMDVNVDEQAIVDKLYESTKDWVSVEVELNKTMKPSVLFHLTEKDAGDRFYMRLNDNYSSYFGYHAIHRFKNDFENKQSIFKDWEKLKNNIELIHPHNKYHHLRLCGGFQFSSHKSDDEWREYGLNHFVLPKVLISNEGTRTYLTYTTKRQDFDLQAFKTLVAHFEQTTMDNPEEALGDVTRMEDIYKDDWRDLVKEAIDTIDDNKKIVLARRRLVKFDKKINIPYVLNRALENEKNSYIFLLEANQSIFFSQTPEQLIKVEDGVLSTKAVAGTIKRTHNEQIDNKNIEAFLKDKKNLGEHRFVVESILNDIEPFVQDVEYNETPNILKNDHMYHLYTEIKANLNDKSYIGLIDRLHPTPALGGYPKEEALDFIENKEFGTRGLYGAPVGYIDVYDDCEFIVAIRSMLIKEQQATLYAGCGIVKNSDPDSEVAETAVKFSPMMNALGVDNNDES

SEQ ID NO: 5784 - protein, 44 aa, Staphylococcus epidermidis
AHTLDTFKPIVVWAWYTHKFQFRNKRLPDDLFSWSGHLLWIMLL

SEQ ID NO: 5785 - protein, 62 aa, Staphylococcus epidermidis
IGGFINVHKFLFDFVIIYASFINNYMVILFKSLYKFNQYLILYIIHYFYSCFPYFTHSRRNI

SEQ ID NO: 5786 - protein, 127 aa, Staphylococcus epidermidis
YVKLVWNKEETSMRIYINEIKLKDDGVYCFSEESTEGLEEVGQMLVDSDNYGFAYLLDDGQSYSYLIFVQETWSMLHENRDKRIIINNHLELKHFQEELDYVLNNIEGNNNYGKEFVSAVEKTFELE

SEQ ID NO: 5787 - protein, 44 aa, Staphylococcus epidermidis
DKICLNKLIRSNSVRLMKLISKKVTCLTKFIINREECNNEKKIK

SEQ ID NO: 5788 - protein, 43 aa, Staphylococcus epidermidis
IKSCKVGIDISIKDTPKIAITIKKVSHSPAVIITGNALLIFFG

SEQ ID NO: 5789 - protein, 406 aa, Staphylococcus epidermidis
VFIRKRRGDFMTQSEKIINLTNHYGAHNYVPLPIVISEAEGVWVKDPEGNTYMDMLSAYSAVNQGHRHPRIIQALKDQADKVTLVSRAFHSDNLGQWYEKICKLAGKDKALPMNTGAEAVETALKAARRWAYDVKGIEPNKAEIIAFNGNFHGRTMAPVSLSSEAEYQRGYGPLLDGFRKVEFGDVNQLKAAINKNTAAILVEPIQGEAGINVPPEGYLKTIRELCDEHQILFIADEIQAGLGRSGKLFATDWDHVKPDVYILGKALGGGVFPISVVLADNEVLDVFTPGSHGSTFGGNPLASAVSIAAIDVIIDEDLPGRSLELGEYFKSELKKIEHPSIKEVRGRGLFIGIELHESARPYCEALKEQGLLCKETHDTVIRFAPPLVITKEELDMALEKIKSVFA

SEQ ID NO: 5790 - protein, 51 aa, Staphylococcus epidermidis
TPVRDNSLIKDAYDNSDEISEKINCIIISATLVIIPMPMEVNNRLDAMSLW

SEQ ID NO: 5791 - protein, 44 aa, Staphylococcus epidermidis
YMSRLSLRRQLTKRGGALIANHFRSHHDHSPQLLYYCIIYSLDM

SEQ ID NO: 5792 - protein, 96 aa, Staphylococcus epidermidis
FVIRKASYGQTPHVHFEIVPITEDGRLSAKDVVGNKKALASFQDKFNEYVNERGYELEQGTSRELTNRQHDQVNSYKQKTEYHKKEYERRYKIQPI

SEQ ID NO: 5793 - protein, 454 aa, Staphylococcus epidermidis
KGIRVSISYIYKGETAMNKIIIVGAVAGGATCASQIRRLDKESEIIVFEKDRDMSFANCALPYYIGNVIEDRRKVLAYTPNQFYDKKQITVKTYHEVIQINDERQKVTVLNHQTNQTFEESYDTLILSPGASANRLNTHSDISFTVRNLEDTETIDTFITNTKAQRALVVGAGYISLEVLENLHHRGLDVTWIHRSTNINKLMDQDMNQPIIDEIEKRNITYRFNEEISHVNGHEVTFTSGKVENFDLIIEGVGTHPNSQFIKSSNVILNDKGYIPVNHNFQTNIPNIYALGDVITSHYRHVNLPAQVPLAWGAHRGASIIAEQLSGNSSIHFKGYLGNNIVKFFDYTLASVGIKPNELKNFDYDMVEVKQGAHAGYYPGNSPLHLRVYFEKDSRKLIRAAAVGKQGADKRIDVLSMAMMNNATVDDLTEFEVAYAPPYSHPKDLINLIGYKAQ

SEQ ID NO: 5794 - protein, 43 aa, Staphylococcus epidermidis
ATPRLADTVNLLLVPPDGLEGCDGFVDVVPQGATCFVLIKYFS

SEQ ID NO: 5795 - protein, 164 aa, Staphylococcus epidermidis
KAMRYVYGSEKVLPLSKKTSHHARIYIGQPTKIFNTRRCFLMSSDTNGLAHTKWNCKYHIVFAPKYRRQVIYGKIKRDIGVILRQLCERKGVEIIEAEACKYPVGVVEDQIYYFNEDNIDNVIFEGYSDQDETRFQELFKEMMGNLDEDIKRGTVQQKDSYGLI

SEQ ID NO: 5796 - protein, 500 aa, Staphylococcus epidermidis
KKERYILNASALFKKIRVKNVIGTLDIQVDDITTDSRTAKEGSLFVASKGYTVDSHKFCQNVVDQGCGIVVVNRELELKGNVTQVVVPDTLRVASLLAHELYEFPSHQLTTYGVTGTNGKTSIATMIHLIYRKLNKNSAYLGTNGFQVNETKTKGANTTPETVALTKKIKEAVDANAEAMTMEVSSHGLALGRLRGVEFDVAIFSNLTQDHLDFHGTMEAYGHAKSLLFSQLGEDLSKEKYVVLNNDDDFSDYLASVTPYEVFTYGITHEAQFMAKNIKESLQGVEFEFCTPFGSFPVKSPYVGRFNISNIMAAMIAVWSKGTNLNEIINAVTELEPVEGRLEVLDPSLPIDLIIDYAHTADGMNKLIDAVQPFVKQKLIFLVGMAGERDLTKTPEMGRVACRADYVIFTPDNPANDDPKMLTAELAKGATHNNYIEFDDRAEGIRHAIDIAEPGDTVVLASKGREPYQIMPGHVKVPHRDDLIGLKAAYQKFGGGPLED

SEQ ID NO: 5797 - protein, 593 aa, Staphylococcus epidermidis
RNYRSGLLVDNNKKQVIPRSQYRRKRREYFHNVEREERIRREKIEKENQAKREQHQTKVNEERVKDNLRKARIEKLTQEEIHQQRDDKSYKQKTLNQNNQMNKSKDDDNKIGEESLHDVRVSSDTSTLPHQNKSIKDYDDSGNESKQHTKLTSKESMLGVNSNHTEQDSRSTQPYSSKHSYSQPKDKDNDNTQQAQFLKKEDKQRNRAENIKKVNEFKQLVVAFFKEHWPKMLIIIGIIVLLLILNAIFTTVNKNDHTNDSAFNGTAKDETTAMKIAENSVKSVVTVENDLSNDTTVSDNKNESDNEIGSGVVYKKVGDSIYIFTNAHVVGDQEKQKVTYGNDKSVTGKVIGKDKWSDLAVVKAKVADENIKPMTMGDSNNIKLAEPILVIGNPLGTDFKGSVSQGIVSGLNRHVPVDIDKNDNYDALMKAFQIDAPVNPGNSGGAVVDRDGRLIGIVSLKIDMHNVEGMAFAIPINDVRKIAKELEHKGKVNYPNTEIKIKNVGDLDDSERNAINLPAKVNHGVLIGEVKENGLGDKAGLKKGDVIVELDGKKIEDNLRYRQVIYSHYDDQKTITAKIYRNGAEKNIKIKLK

SEQ ID NO: 5798 - protein, 317 aa, Staphylococcus epidermidis
RGWLLMSNENVLLQVKNLKQYFNQGKHNEVKAIDNISFDVYKGETLGLVGESGCGKSTTGKAIIKLNDITDGAIEYDGKDIHQIRKRKERLKFNKKIQMIFQDPYASLNPRLKVMDIVAEGIDIHKLASSQRDRKKRVYDLLETVGLGKEHANRYPHEFSGGQRQRIGIARALAVEPEFIIADEPISALDVSIQAQVVNLLLKLQRERDITLLFIAHDLSMVKYISDRIAVMHFGKIVEIGPADDIYNYPLHDYTKSLLSAIPQPDPDVERNRQRVLYHEDATLNEERQLNEIRPQHYVFSTQNEAVKLKQKYGLSV

SEQ ID NO: 5799 - protein, 150 aa, Staphylococcus epidermidis
GKTSENGGDTVFQIAKNQTMLDDCFEIRKCVFVEEQGVPLENEFDQYEDYSFHIVGYINGVPMATARIRPLNTHICKIERVAIIKWYRGLGYGKNLIHAIETIAKKHQYNELTMNAQLQARDFYLKLGYSPFGKVFLEENINHISMNKFL

SEQ ID NO: 5800 - protein, 103 aa, Staphylococcus epidermidis
CPRLFYCKHRQQFNLKTRLISSYFNICLNPEFQTEILQTRQVGVRGPNIENFKQKFYRQGKLGFGVCLDNALITYAPLKPFIKIQSVNKINVYSFIYITHLSL

SEQ ID NO: 5801 - protein, 49 aa, Staphylococcus epidermidis
QILRFFEDNTKIVQNVFKFSFVTLQPYLINNEHFIKQIYDKAWYCTPYL

SEQ ID NO: 5802 - protein, 90 aa, Staphylococcus epidermidis
SVSRVIKIAQRIMEDYECIKSVSALEDKEKEIREKDDLLNKAVGRIENTYDNFNRLYEMAKPFKENVEIALKLLKILLKELMKKHICGKS

SEQ ID NO: 5803 - protein, 514 aa, Staphylococcus epidermidis
IESRKTFAIISHPDAGKTTLTEKLLYFSGAIREAGTVKGKKTGKFATSDWMKVKQERGISVTSSVMQFDYDDYKINILDTPGHEDFSEDTYRTLMAVDSAVMVIDCAKGIEPQTLKLFKVCKMRGIPIFTFINKLDRVGKEPFELLDEIEETLNIDTYPMNWPVGMGQNFFGIIDRHSKTIEPFRDEENLLHLNEDYELKEEHAIKNDSAFEQAIEEMMLVDEAGEAFDNEALLNGELTPVFFGSALANFGVQNFLNAYVDHAPMPNARQTKEEVDVSPFDIDFSGFIFKIQANMDPKHRDRIAFMRVVSGAFERGMDVTLQRTNKKQKITRSTSFMADDKETVNHAVAGDIIGLYDTGNYQIGDTLVGGKQKYSFQELPQFTPEIFMKVSAKNVMKQKHFHKGIEQLVQEGAIQYYKTLHTNQIILGAVGQLQFEVFEHRMNNEYNVDVVMEPVGRKIARWIENEEDIKDNMNTSRSILVKDRYDNYVFLFENEFATRWFEEKFSDIKLYSLL

SEQ ID NO: 5804 - protein, 161 aa, Staphylococcus epidermidis
KAQRFAKLKSARRVIAIDHVEHRLAHTEKYNGAEVYNFLKEDDVGKLLHETTRGGADVVIDCVGIDEQVVQDDLEVSSNSIQRGNISPIVTATESVRKYGTIQLIGVYGTAADNSQLDLIFNRNVQVKSGQAPVIHMMPKLYDMIKIKSLIQQKLSLILCL

SEQ ID NO: 5805 - protein, 44 aa, Staphylococcus epidermidis
PTKRPHKKDALVTQGDLPVFILRWAYGIKLPQGMPKVGLLTGRN

SEQ ID NO: 5806 - protein, 73 aa, Staphylococcus epidermidis
SELSTSIISALIYLATVAKTVADSAREGKIAVEKPSHPATGNHSNLTANTYCNKTAKTNDGTDTAITEIIVVV

SEQ ID NO: 5807 - protein, 242 aa, Staphylococcus epidermidis
DDMRIERVDDTTVKLFITYSDIEARGFSREDLWSNRKRGEEFFWSMMDEINEEEDFVVEGPLWIQVHAFEKGVEVTISKSKNEDAMNMSDDDTNHQFDDQVNELLAQTLEGEESLEDLFEQRKQQKKNHQDKQQRRAHKPSNVRNIIVKFDDLEQVIDYAYHNNQNTDEFEDLLYMIDNKYYYSIHFDDSVSQEMINDSYSQLLEFAYPTDKTNIYLNDYAKIIMSHNVTSQVRKYFTDTNE

SEQ ID NO: 5808 - protein, 468 aa, Staphylococcus epidermidis
ICFGGVNMSNETEMKDNVREDVYDKELFDRLLDQNDIDEFRKEFLELHNYEQSEYFEDTDDENRQKIFEFLSPKEVANFFDQLDFDDDDYESLFDNMDATYASHVLEEMSYDNAVDILNELSKPKVASLLTLMNKDKANEIKALLHYEEDTAGGIMTTEFISLKSTTPVKEALIHVKEQAPDAETIYVIFAVNEDEQLVGVLSLRDLIVAENDAYIEDVMSERVISANVGDDQEDIAQLMRDYDFIAVPVVDYQNHLLGIITIDDILDVMDEEASEDYSRLAGVSDIDSTSDSVFKTASKRLPWLIVLTFLGMITATILGSFEDTLSQVALLAAFIPIISGMSGNSGTQSLAVSVRNISTGEINEQSKFKIALREAGSGLLSGIVCAVILFLIIVVIFRQPLLALIVGGSLTCAMTVGTLVGSMIPLVMNKCKIDPAVASGPFITTINDIVSMLIYFGLATSFMSYLT

SEQ ID NO: 5809 - protein, 169 aa, Staphylococcus epidermidis
MILGLALVPSKSFQDEVNAYRKRYDNHYAQIMPHITIKPQFEIDDHDFNLFKNEVKNRISSIKPVEVHATKASNFAPVSNVIYFKVAKTESLEQLFNQFNTEDFYGIAEHPFVPHFTIAQGLTSQEFEDIYGQVKLAGVDHREIIEELSLLQYSEEEDKWTIIETFTLG

SEQ ID NO: 5810 - protein, 55 aa, Staphylococcus epidermidis
NIKGAGTINGLTYRPALYIQPLYTCYNQGINFYEGGFQEKIFKHLKENFSGKILR

SEQ ID NO: 5811 - protein, 548 aa, Staphylococcus epidermidis
RMKGFKVLIILLSVCIILSACSNKQSLYSDQGQVFRKVITQDMTTLDTALITDAVSGDIAAQAFEGLYTLNKEDKAEPAIAKSFPKKSNGGKTLTINLRKNAKWSNGDSVTAYDFVYAWRKVVNPKTASEFAYIMSDIKNADEVNAGKKSVKDLGITAIGKYKLQVDLERPVPYINELLALNTFNPQNEKVAKKFGEQYGTTAEKAVYNGPFEVTNWKVEDKIQLVKNEQYWDKKNVKLDKVNYKVLKDQQAGASLYDTGSVDDTIITSEQVDKYRGESALNYRLTAATFFIKMNQKTVPEFKNKHLRLAISQAINKKGYVNSVLNDGSLPSNNFTGVGTADTPDGKDFARTIKSPLKFNPDLAKKNWREAQKELGKNKFTFTMNTQDTPASKIAAEYIKSQIESHLPGVTLKIKQMPFKQKTTLELANNYEASYSGWSPDYPDPTAFLQTMTKNNAQNNTDWSNKEYDQLLKDANSKFLRKPGERNTSLQKAEYILLHEAPVAPVYQKGEAHLTNPQVKGLQYHKVGPETTLKHVYIDKSINRETGK

SEQ ID NO: 5812 - protein, 67 aa, Staphylococcus epidermidis
FKGGLVMTVAEVGNIVEFYDGLRGRVEKINDNSVIVDLTIMDNFNELDLPEKTVINHKRYKIVDQEG

SEQ ID NO: 5813 - protein, 139 aa, Staphylococcus epidermidis
KDGGTNMLHVHILSWVLAIILFIATYLNYSQTQGASPYYKPLHMALRLFMLLTLISGFWELIEEFMAASNGEGGNHMLLTLKMLCGLAVIAFMEISIAKRKKQQTSHKFFWITIILIIITMAIGVILPWGPISKIFGIS

SEQ ID NO: 5814 - protein, 55 aa, Staphylococcus epidermidis
IIILKFINLPRTIYNGVCVTFSLINLKKHFLAQIHESKKCFFYPWNINNKMIATI

SEQ ID NO: 5815 - protein, 1162 aa, Staphylococcus epidermidis
GNVMEFNTYIGRAGTGKSTAMLNQIKNKMKQDPLGDPIVLIAPTQSTFQLEQAFVNDSELHGSLRTEVLHFERLSHRVFQEVGGLTEQRLSKDALEMMIFHIVQQHESDLKLYGSQAQYYGLSEKLAEQIQDFKKYNVTPEHLNQLIENHSIQTRTKHKLEDISLIYKQLESRMNGEFITTEDSLQQFIEILSQSQWIKKAEVFIDGFHNFSTLEYRIIEALVQHAKQVTVLLTTDGSHHPFSLFRKPSEVLSHLEDIANRLNINLNKTYFNTFYRYNNDDLKNLENGFDALQFTPKHHQNHVKIFESSSMREEINEVARRILKDVREADYKFRDIAILYRDESYAYLFESILPSYDIPFNIDTKKSMTHHPIMEMLRSLLEVIRSNWHINAMLRLFKTNVLTSQFKRSSYLIDLLENFVLERGIYGKRWLDEDIFSIDQFSRMGRKSHQLTEGHQALYKEVIKLKKNVINKVLYFEQAMNEAHTVKDYATSFYESLEYFELPSQLMTQRDELELAGLTEKAEEIDQVWNGLIQILDDLVTVFDDQEMTLQQFLDVFDIGLEQLEFVMIPQTLDQVSIGTMDLAKVDNKKHIYMVGMNDGILPQTVSSSSLITDEEKKYVEDNAHVELSPTSDILQMDEAFVCYIAMTRSQQSVTFSYSLMGNSGDEKEISPFLTQIKELFYDLEIINLQDLHKAQPLLMMQHSHQTKIQLFEYLRGWLDHEDIDYRWLDAYLAIRDDDQLNQGLDYLTTSLTYDNETVQLNEILSQQLYGKTINASVSRFEGYQQCPFKHYASHGLRLNERTKYELQNFDLGDIFHSVLKYISDRIYGDFKNLDTKNIQSLTKEALELILPKVQFNLLNSSAYYKYLSKKIGSIVETTLKALKYQGEYSKFVPQRFETGFRKSPKNKGELVAQPLITNQGIPINIRGQIDRIDTYTKGDHSYVNIIDYKSSESSATLDLTKVYYGLQMQMMTYMDIVLQNKERLGLTDIVKPGGLLYFHVHEPRIKFKSWADIDEDQFQKDYIKNFKMSGLLNRDQEVLDALDIRLEPKYNSDIVPIALTAKGAINQRSSKVADENIIYQLIEHNKKNFIETASHIMDGHTEVAPLKYKQVLPCQFCNYKSVCHVDGLIDSKRYRTVDESIKPLDLIQQLRNEGGERHDSN

SEQ ID NO: 5816 - protein, 260 aa, Staphylococcus epidermidis
GVTIMLNLENKTYVIMGIANKRSIAFGVAKVLDRLGAKLVFTYRKERSRKELEKLLEQLNQSEHHLYEIDVQNDEDIINGFSQIGKDVGQIDGVYHSIAFANMEDLRGRFSETSREGFLLAQEISSYSLTLVAHEAKKLMPEGGSIVATTYIGGEAAVQNYNVMGVAKASLEANVKYLALDLGEDNIRVNAISAGPIRTLSAKGVGGFNTILKEIEARAPLKRNVDQEEVGKTAAYLLSDLSSGVTGENIHVDGGFHAIK

SEQ ID NO: 5817 - protein, 148 aa, Staphylococcus epidermidis
LQYIDGLIDKQLIDEDAKEDVRRDEIMHFIDGPLYMEIAQADNVYTELPFVVNQIKVDGLTSEDEDVSIIQGMIDLIYESDGQFYFVDYKTDAFNRRKGMSDEEIGNQLKEKYQIQMTYYRNTLETILKRPVKGYLYFFKFGTLEIDD

SEQ ID NO: 5818 - protein, 617 aa, Staphylococcus epidermidis
GGHMEFLSLVIVVVAAFMTPIIVHRFNINFLPVVVAEILMGIVIGHSFLNLVERDAFLNILSTLGFIFLMFLSGLEIDFNAFKKDSRPRQGEDKHEKDVPGHLKLALTVFAFIMMISVVLAFAFKWLGLVNDVLLMVIIISTISLGVVVPTLKEMNIMRTTIGQFILLVAVLADLFTMILLTVYGAIYGEGGSTIWLTGILVVFTVVFYVIGVLFKRMSFLQKLMDGTTQIGIRAVFALIILLVALAEGVGAEYILGAFLAGVVVSLLKPNEEMVEKLDSFGYGFFIPIFFIMVGVDLDIPSLIKEPSLLLIIPVLIFSFIISKLIPVFYIRRWFDTKTTIASAFLLTSTLSLVIAAAKIAEKLKAISPETSGILILSAVITCVFVPVIFKKMFPIPNEVGRRIEVSMIGKNQLTIPIAQNLTSQLYDISLYYRKDLSDSRKLSDDITMIEIADYEEDLLERLGLFERDIVVCSTNDDHINKSVALMAKKHGVKRVICRLESTNEDPTLKHQGIEVFSNYLSNKILLKSLIETPNMLNLLSNVETSLYEIQMLNYQYENIQLRNFPFGGDIIFVRIIRDNDSIVPHGDTQLRYKDRLIVTGTKEYVDELKQELEFYY

SEQ ID NO: 5819 - protein, 92 aa, Staphylococcus epidermidis
KQHIKNLVVDLLRIKSLQFHGMMINVYHYHSNDLIMLAIPELFWSIELSKELDANQLYEELVMQLFNLLTEVEADTLASNITDLIRNESKGE

SEQ ID NO: 5820 - protein, 332 aa, Staphylococcus epidermidis
ASNMETLFSGIQPSGIPTIGNYIGALKQFVDVQDDYECFFCIVDQHAITVPQDRLKLRKQIRQLAAIYLATGIDPDKSTLFIQSEVPAHVQAGWMLTTIASIGELERMTQFKDKAQKRADGVPAGLLTYPPLMAADIVIYNTNIVPVGDDQKQHMELTRNLVDRFNSRYNDVLVKPEVRMPKVGGRVMSLQDPTKKMSKSDDNQKNFISLLDEPHVAAKKIKSAVTDSDGIIKFDRENKPGISNLLSIYSGLTNESIKNIESKYEGEGYGKFKGDLSEIVKDFLINFQEKYASFYNSDDLDDILDKGKEKAQKASFKTLKKMEKAMGLGRKR

SEQ ID NO: 5821 - protein, 285 aa, Staphylococcus epidermidis
TMILTYQIVQSEPVKTFLKNQDYSKRTLSAIKLNGALLLNGSPVTVRHVMNKGDRLEVHFPCETPSENLIPYDKELEVIYEDAYLIIVNKPQMQNCAPSREHPHGSLVEQVLAYYTKKGEKINPHIVTRLDRNTSGLVVFAKFGHVHHLFSKVKFKKEYVALAYGHTQSSGVIEAPIARRSDSIIKREVNDKGKYAKTVYQRLMQNETASLCKVKLLTGRTHQIRVHFEYIGHPLIGDDLYGGNHPCVHGQALHCCSVEFIHPIYRSHYLINVDYKQLIKLFNMV

SEQ ID NO: 5822 - protein, 404 aa, Staphylococcus epidermidis
GVNMKDKIVLAYSGGLDTSVAVQWLIDKGYDVVACCLDVGEGKDLDVVYQKALDMGAVECHIIDATKEFSDDYVSYAIKGNLMYENAYPLVSALSRPLIAKKLVEIAEKTNSIGIAHGCTGKGNDQVRFEVAIKALNPKLKAFAPVREWAWSREEEIDYAIKHNIPVSINYDSPYSIDQNLWGRANECGILEDPYAAPPEDAFDLTTPLEETPDNADEIILTFKQGIPVQVDGKDYQLDDLILYLNQLAGKHGIGRIDHVENRMVGIKSREIYETPGAEVILKAHKALETITLTKDVAHFKPVIEKQFSEQIYNGLWFSPLTDSLKLFIDSTQQYVEGDVRIKLFKGNAIVNGRQSPYTLYDEKLATYTKEDAFNQESAVGFIDIYGLPTQVNALLHGGYSNEQ

SEQ ID NO: 5823 - protein, 263 aa, Staphylococcus epidermidis
YNSINITREHRFMSEFKVGKINKKIIHSDILNRDVTLSVYLPEDYTNLFKYQLIFCFDGLDFFRFGRIQRIYEQLREEQSIQRAIIVGFHYEDVEKRREEFHPSGSRSNLTIKAMGKEILPYIDATFPTYKVGNTRLLIGDSLAGSIALMTAMTYPTIFSRVALLSPMYNENIKKKIDTCMNKGQLTIWHAIGLEEADFILPTNGKRANFLTPNRELNQLIKEDNIEYFYKEFNGGHHWKSWKPLLGDILLQFLGDPINGKYV

SEQ ID NO: 5824 - protein, 201 aa, Staphylococcus epidermidis
KLSINFSYQYLKGESNVIRKAKTSDNRQIAELCYLIWRDMELDITKEITKDRIIEAIELSIVNVRYRSFYEHIWVYEKDGVVAGCVIAYPGKEEMDFEQQWLKLPLEEDILQLGTPLPEKESYDDEIYIEAVVTTPKYRGQGIATQLLKYVISTHAHEKWGLNCDYDNNKARHLYHKLGFKEDATIRLYGHQYFHMTLNNK

SEQ ID NO: 5825 - protein, 56 aa, Staphylococcus epidermidis
IQIIICQCDKFFKLFIHVVLLHYIKLIILYALFINYTIQIYTLHKFVASLPIFILH

SEQ ID NO: 5826 - protein, 49 aa, Staphylococcus epidermidis
CFRIQQPFANILFYLSYFIKHIFHLLDHLKIVREYLLAMVSMISNDVHR

SEQ ID NO: 5827 - protein, 194 aa, Staphylococcus epidermidis
GFLMTHLPETIYVIRKGDMVIRPKYDEYQQTNGTEIIRFDQTRKESPFKVQRIIERSCKFYGNNYISKKAETNRITGISSKPPILLTPLFPTYFFPTHSDRQEENIWINMHYIENVKELKNRKSKIIFANGDSLTLNVSFHSLWHQYTNAIIYYYMVDKQSRMKSNNPEQPIDYNQSSLNIFEALSRYSLFEEN

SEQ ID NO: 5828 - protein, 57 aa, Staphylococcus epidermidis
FYLIQLQLKPNLLYFHITYRRLPVRLHSHPFFSLLSPPNFTHYYIVSFLIFYVVINA

SEQ ID NO: 5829 - protein, 767 aa, Staphylococcus epidermidis
YAIINVIKFIKGGQLMDFINITGASQNNLKNIDVNIPKHLVTVFTGRSGSGKSSLVFNTVAAESEQLLNESYSSYIQFHLNQQPRPKVKKIKNLPVAMTINQKRFNGNSRSTVGTVSDIYASVRLLWSRIGEPFVGYSDAYSFNSPKGMCKTCEGLGYIEDINLDELLDWDKSLNEGAIDFPSFGPDKERGKAYRDSGLFDNNKKLKDYTKDELELFLYQEPMTLKNPPKEWRKSAKYVGLIPRFSRIFLGDKEFNKKRYAKHLKNVVNNKICSTCKGQRLNSKILSSKIMSKNISDFTQMTIKENLEFLNKLEDPTAKYIIDPLKKQLEALEYIGLSYLTLNRVTTTLSGGEAQRLKLIRHLNSSLSDLVYIIDEPSVGLHPEDIAKINEILKSLKEKGNTVLIVEHDPDVIKEGDYIIDMGPGSGKNGGEITFEGTYNELLSSNTSTGNALRNKHNLKENIREANHFYNIGPVTQNNLNNVKTSIPKHVLTVLTGVAGSGKSTLVKAGFENNDHTIFIDQKAVQGSNRSNLLTYLGVFDSVRSYFSKETGLNKAMFSYNSKGACPNCGGKGYIKTELAFMGDFSQTCEVCHGKRYKQEVLDATIDGYSIADVLNLTVDEGIIFFDKKNDIKSKLQSVSKTGLNYMSLGQPLSTLSGGEIQRVKLGQHLDEEIKNSIFIFDEPTTGLHESDIPILMECFDDLIDQNNTVILIEHNLSIMCEADWIIDVGPGPGLDGGKVQFSGTPKNFIDSSETLTSKHLKRYIKQ

SEQ ID NO: 5830 - protein, 82 aa, Staphylococcus epidermidis
FFPIILTSMRRPTSLGIGNIFLNITGTKTHVITALRIKMPEVSGEIAFNFSAILAAAITSDKVDVSKKADAMVVLVSNQRLM

SEQ ID NO: 5831 - protein, 106 aa, Staphylococcus epidermidis
LLAIEPPISRKSSDIRKEKVQVLRSLKCFNPNEIKESFVRGQYDGGMMNNEFVPAYRNEPNVNSQSNTETFVAGKIEIENSKWASVTFYIRTEKRMKKIYPNRYRV

SEQ ID NO: 5832 - protein, 353 aa, Staphylococcus epidermidis
KDVFMFKSKKIIISTLSTVTLGLASLSSPSIAETSNHSPAPNQSEKSIQQQTNIPSNMNQSSAKTFKRQAESDSVSGKTNDTHNHWTKNLTGEKFTTIAHRGASGYAPEHTFEAYDKSHNELGASYIEIDLQRTKDGHLVAMHDEKVNRTTNGHGRVDQLTLKELKQLDAGSWFNRKHPEYAKNKYKNAKVPTLDEILNRYGKNANYYIETKSPDVYPGMEKQLLDTLDKHDLLTQKSLKHGHVMIQSFSGSSLEKVHHMNANIPLIRLMNKFELKKATNQDLKNIKSYAIGVGPEYTDLNIKNTRHLKNLGFLVHPYTVDDENQMRNLNQYGVDGVFTNFADRYKKVSETQQ

SEQ ID NO: 5833 - protein, 49 aa, Staphylococcus epidermidis
ATKIKNTIHQLSKYINNELEHIATIKMLAHFGKLYFINSFCKTVLIYNS

SEQ ID NO: 5834 - protein, 173 aa, Staphylococcus epidermidis
PKKISKALPVIITAGLCDTFLIVIAILGVSLILISMPTLQLFIYIIGFLFLMYMAWSLWTEKPSNIEEIEPMSAKKQILFALSVSLLNPHAIMDTVGVIGTSASVYDGYDKVVFSLATISVSWIWFVFLAILGRITGKIDKSGKYIVILNKVSSVIVIIVGLIILKNIVGILS

SEQ ID NO: 5835 - protein, 40 aa, Staphylococcus epidermidis
FERIMRLFKQFKYYILVFLYREVLANEIIIKFKFKIFKSP

SEQ ID NO: 5836 - protein, 484 aa, Staphylococcus epidermidis
VSLIFMVYLHKLMHYFTGGIVMSNKAWGGRFETQPEEWVDDFNASIDFDKNLIKQDVQGSIAHATMLAKQHIITDDEAQSIINELKNIQSDFEEGKLKFKASLEDIHLNIEHELIQRIGEAGGKLHTGRTRNDQVATDMHLYTKEQVQYIIELIASFQETIVQLADQHVDTIMPGYTHLQRAQPISFAHHIMTYFWMLERDKGRFMDSLKRIDISPLGAAALSGTTHPIDRHLTQELLGFANLYENSLDAVSDRDYIVETLHHISLTMVHLSRFAEEIIFWSTDEAKFITLSDAFSTGSSIMPQKKNPDMAELIRGKVGRTTGHLMSMLVTLKGLPLAYNKDMQEDKEGLFDAVHTLKGSLRIFEGMVASMKVNSNRLSQTVKNDFSNATELADYLVSKSVPFRTAHEIVGKIVLNCIHKGIYLLDVPLSEYQEHHENIEEDIYDYLTPENCLKRRQSYGSTGQESVKHQLKVAKALLKDNESK

SEQ ID NO: 5837 - protein, 559 aa, Staphylococcus epidermidis
IIMMNHSEALTEQVFSFASELYAYGVREVVISPGSRSTPLALVFEAHPNIKTWIHPDERSAAFFALGLIKGSEKPVAILCTSGTAAANYTPAIAESQISRLPLVVLTSDRPHELRSVGAPQAINQVNMFSNYVNFQFDLPIADGSEHTIDTINYQMQIASQYLYGPHRGPIHFNLPFREPLTPDLDRVDLLTSVTKTLPHYQKSISVDDIKDILQEKNGLIIVGDMQHQAVDQILTYSTIYDLPILADPLSQLRKEKHPNVITTYDLLYRAGLNLEVDYVIRVGKPVISKKLNQWLKKTDAYQIIVQNNDQIDVFPTPPHISYEISANDFFRSLMEEPLVERKKWLQQWQSLEQQARIEISDYLKHATDEAAYVGSLIQKLTKEDTLFVGNSMPIRDVDNLLFDSEASVYANRGANGIDGVVSTALGMAAHKNVTLLIGDLSFYHDMNGLLMAKLNELHINIVLVNNNGGGIFSYLPQKRSATKYFERLFGTPTGLNFEYTALLYDFTFKRFDNLTDFKYAELSKMGSHMYEVITNRDENLHQHQNLYQKLSEIVNVTL

SEQ ID NO: 5838 - protein, 148 aa, Staphylococcus epidermidis
QLSIRQITFKCKNSCYIRYILMEHGDIMSKTPYELIGQKALYQMIDHFYQLVEKDSRINHLFPGDFKETSRKQKQFLTQFLGGPDLYTQEHGHPMLKRRHMEFTISEYERDAWLENMHTAIQHAQLPAGVGDYLFERLRLTANHMVNS

SEQ ID NO: 5839 - protein, 612 aa, Staphylococcus epidermidis
AIQIIKEVYIMSQQLTREEQERKYPEYTWDLTTIFKSDEAFEEAFKSIEAKIGEEEKFKGHLGESAETLYEALSLEDELGTKLEKVYVYAHLKQDQDTANDKYTGLEARAHQLVIKYSSAWSFLVPEILQLDEATIQSFIDSNNDLKRYEFDLKLINEKRPHILDANTEKLLTEAQDALSTPSNVYGMFSNADLEFEDAIDKDGQAYPLTQGTFIKYLESDDRELRASAFRNVYKAYGAHNNTLGATLAGEVKKNVFNARTHHYRSARERALSNNHIPEAVYDNLIKTVHKYLPLLHRYTKLRQELLGLDDLKMYDLYTPLVKDVKFEMPYEEAKSWMLKALEPMGEEYLNVVKKGLDNRWVDVYENKGKRSGGYSSGGHLTNPFILLNWSDTVSDLYTLVHEFGHSAHSYFSRQNQPSNLSDYTIFVAEVASTCNEALLSDYMDKHLDDERRLLLLNQELERFRATLFRQTMFAEFEHKIHQIEEAGEPLTPNRMNEEYAKLNKLYFGEAVETDDDISKEWSRIPHFYMNYYVYQYATGYSAAQSLSHQILTEGQPAVERYINEFLKKGSSNYPIEILKNAGVDMTTPQPIEEACEVFEQKLDAFEKLMKA

SEQ ID NO: 5840 - protein, 49 aa, Staphylococcus epidermidis
RYNLSMIESLCHYKCKGLHICFASRFSLFHTIQFFDYDDIDSFYCYIKK

SEQ ID NO: 5841 - protein, 43 aa, Staphylococcus epidermidis
TSNFFTNQFHKTNAIASNQLIQTNFISFKLTRSFSYVIAIPII

SEQ ID NO: 5842 - protein, 332 aa, Staphylococcus epidermidis
GENVMKFISNNNINDPSLNLAMEEYVLKNLPSEESYFLFYINRPSIIVGKNQNTIEEVNQAYIDKHQIDVVRRISGGGAVYHDTGNLNFSFITDDDGHSFHNFKKFTMPIVQALQSMGVNAEMTGRNDIQVGQAKISGNAMVKVKNRMFSHGTLMLNCDLNEVQKALKVNPAKIKSKGVKSVRKRVANIEEFLEQPIDIEEFKKIILKTIFGENEVEEYILTEEDWKNIKQLSDEKYRTWEWNYGSNPKYNIEREEKFEKGFIQIKLDVKKGRIERAKLFGDFFGEGDVTELEHALVGCLHDFEHIEEALQNYDFYHYFGDIDKYEIIRLMS

SEQ ID NO: 5843 - protein, 168 aa, Staphylococcus epidermidis
TYVVNILKRSANMSRKTYEKIANINGMFNVLEQQIIHSKDMALFRNEFFYVNHEHRENYEALLIYYKDSLDNPVVDGACYILALPEIFNKVDVFESDLPFTWVYDENGLSDTMKSISVPLQYLIAAALEVTDVNIFKPSGFTMGMNNWNIAQLRIFWQYCAIVRKEAL

SEQ ID NO: 5844 - protein, 72 aa, Staphylococcus epidermidis
IFGVATNHLKESGLTNVKGLMRIIIEKPFGDDLKSAKKLNNQISKSFKEEEIFGIGHYLSKEMIQNIERLRF

SEQ ID NO: 5845 - protein, 264 aa, Staphylococcus epidermidis
INLVRFKMKAFVEAVDELGGIYYDVPYNLNEPNSDDTGRIKIKKGYQKLNGDQALAVARTRHHDSDLKRGQRQMELIKILFQKAQNLKSIDKLDNVISIVGKNAKHNLTQKEIKSLAKMYLGGSTEIKTSQLKGKDDYLNDIYYYHPSVKSIMEYSNLLRNDLDLSKITNKNDFLDQRVIKRYGSLVPLTELDEDLLRKNQKESTDSQKESDSSSQNNDEEDQTNEQTDQNSLNGNEQYPNQQDNNQTNGENGMINNDNYPYAQ

SEQ ID NO: 5846 - protein, 77 aa, Staphylococcus epidermidis
KVVVFMNHNTEVKYTTLEDFVMTVNDLGVELVIEEALRNARKAKLKLLIDEALINKNENDFIQYTNEFKQLEAFLSE

SEQ ID NO: 5847 - protein, 80 aa, Staphylococcus epidermidis
YNTVKYPFQPLFIHKTKLSQSVHIVSEFNSTKLSLTFQKHLIFVRILHKLPLLVEVLSCQHLHFLIFQSDSLSYPFLRIH

SEQ ID NO: 5848 - protein, 1076 aa, Staphylococcus epidermidis
EMKVVKDMIPTKPHDVIWTDAQWQSIYAKGQDILVAAAAGSGKTAVLVERIIQRILRDEVDVDRLLVVTFTNLSAREMKHRVDKRIQEASFKDPNNEHLKNQRIKIHQAQISTLHSFCLKLIQQHYDVLDIDPHFRTSSEAENILLLEQTIDDVLEQHYDKLDPHFIELTEQLSSDRNDDQFRSIIKQLYFFSIANPQPFEWLNQLAQPYKEENKQRELMQLINDLAMIFMKAGYEELQKSYDLFSMMESVDKQLEVIETERMFITKAIEGKVLNTDVITQHEFMSRFPAINSKIKEANEGMEDALNEAKQHYDKYKSLVMKVKNDYFSRNAEDLQRDMQQLAHRVAYLAQIVQDVIQSFGVQKRSRNILDFSDYEHFALRILTNEDGSPSRIAETYREHFKEILVDEYQDTNRVQEKILSCIKTGEEHDGNLFMVGDVKQSIYKFRQADPSLFIEKYNRFSSSGTESGLRIDLSQNFRSRQEVLSTTNYLFKHMMDEQVGEISYDDAAQLYFGAPYDEVSHPVQLRALIEASSENSDLTGSEQEANYIVEQVKDIINHQNVYDMKTGQYRKATYKDIVILERSFGQARNLQQAFKNNDIPFHVNSKEGYFEQTEVRLVLSFLRTIDNPLQDIYLVGLMRSVIYQFTEEELAKIRVVSPHDDYFYQSIKNYMIDEKADSRLVDKLNRFIQDIQKYQNYSQSQPVYQLIDKFYNDHFVIQYFSGLIGGKGRRANLYGLFNKAVEFENSSFRGLFQFIRFIDELIDRKKDFGEENVVGPNDNVVRMMTIHSSKGLEFPFVIYSGLSKKFNKGDLNAPVILNQQYGLGMDYFDVNKDMAFPSLASVAYRAINEKELISEEMRLIYVALTRAKEQLILVGRVKDEKSLIKYEKLAVSDTHIAVNERLTATNPFVLIYGILAKHQSPSLPNDQRFERDIDQLNSEVKPRVSIVIDHYEDVSTEEVVNDNEIRTIEELKAINTGNEDVKIKIHQQLSYDYPFKVNTMKPSKQSVSELKRQLETEESNTNYDRVRQYRIGVASYERPKFLTQTKKRKANEIGTLMHTVMQHLPFREQRLTKDE

SEQ ID NO: 5849 - protein, 44 aa, Staphylococcus epidermidis
LSEVTYNKISLVNFVRKPLKIYSEYDYCGHFILLYYQVLKMLNY

SEQ ID NO: 5850 - protein, 313 aa, Staphylococcus epidermidis
FRRVYMTKYVLKRLCYMFVSLFIVITITFFLMKLMPGSPFNDTKLNAQQKEILNEKYGLNDPVALQYVNYLKNVVTGDFGNSFQYHNMPVWDLVKPRLIPSMEMGITAMVIGVVLGLVLGVAAATKQNTWVDYTTTIISVIAVSVPSFVLAVLLQYVFAVKLEWFPVAGWEGFSTAILPSLALSATVLATVARYIRAEMIEVLSSDYILLARAKGNSTLKVLFGHALRNALIPIITIIVPMLAGILTGTLTIENIFGVPGLGDQFVRSITTNDFSVIMATTILFSTLFIVSIFIVDILYGVIDPRIRVQGGKK

SEQ ID NO: 5851 - protein, 618 aa, Staphylococcus epidermidis
RNLLLIGKNVTMRKKLNNEYRSAKKIRYMPGLDGLRAIAVIGIIIYHLNKQWLTGGFLGVDTFFVISGYLITSLLLKEYEDTGTINLKNFWIRRIKRLLPAVFALIVVVGIATLLLHPEHIVRVKHDMIAAIFYVSNWWYIAKDVNYFEQFSFMPLKHLWSLAIEEQFYLFFPAVLLLFMAIVKKKKNVILMFWIISLVSLLMMVVISQPHLNHSRVYFGTDTRLQTLLLGVLLAFIWPPFKLNPNPPKGLKTVINSAGIIGLTFVILLFFNVSDESDWIYNGGFYLISTMTLLIIASVVHPTTILAKLLGNPLFVYIGKRSYSLYLWHFPVISFIHSYFIDGQLPTYVYIMDIVITVLLAELSFRYVETPLRKEGLKAFTFKKTYKPQFIRTIVTLIMLLPFIFILVGAFDKFGKDTISNKAQTFNTNEADQYLIHMIPIDNISLTSDGKTKENKKDNDVYTQIKPLLIGDSVMVDIGEQFKTKVPKAKIDGKVGRQLYQAESLVKNQYRHYNKPSDQIILELGTNGDFTKEQLDNLIDKFGKAQVYLVNTRVPRSYESHVNELMAKAAKNKKNVTLIDWYSRSKGHTEYFAPDGIHLENDGVEALTDEILKNIKKK

SEQ ID NO: 5852 - protein, 51 aa, Staphylococcus epidermidis
NTIFEPLWNNKYISNIQATSSETISIEYRGGYYESSGALKFMVQNHLLQMV

SEQ ID NO: 5853 - protein, 127 aa, Staphylococcus epidermidis
EVSLMSINSYLISSLFTPVLSIIIWLFYSNHFINLINILFYTSFIIFIVAFLILLIQEGIFDATSFGFRRLKYQLSSTKRKRMMKNDHFFNPQKVKKESYIISPWVVPTLIINLTYIIVSIGVSLLI

SEQ ID NO: 5854 - protein, 395 aa, Staphylococcus epidermidis
QMKLSLNSSSKFLRAPSIRQFSNRIKAIDDCVNLTIGQPDFPMPDVVKNAYIKAIKNDKTSYSHNKGLFETREAISQYFKRKYNFLYSEEEIIVTNGASEALDTSLRSIIEPGDDILIPGPIYAGYIPLVETLGGNPVYIDTTQSDFKVTPELIESHLTHKTKAILLNYPTNPTGVILERSEVKNIVDTLVNKHIFIISDEIYAENTFKGQHTSFAEFPEIRDQLLLIGGLSKSHSATGIRIGFLLGPEYLIEKLTFMHAYNCICANVPAQIACTTALNEGINAPLYMNRDYIERRNYLKEKLESLGFELTAQPEGAFYIFPSIKRFTENDFEFCVDVLEKAHLAMVPGSSFTDIGKGYIRISYAYDMETLKKGMHRLENYLQQHYPEQMTTPTK

SEQ ID NO: 5855 - protein, 144 aa, Staphylococcus epidermidis
NNELNSFYRRVRCMVTLFTSPSCTSCRKAKAWLQEHDIPYTERNIFSEHLTIDEIKQILKMTEDGTDEIISTRSKTYQKLNVDIDSLPLQDLYSIIQDNPGLLRRPIILDDKRLQVGYNEDEIRRFLPRKVRTFQLQEAQRLVD

SEQ ID NO: 5856 - protein, 48 aa, Staphylococcus epidermidis
MRYSILKANLSQENYFLCNLSFIKKVIFNIKGHTTTLDIQFTEILKYI

SEQ ID NO: 5857 - protein, 888 aa, Staphylococcus epidermidis
DGCSFYFLGGRHMEMKPKYDPREVEKGRYEEWVSNGYFKPSEDKSKEAYTIVIPPPNVTGKLHLGHAWDTTLQDIITRMKRMQGYDTLYLPGMDHAGIATQAKVEAKLNEQGISRHDLGREKFLQQAWDWKEEYATFIRQQWAKLGLGLDYSRERFTLDDGLSKAVRKVFVDLYNKGIIYRGERIINWDPIARTALSDIEVIHEDVQGAFYHFKYPYGDGNGYIEIATTRPETMLGDTAIVVNPNDERYKDVIGKTVILPIVGRELPILADEYVDIEFGSGAMKVTPAHDPNDFEIGQRHQLENIIVMDEYGKMNDKADKYKGMDRFDCRNQLVKDLKEQDLVIKIEEHTHSVGHSERSGAIVEPYLSTQWFVKMKPLAQRALDNQNTKDRIDFFPGRFENTFNRWMEEIRDWTISRQLWWGHQIPAWYHKDTGEVFVGEEAPEDIENWIQDEDVLDTWFSSALWPFSTLGWPDTNADDFKRYYPTNALVTGYDIIFFWVARMIFQGLEFTDRRPFNDVLLHGLVRAEDGRKMSKSLGNGVDPMDVIDEYGADSLRYFLATGSSPGHDLRYSTEKVESVWNFINKIWNAARFSLMNIGEDFKVEDIDLSGNLSLADQWILTRLNETISTVTELSDKYEFGEVGRALYNFIWDEFCDWYIEMSKIPMNGEDESQKQTTRSVLSYVLDKIMKMLHPFMPFVTETIWQSLPHHGETIVKANWPTVDQALIFNESKQTMEQLVEIIKSVRQSRVEVNTPLSKAIPILIQTKDEKIKHTLMDNISYLHKFCNPSQLTIDTEIEIPEKAMTTVVVAGKVVLPLEGLIDMDKEIARLEKELDKLQSELDRVDKKLSNENFVNKAPEKIINEEKEKQQHYQEKYNGVKSRIEQLKA

SEQ ID NO: 5858 - protein, 442 aa, Staphylococcus epidermidis
ISQSWRYLYMTATWEKKEGNEGVLTVTVPAEKVNKALDQAFKKVVKQINVPGFRKGKVPRPIFEQRFGVEALYQDAVDILLPEAYGEAIEDTEINPVAQPEVNVTQIEKGKDFIFEATVTVEPEVKLGDYKGLEIEKQETDLSDEELQESIDHSLSHLAEMVVKEDGAVENGDTVNIDFSGSVDGEEFDGGQAEGYDLEIGSGSFIPGFEEQIEGMKTGDEKDVVVTFPEEYHAEELAGKEATFKTKVNEIKFKDVPELNDEIANELDSDAENVDEYKENLRKRLSEQKATEAENTEKEEAINKATENASIDIPEAMINTELDRMIQEFGQRIQQQGLDLQTYYQISGQNEEQLRDQMKDDAEQRVKTNLTLTAIADEENIEVSDEDIDKELEKMSEQFNISVEDIKSTLGNTDIVKNDVRIQKVIDLLRDNAKYVEATKED

SEQ ID NO: 5859 - protein, 57 aa, Staphylococcus epidermidis
FHCPAPKFHLTSTIINHNDAILSCQSIQLTLSIFNLTYRQLTNSILCIHLMNDTSLL

SEQ ID NO: 5860 - protein, 422 aa, Staphylococcus epidermidis
KRMFKFNEDEENLKCSFCGKDQDQVKKLVAGSGVYICNECIELCSEIVEEELAQNTSEGFTELPTPKEIMDHLNEYVIGQEKAKKSLAVAVYNHYKRIQQLGPNEDDVELQKSNIALIGPTGSGKTLLAQTLAKTLNVPFAIADATSLTEAGYVGDDVENILLRLIQAADFDIDKAEKGIIYVDEIDKIARKSENTSITRDVSGEGVQQALLKILEGTTASVPPQGGRKHPNQELIQIDTTNILFILGGAFDGIDEVIKRRLGEKVIGFASNEADKYDEEALLEQIRPEDLQSYGLIPEFIGRVPIVANLETLDVAALKNILTQPKNALVKQYTKMLELDNVELEFSEEALSAISEKAIERKTGARGLRSIIEEALIDIMYDVPSSENVSKVVITEQTINEEIEPELYDDEGNLINKNKTSA

SEQ ID NO: 5861 - protein, 40 aa, Staphylococcus epidermidis
LIRTRHLLKIFDLRLSHVNCDSVFLYVNIEKNVKVNYTIV

SEQ ID NO: 5862 - protein, 46 aa, Staphylococcus epidermidis
IKNALISTFKAMLCHQYSKFHLEIQQTRRVGVWGPNKKNFTEKFNR

SEQ ID NO: 5863 - protein, 48 aa, Staphylococcus epidermidis
FKMAEQSKEKQANEQAKAQNLFARWRKEETLYSEDEKKDKSSKKKDKE

SEQ ID NO: 5864 - protein, 192 aa, Staphylococcus epidermidis
DTNFSHIEVFWVLKFFRNNKLIVVLCAMIIFIALIGLSIRSQTQSPAEQYVGDSVSFGQRVISYPIQFVTGSIGDLFEKGSSKKDKNKIKQLEAKNEELESENKKYKKELDIKDLSKYEPISTSVIARNPDQWMNTILIDKGSKAGIKNNMAVMTTRRISWKSTKVNHFHPSRPYFHSYSSRKIFVNIHHRT

SEQ ID NO: 5865 - protein, 107 aa, Staphylococcus epidermidis
SNHYLPIPHNDPFQLLLDHILVSFPYVYLLKNKKNIHPIKNRTDVLFRGTTYIQEEIIHSFLQALKSLINAHTRLLPTCRLCFNRSYKIGLPSDLIIYIFTATICSL

SEQ ID NO: 5866 - protein, 73 aa, Staphylococcus epidermidis
YYIYNISDLRRFNIMSILTIILIVLLVILLFKVGLSILRFLISVGIVLLCIYLGYQGVLWLFEHFQNFSGFIR

SEQ ID NO: 5867 - protein, 58 aa, Staphylococcus epidermidis
VILQLKIVNSKKFGTLLKHIYKFFQLEKCILTTIKKCRYFGKKLNVDYNLSNLFKHST

SEQ ID NO: 5868 - protein, 44 aa, Staphylococcus epidermidis
NSSHIYFCLRLFIINVEECDICYYLPILVALYLVFFINFAIKIY

SEQ ID NO: 5869 - protein, 53 aa, Staphylococcus epidermidis
KVFKLIRINPIKLRKKTEKFITLIKFNINEIDIIIQVKEKKTSNIEPSGTCLV

SEQ ID NO: 5870 - protein, 126 aa, Staphylococcus epidermidis
RSSKEEFIMPRVKGGTVTRARRKKTIKLAKGYFGSKHTLYKVAKQQVMKSGQYAFRDRRQRKRDFRKLWITRINAAARQHDISYSRLMNGLKKAEIDINRKMLSEIAISDDKAFAELVSKAKEALK

SEQ ID NO: 5871 - protein, 47 aa, Staphylococcus epidermidis
VVPKISVWSSPILVSMDSTGLKTFVESFLIPKPASIITKSTGFISPK

SEQ ID NO: 5872 - protein, 309 aa, Staphylococcus epidermidis
RMRKLIVGSRRSKLALTQSQQFIDKLKFIDPSLDIEIKEIVTKGDKIVDKQLSKVGGKGLFVKEIQNELFNKEIDMAIHSLKDVPSMIPDGLTLGCIPDREIPFDAYIAKNHIPLQELSEGSIVGTSSLRRGAQILSKYPHLKIKWIRGNIDTRLKKLETEDYDAIILAAAGLKRMGWSDNIVTTYLDRDILLPAIGQGALGIECRSDDKELLDLLSKVHNHDVAQCVTAERTFLSEMDGSCQVPIGGYATIAQDNQIEFTGLIMSPDGKERYEHTALGTDPVKLGIEVSQVLKKQGAYDIIKKLNEAE

SEQ ID NO: 5873 - protein, 49 aa, Staphylococcus epidermidis
IHNKTMPTEIKKRNIDNPTLNKRMTSKTIKIIVKMLIMLNLLKSLILYM

SEQ ID NO: 5874 - protein, 173 aa, Staphylococcus epidermidis
IILNLICKRRAYMRYIFSVIKNIIAVLAIILIIYIALQHAPFLKNQEWNPLNDMNNHHQNITQKVSQKNNTLYSQPSNDKSYILKENDIINNVPAGQIKTVFNMIDKAEFMSVSGLERMGFNDEYLAGQQGDEFIIYKFGDDYIRVYNTEFEMNEDLNQLKQPINLKPIEAYQ

SEQ ID NO: 5875 - protein, 46 aa, Staphylococcus epidermidis
HLLKEDMNTTYRLKECGDILGINLLDHIIIGDNKFTSLVEAGYFDK

SEQ ID NO: 5876 - protein, 61 aa, Staphylococcus epidermidis
KVGNKMKFDRHRRLRSSKTMRDLVRETHVRKEDLIYPIFVVEQDDIKSEIKSLPGIYQISF

SEQ ID NO: 5877 - protein, 40 aa, Staphylococcus epidermidis
NDNELVISKKLKHPEHLYMTKISILIYFILLIQLNKALTL

SEQ ID NO: 5878 - protein, 274 aa, Staphylococcus epidermidis
FGDDMQETLLIRFHEIILMIYLFSIICYFVDFINKNYKTRTVGFYSLGIVWVLQTISLSIFFIHTKQVPLGSIFDVFFSLTWIIISISLILNLIKVMNFSVFFLNLIGFILMSLNTFQPEHYQTQIQQIAVINELLLVHIALAVLSYAFFAIAFVNSLLYIIQYRNLKEKNFDQNYFRIGSVATLETIVFYSTLVAWIILILSTILGAQWGIFAVGKQIFIDPKVIFSTIITLLYGVYIFIRIKKWISQRNLIYFNIILFCLCMINLFFLTHFR

SEQ ID NO: 5879 - protein, 87 aa, Staphylococcus epidermidis
SSALVELITMSVVSNKDGNAESESYETLCFSAKILALDNVRLTIVTFEIPEPKRFKSDNSPISPAPITTACLLFNFPNTFLANSTAA

SEQ ID NO: 5880 - protein, 208 aa, Staphylococcus epidermidis
YIILLIYIIMDIKISQCIGDEIMNECAFNTTDPIYIEYHDYYWGQPIYDSKELFKLMALESQHAGLSWLTILKKKESYEQAFYNFEPQFIAHMTEQDIDYLMKFPNIIHNRKKLEAIVSQAKGYLKIEKDYGSFSKFLWSYVNHQPINMGYKKPRDRKKVDQRATQLSKDLKAYGFKFLGPVTVFSFLEAAGLYDSHLEGCPFKPNHE

SEQ ID NO: 5881 - protein, 205 aa, Staphylococcus epidermidis
LYNSIRKRKSMNINFNNINLIISAVKKAQYPDTGLTEVALSGRSNVGKSTFINSMIGRKNMARTSQQPGKTQTLNFYNIDEQLIFVDVPGYGYAKVSKVQREKFGKMIEEYITQRENLKLVIQLVDLRHQPTEDDVLMYNYLKHFDIPTLVICTKEDKIAKGKVQKHIKRIKDKLELESGDNIISYSSIKNSKQQEIWNFIETYI

SEQ ID NO: 5882 - protein, 358 aa, Staphylococcus epidermidis
SGILKRNFINNLIILLIAIMLSLLLKMLHVILPFMFGPILAALLCVKVLKLKIRWPFWLSQIGLILLGVQIGSTFTQQVIKDISKNWLTIVFVTILLILLALIIAFFFKKIAQVNLETAILSVIPGALSQMLVMAEENKKANILVVSLTQTSRVIFVVILVPLISYFFQDNHHEMNHTTMEVPTLSQTLNIWQIIILFSMVGIIYIGMSKINFPTKQLLAPIIVLIIWNMTTHLTFSLDHWLLATAQLIYMIRIGLQIANLMSDLKGRIAIAIAFQNIMLIVTTFIMIIGIHLITNESINELFLGAAPGGMSQIVLVAMATGADVAMISSYHIFRIFFILFVIAPLIGYFINVKLNNK

SEQ ID NO: 5883 - protein, 427 aa, Staphylococcus epidermidis
RHRSMIMNYLDSLYWIHERSKFGIKPGVKRMEWMLEQLNNPQHKIRGIHVGGTNGKGSTVAYLRTALIENDYSVGTFTSPFIESFNERISLNGVPIMNDEIVQLVERVKPVSEALEIETDLGGATEFEIITTMMFLYFGEINPVDFVIIEAGLGIKNDSTNVFKPVLSILTSIGLDHTDILGTTYLDIAKDKAAIIKPHIPIVYAVKNDDALKYVRDYALEQNAKPIELDREITVVSQDDEFTYRYKDYELETIILNMLGEHQKENAALAITALIELNERQIIELDFNKMIDGIESVNWTGRIEQVKEQPLMVIDGAHNNRSIDALVDTIRHYYGRDKIDILFSAIKGKPIHSMINKLNDIASKFYIADFEFPKALAKEEIAEELKLDNLHLIDDYVDFIENYEGDGLIITGSLYFISEVKAKINFN

SEQ ID NO: 5884 - protein, 229 aa, Staphylococcus epidermidis
NKFMKPVIVMTQTNEVHSHLVDIIHKPFIQLKQLHFNEKLLDHSYDWLIFSSKNAVKYFYPYLKNVKVKKVAVIGDKTAQYCNELGISVDFVPRDFSQEGFLDEFKISEQHLLLPSSEKARSKLVQQLSKYNEVVKIDLYRPVPNFKNISQVKSLVRKHQIDAVTFSSSSAVEFYFKEDNVPEFDHYFAIGKQTARTILKFNTSVKVANKQTLDSLIDKIIESREQNEI

SEQ ID NO: 5885 - protein, 431 aa, Staphylococcus epidermidis
GGHMMSFEKSIKAMEQAEKLMPGGVNSPVRAFKSVDTPAIFMDHGEGSKIYDIDGNEYIDYVLSWGPLILGHKNQQVISKLHEAVDKGTSFGASTLQENKLAELVIDRVPSIEKVRMVSSGTEATLDTLRLARGYTGRNKIIKFEGCYHGHSDSLLIKAGSGVATLGLPDSPGVPEGIAKNTITVPYNDLDSLKLAFEKYGDDIAGVIVEPVAGNMGVVPPVNGFLQGLRDITNEYGALLIFDEVMTGFRVGYNCAQGYFGVTPDLTCLGKVIGGGLPVGAFGGKKEIMDYIAPVGTIYQAGTLSGNPLAMTSGYETLSQLTPESYEYFNSLGDILEKGLKEVFAKHNVPITVNRAGSMIGYFLNEGPVTNFEEANKSDLKLFSNMYREMAKEGVFLPPSQFEGTFLSTAHTKDDIEKTIQAFDNALSRIV

SEQ ID NO: 5886 - protein, 98 aa, Staphylococcus epidermidis
ADVLFLLIRFPSSSYNSGSISSLIVCSVMTTLLTFSEEGTSYMMSINASSIIERNPRAPVLRSIAFSLIADRASSENSNSTLSNSSILVYCLTSAFLG

SEQ ID NO: 5887 - protein, 207 aa, Staphylococcus epidermidis
KEIIMSKFDEQIIVVNRDILFNKDKNAFNGFLHKNNFKGKEIFSALSKYEVKRRGDMEDDPSFKQLISYCLLENEKGEILIYERLSGGGEERLHGQSSIGVGGHMNDVVGADSINEVLRVNAQRELEEEVGLSNNKSQNMEYLGFINDDDNDVGKVHMGVVFKITVHSNDVEAKETDTLKIKWIEQGDIQSYEDFETWSALILQDIS

SEQ ID NO: 5888 - protein, 46 aa, Staphylococcus epidermidis
LYEIDSILLFVTIELTLIKLINKIDRVNELWKTSLNLDITRLQINF

SEQ ID NO: 5889 - protein, 222 aa, Staphylococcus epidermidis
IFTFNTIYILIIRSNFISLSPTFISFKGRILLRINEMALHEKPRERLITYGAKSLSNVELLAILLNTGRKGFSSIDIANELLKQQSTIRDLKKLSINDLLKIKGIGLYKAVILQAAFELGERINSTSTFDKVQITHPSDVASLMMSTMKDLEQEHFVVLLLNSKNIVTKQAWVYKGTLNSSIIHPREVFNIAIRESSNSIIVVHNHPSGDVTPSERGYEYNV

SEQ ID NO: 5890 - protein, 319 aa, Staphylococcus epidermidis
FFKIYHDWSAKLMADIIPFPQFKSKMIKQINDAERNADFEKMYQLFNVYEQHFDPNEEIALKKCQMLLQLNAYLELREEAIILLKRGFNCYDELMIYYIKSLNGLGQFNEAVEVINQIIDEVKNHKTRMELFPLKEYAISRLDEDRKALSSSLSDFGSLNTREQTSLILQLIDNGHYNFKESVANILISMDLPKNLVSLMLEYLRFAEYSHTITIHKYGETINVNPNHLSGIEHTTIKDKVIPVVMNRLEDGALHILKEAQHIMNNHSILMYPIDIESLYTIDNWIDAYDVYFKQLIGIDINGCNNDTLQFIKSLDNEM

SEQ ID NO: 5891 - protein, 448 aa, Staphylococcus epidermidis
MHFVAISINHRTADVTLREQVAFRDDALRLAHEDLYETKAILENVILSTCNRTEVYAIVDQVHTGRYYIQRFLARSFGFEVDDIKDMSEVKVGDDAVEHLLRVTSGLDSIVLGETQILGQMRDAFFLAQNTGTTGTIFNHLFKQAITFAKKAHSETDIADNAVSVSYAAVELAKKVFGKLKSKHAVVIGAGEMGELSLLNLLGSGISNVTIVNRTLSKAKILAEKHNVSYDSLSALPSLLETTDIVISSTSAEDYIITNSMVKTISETRKLDSLVLIDIAVPRDIEPGIDAITNIFNYDVDDLKDLVDANLRERQLAAETIAGQIPEEIDSHNEWVNMLGVVPVIRALREKAMNIQAETMESIDRKLPDLSERERKVISKHTKSIINQMLKDPIKQAKELSTDKKSNEKLELFQNIFDIEAEDPREKAKLEKESRAKEILAHRIFSFE

SEQ ID NO: 5892 - protein, 72 aa, Staphylococcus epidermidis
TDEVTTNDKNINGIKGKYLISLKEKIFKIMAKIPPMINVNTTIKKKKFNGNISPNILKSNMSPYPINLDANR

SEQ ID NO: 5893 - protein, 78 aa, Staphylococcus epidermidis
RILVKRPIGNESCLGMKTHRGAAKRVKRTGSGQLKRSRAFTSHLFANKNTKQKRQLRKAKLVSKSDMKRVKQLLAYKK

SEQ ID NO: 5894 - protein, 54 aa, Staphylococcus epidermidis
KSRVKTWAYMNRLTPWVCAKRDVRPIPKKRGINKARLLITSKGILSFLFGTHLG

SEQ ID NO: 5895 - protein, 237 aa, Staphylococcus epidermidis
YMLLLAYTCSIIFSFLYQFCNQNILKLQYLYSRSHCDFCHTIIKPLDLLPIISFLKLRGQSRCCNQPLQRLYLIGELVSFGAIFLYYPTHFNIHFTLFLITFLFLLTMCLYDIHSMHIDMRLLFVYTVVSVFTTQTYFGNFIMIFLISHVIYLFASKFIGYGDILLFNILGLIFPLNFFFFIVVFTFIIGGIFAIILKIFSFKDIKYLPLIPFIFLSFVVTSSVYHQLLFLLRGEFY

SEQ ID NO: 5896 - protein, 98 aa, Staphylococcus epidermidis
VKIFLSAATSKVSRLATIGTRPINSGIKPYDWRSSGRICSSKASSSYLSASLLANPITFSPKRLLMTSSIPSKAPPKINKMFVVSIWINSWFGCFRPP

SEQ ID NO: 5897 - protein, 286 aa, Staphylococcus epidermidis
KVKLNHYQAYTKLVFKKKILLHEEIKEAYDLGIRAIMFFGVPNDKDDIGSGAYDHNGVVQEATRISKNLYKDLLIVADTCLCEYTDHGHCGVIDDHTHDVDNDKSLPLLVKTAISQVEAGADIIAPSNMMDGFVAEIREGLDQAGYQNIPIMSYGIKYASSFFGPFRDAADSAPSFGDRKTYQMDPANRLEALRELESDLKEGCDMMIVKPSLSYLDIIRDVKNNTNVPVVANNVSGEYSMTKAAALNGWIDEEKIVMEQMISMKRAGADLIITYFAKDICRYLDK

SEQ ID NO: 5898 - protein, 51 aa, Staphylococcus epidermidis
FYTSPKGPPAAISIKIAKYDNSFLQVENYFNFLYSVKDMNLSSSFFVGFLS

SEQ ID NO: 5899 - protein, 167 aa, Staphylococcus epidermidis
EAFLMDWILPIAGIIAAIAFLILCIGIVVVLISVKKNLDYVAKTLDGVEGQVQGITRETTDLLHKVNRLTEDIQGKVDRLNSVVDAVKGIGDSVQNLNGSVDRVTNSITHNISQNEDKISQVVQWSNVAMEIADKWQNRYNRRGSANYKTNTVADDANHSYNSRVNK

SEQ ID NO: 5900 - protein, 78 aa, Staphylococcus epidermidis
ANLSLLIEYNILVEAYIPELPADNTLVNITAFINEAAKANPAFLNTNVKGEVAILSPPPINALLSYGINIPIMKIARM

SEQ ID NO: 5901 - protein, 40 aa, Staphylococcus epidermidis
FCLSKLTENGFTVELGTFPLTNETSVELSTYSKFSGSVTL

SEQ ID NO: 5902 - protein, 366 aa, Staphylococcus epidermidis
GVRFYMTIDNSKTLERIKILTELHGAPGFEDEVRSYMKSEMEPYVDKFIQNKMGGFYGIKKSNKENAPRVMIAAHMDEIGFMITHINDNGMIQFTNLGGVANDIWQGQRLKIKNRYGKEIIGVVANIPKHFRTGNESIPQIKDLMLDIGASSSEEVRNRGVEVGDTIVPHTIMTQLSKNRYSAKAWDNRYGCVLAIEILELLKDVQLDVDLYVGANVQEEVGLRGAKAAAKQIDPDIAFVVDCSPANDIKGKQQLSGVLGEGTLIRIKDGTMILKPLFRDYLLKLAEENQIAYQYYISPGGTDGGEIHKENEGIPTAVIGVCARYIHSTDAVFDIRDYFSARHLLKESIIHLTSGQIQQLQYGKEF

SEQ ID NO: 5903 - protein, 45 aa, Staphylococcus epidermidis
IQISSWLNIRKVTAQRAENHQKNYKKDNSYIISIEIVFIYLSWTF

SEQ ID NO: 5904 - protein, 54 aa, Staphylococcus epidermidis
IQTSSWLNIRKVTAQRAENNQKNYRKRQFLYYFNRNCLFLLILNLFVPASLFFN

SEQ ID NO: 5905 - protein, 47 aa, Staphylococcus epidermidis
SFTFLSFFFLREDMIAKPDIKVTPANGSDLSAFPASGRDLIVLFSEL

SEQ ID NO: 5906 - protein, 51 aa, Staphylococcus epidermidis
ISMSQFKKSGLDKSSATVIAETSKHRSSLKNTPSTSNNIAFMPYPFHFRKF

SEQ ID NO: 5907 - protein, 46 aa, Staphylococcus epidermidis
FFTFFLLWFAIKKSIKNKTATSIATIKPITVGEEKSIKTTLLYQFQ

SEQ ID NO: 5908 - protein, 208 aa, Staphylococcus epidermidis
KSTFKIWYTISNFRRYLMHFNKYQILTTDKYTKFEHLYKKVKHICVVIFLVVFLIGFIILLSLVLYFQQLTKDASSISDRELKAKILHIPGDELINHNNQILEEYDHSQNTLIVGPNHVNSNIIHALTASEDTLFYKHNGIMPKALLRAMLQDITNSNQSSGGSTITQQLVKNQVLSNKKLIVVKQMKLSWLHGSKIYYQKMKSYIRI

SEQ ID NO: 5909 - protein, 48 aa, Staphylococcus epidermidis
LLYPLIFYIFQIAFSKEFLSAFFYLWQLFIRQDACDITYGHRHLFVYS

SEQ ID NO: 5910 - protein, 212 aa, Staphylococcus epidermidis
MSMFTGIIEEIGTVQQVRSEQSVRTLEIKAQNILVDMHIGDSISVNGACLTVIDFTDSSFSVQVIKGTENKTYLGSVQRNTEVNLERAMSGSGRFGGHFVLGHVDELGTISKINETANSKIISIKTTKNILNQMVKQGSITVDGVSLTVFDLHDYTFDIHLIPETRRSTILSSKKVGDKVHLESDVLFKYVENIMNQNQSQLTEEKLRAFGF

SEQ ID NO: 5911 - protein, 567 aa, Staphylococcus epidermidis
SLMLKFHLRLLLLISTITIISFIGLGAIIHNTIYQTLTSNQIKSLDSEARNYVNLFNNNKEKEITNIAHNEKNIILIKEKDKDKIIYSSGNIKDIDHRIDNEANPSKLINKNTKLGMRYTYKNTIDDKTIYISGINNEIIDLQKDLWKYLSIVGVIVLFTVYLASRSINRTYIRPINEVTYATSLLADGYYHVRVPESNVKETRALFVTTNDLARRLQKLNNSQKIQSNRLKTTLENIPSSVLMIDKHGEIVVANHAYYQVFNPDQMVENKSYIGFIDDSIEKLIIESFRTEKVIYEQLEVAINNVHTKYFDVSCIPILTKSKKNLQGMVVVLHDITNLQKLENLRREFVANVSHELKTPITSIKGFAETLIEGAKNDEQSLDMFLNIILKESNRIESLVTDLLDLSHIEQQKELEINYMNLSELAINIIDNLQTQAYNKRIKIQSEIEKDVIIEAHENKIAQVITNLLSNAINYSSEDNKVIVRVYRNDNKVYLEIQDYGIGISETDQKRIFERFYRVDKARSRDSGGTGLGLSITKHIVEAHNGRIDVKSAPGKGSIFKVLFNDN

SEQ ID NO: 5912 - protein, 102 aa, Staphylococcus epidermidis
STALDLEKMIPTTKITVNRANIIPKIRFAVKKEKIESAADRIVKTINPILKNFCLLFFCVCSSSKVSFNFSYKFSFSCNSKTCCVYSFFFSKVSSGTSSFST

SEQ ID NO: 5913 - protein, 246 aa, Staphylococcus epidermidis
PFTFRRRNDMTKLNVKVFADGADIEEMKSAYKNQLVDGFTTNPSLMAKAGVTDYKAFAEEVVSEIPDASISFEVFADDLPTMEKEAEILKQYGDNVFVKIPIVTTTGESTLPLIKRLSSKQVRLNVTAVYTIEQVKAITDAVTEGVPTYVSVFAGRIADTGVDPLPLMKESVKVTHSKEGVQLLWASCREVYNVIQADEIGADIITCPADVVKKVNNNLGRDIGELSVDTVKGFAKDIQSSGLSIL

SEQ ID NO: 5914 - protein, 58 aa, Staphylococcus epidermidis
VSLPYIYSVNLTYYILLIKVSLYYYNSSNISSTAFLPCCMQSGKPTASNGAPVTRNLG

SEQ ID NO: 5915 - protein, 82 aa, Staphylococcus epidermidis
NNTPIAIKITTNIANMINNTIYFSSYFIILHYNVILCVVKSQNQLIDRLFLKDYTKLKIVVTRYDDDKEYSNKLQTDIKTTC

SEQ ID NO: 5916 - protein, 46 aa, Staphylococcus epidermidis
IKKPVNEFLKTHLLTFLLGIMSQPHFTIDLLTVKFKRVRSNSFILI

SEQ ID NO: 5917 - protein, 59 aa, Staphylococcus epidermidis
SRQLESGWEKEVELSTYTNSCSYDKRIVYLCAILSMLIGLFKDIDISLCLQYRYKVFLR

SEQ ID NO: 5918 - protein, 420 aa, Staphylococcus epidermidis
MIFTSMSHKVVVLMNNEALTLFRKRQQAIRKEKNYYNKFIFNGHFTVFLLILLGAFIFGYGEWLSHIPPQIDYALFASIALAVVSLFPIRTLLKEADQIFLLPFERHMKNYINASLFYSYISRISLPFILLIVFFPLFYKLSHNHYGFYIAFSISTLLYPYLVLLIKWQWVKLNKNVFIINILLFIPLAVTHYMILRFHNYLAFLIMIILFVIYLVLKTKADHYLLPWEKVIAIEQQHHTNYYKFVNMFTDVKHLRESAVRRSYLDFLLPVPKGAKFNENRMYLYLFIRSFVRGRDAFSIILRLVIIAIILMVWLSQPVVSLIIGSLFMYIILLQMSQFYTQQAYGLWPQVWPVSDTKVIAGYQQFLNRLMIIIAITFTIVYVIKHHDLFFFAVLFFIVGWLTIRNAVKKLKYQETLLRD

SEQ ID NO: 5919 - protein, 168 aa, Staphylococcus epidermidis
EVVTMTQITFKNNPIKLSGSEVNEGDIAPNFTVLDNSLNQITLDDYKNKKKLISVIPSIDTGVCDSQTRKFNEEASAEDGVVLTISVDLPFAQKRWCASSGLDNVITLSDHKDLSFGRNYGLVMDELRLLARSVFVLNENNKVVYKEIVSEGTNYPDFEAALKAYRNI

SEQ ID NO: 5920 - protein, 382 aa, Staphylococcus epidermidis
GHVTIRLEVDNMKIGIPKEIKNNENRVGLSPSGVHALVDQGHEVLVETNAGLGSYFEDGDYQEAGAKIVDEQSKAWDVDMVIKVKEPLESEYKFFKEELILFTYLHLANEQKLTQALVDNKVISIAYETVQLPDGSLPLLTPMSEVAGRMSTQVGAEFLQRFNGGMGILLGGIPGVPKGKVTIIGGGQAGTNAAKIALGLGAEVTILDVNPKRLEELEDLFDGRVRTIMSNPLNIEMYVKESDLVIGAVLIPGAKAPNLVTEDMIKEMKDGSVIVDIAIDQGGIFETTDKITTHDNPTYTKHGVVHYAVANMPGAVPRTSTIGLNNATLPYAQLLANKGYREAFKVNHPLSLGLNTFNGHVTNKNVADTFNFEYTSIEDALK

SEQ ID NO: 5921 - protein, 507 aa, Staphylococcus epidermidis
NVTTNNKYIRMIYMRVAIIGMGTAGVSVLRQLVKHENFSQLKVDVYDDDRNMGQGVPFQNDSSELLINMPSKSMSLNLDDDQEFWKWYQNQTEFNFSNPQYLPRFVFGHYMKSYLSYYNDQFDNLTIINDKVQEIFTQSDVDDTDLKYHVCTCDDEKEWREYDYLFLTFGTFSYHDPYDLKGTKGYIQTPYPTYHTLDNVKDSDRIVIIGTGLASLDAVRYVAAHHPSLPITMTSRSAALPSVRGKMTKIQFTHLTKSRFNGIMKNHFGNVPLEKVVSLFLKECEDYGIDFKKLIYRRTGNHVKDLEYDLNHEEEMGIFQSIIEHLKENLNWIWNSLSVKDQETFNRKYTKIIQLNSNPMPPRTARLLIKLIQNNELVIKKGLEDIVHKNNQFMLKYNDTTQNYELFDIVINATGSKTHLSQLDEDDQLILNLENRQIVQRHPMGGIQIIPETNQVISPRYGTLKNVIAIGQMTNGVNKLRNGVKMIVNQVVDTVSQLYITQENRNK

SEQ ID NO: 5922 - protein, 61 aa, Staphylococcus epidermidis
KRHTKASVQKLNNCFSQAFKDALNEEIIERDQTWNDPIYERKPTKKEEDKFMSLTEYRKLK

SEQ ID NO: 5923 - protein, 61 aa, Staphylococcus epidermidis
INSTIHLRSTMTKSANKIISIAIKDMKHIQNVLNRLLQISAKIKNIPFSKMVKILISTSTK

SEQ ID NO: 5924 - protein, 220 aa, Staphylococcus epidermidis
ACNTLFCFFITTKKKKEESHMARFRGSNWKKSRRLGISLSGTGKELEKRPYAPGQHGPNQRKKLSEYGLQLREKQKLRYLYGMTERQFRNTFDIAGKQYGVHGENFMILLASRLDAVVYSLGLARTRRQARQLVNHGHIEVDGGRVDIPSYSLKPGQVITVREKSQNLDIIKESVEINNFVPEYLDFDADNLKGTFVRFPERSELPAEINEQLIVEYYSR

SEQ ID NO: 5925 - protein, 45 aa, Staphylococcus epidermidis
IKLTRYLMHKDYNMTQLTLPKETSVHIPTHDMSQYVNDIVKNSRY

SEQ ID NO: 5926 - protein, 58 aa, Staphylococcus epidermidis
TKLTRCLMYKDYNMTQHTLLMETSVLIPANDISRHVNDIAETIPDTEFDEFRHHRGLI

SEQ ID NO: 5927 - protein, 58 aa, Staphylococcus epidermidis
TKLTRCLMYKDYNMTQHTLLMETSALIPANDISRHVNDIAETIPDTEFDEFRHYRCLI

SEQ ID NO: 5928 - protein, 55 aa, Staphylococcus epidermidis
TKLTRCLMYKDYNMTQHTLLMETSVLIPTNDISRHVNDIAETIPDTEFRYHRGLI

SEQ ID NO: 5929 - protein, 207 aa, Staphylococcus epidermidis
MFETITTAAILYIATAVDLLVILLIFFARANNYQQYKDIYIGQYLGSLTLIFVSLFFAYVLNYVPDKWILGLLGLIPIYLGIKVAIFDDCEGERRAKDELNKKGLSELSKSVAVVTLASCGADNIGLFVPYFTTINNYELVITLITFVILIFILVFTAQKLANIPGLGEVIERFSRWIMSIVYIGLGLFIIIENGTVQKLFHFVFLV

SEQ ID NO: 5930 - protein, 51 aa, Staphylococcus epidermidis
ICETLSINTIYLPFSLELFYPDTRNCNNTHFLKHILHLNIFSIKIKEYIRF

SEQ ID NO: 5931 - protein, 76 aa, Staphylococcus epidermidis
KGGTFMDYAHLNLEHFFARNDDLDIIRDRSDFVMINNFTNEMKYREGEIEGTIDLNQYYYKNRSQAVSFIMMNYKN

SEQ ID NO: 5932 - protein, 160 aa, Staphylococcus epidermidis
RGMTMTKNIPTNYKLISKQLASLIEDEKNLIAILSNTSALLNDTIDQINWVGFYLIENNELILGPFQGHPACVHIAIGKGVCGTAVSSGETQRVKDVHQFPGHIACDANSQSEIVIPLHQNGKIIGVLDIDAPIKNRFSQDDQEGLESIVKTLEKQLNQI

SEQ ID NO: 5933 - protein, 365 aa, Staphylococcus epidermidis
VEMTNKLEQYREEIVSLNDQVLELLSKRGELAQKIGEEKIKQGTRVYDPQREKEMINQLLDKNKGPFNDNVIKQLFKEIFKASTDLQKSENEKHLYVSRKLKPEDTIVKFDNGGIIGDGNKSFVFGPCSVESQEQVDAVAQDLQAKGEKFIRGGAFKPRTSPYDFQGLGVEGLKILKNVKDKYNLNVVSEIVNPNDFEIASDYLDVFQIGARNMQNFELLKEAGRTDKPILLKRGLSATIEEFIYAAEYIASQGNRNIILCERGIRTYEKATRNTLDISAVPILKQGTHLPVMVDVTHSTGRKDIMLPTAKAALAVGADGVMAEVHPDPSVALSDAGQQMDLNEFNQFYHELKPLADMYNSKKLK

SEQ ID NO: 5934 - protein, 68 aa, Staphylococcus epidermidis
VMLANTITEIATVMIVLAIDGHLLNFHMRNKPSGKMNKSDKTINHSCLYHDVVSCCIKRPPVYLFDEK

SEQ ID NO: 5935 - protein, 415 aa, Staphylococcus epidermidis
LSYLKRIFVIYLKEKMMTYNKRLFTSESVTEGHPDKIADQVSDAILDEILKDDPNARVACETTVTTGMALISGEISTTTYVDIPKVVRETIKDIGYTRAKYGYDSQTMAVLTAIDEQSPDIAQGVDKALEYRNDISEEEIEATGAGDQGLMFGYATDETDTYMPLPIFLSHQLAKRLADVRKDEILDYLRPDGKVQVTVEYGEDDKPRRIDTIVVSTQHAEDVELAQIEKDIKTHVIYPTVDKALLDDETKFYINPTGRFVIGGPQGDAGLTGRKIIVDTYGGYARHGGGCFSGKDPTKVDRSAAYAARYVAKNIVAAGLAKQCEVQLAYAIGVAEPVSISINTFDTGKVSEARLVEAVRKHFDLRPAGIIKMLDLKQPIYRQTAAYGHFGRTDVLLPWEKLDKVNVLKDAVEIQ

SEQ ID NO: 5936 - protein, 173 aa, Staphylococcus epidermidis
RSAARNEKRFANEERTKMTNHIVLYQPEIPANTGNIARTCAGTLTHLHLIKPLGFSTEDKMLKRAGLDYWEHVNITYHDSIEEFFANTEGHYYLLTKFGKQTYSDFNFSNTNEDYYFIFGKETTGLPEWVKEKYAKTALRIPMSDNIRSLNLSNTAALLIYEALRQQDYPNLS

SEQ ID NO: 5937 - protein, 195 aa, Staphylococcus epidermidis
NEQAEYTIMKLERILPFSKSLIDSHINHNSIVIDATCGNGNDTAYFAQHVPNGFVYGFDIQEQAILNTHKKTKDYSNVKLIQSGHENAKLHIPAQHHGCIDAAIFNLGYLPKGNKEIVTKPETTIMAINEIFDILSIEGIIILVIYHGHEEGKVEKEALLEFLQNFDQNKAHILQYQFINQKNNAPFICAIDKRN

SEQ ID NO: 5938 - protein, 168 aa, Staphylococcus epidermidis
AMYLYTSYGTYQFLNQIKLNHQERNLFQFSTNDSSIILEESEGKSILKHPSAYQVIDSTGEFSEHHFYSAIFVPTSEDHRQQLEKKLLHVDVPLSNFGGFKSYRLLKPTEGSTYKIYFGFANRTAYEDFKASDIFNENFSKDALSQYFGASGQHSSYFERYLYPIEDH

SEQ ID NO: 5939 - protein, 55 aa, Staphylococcus epidermidis
VSMALLLKVARDYTERQIGLNSTKLLKKMDIGGTTLNIKHQVQVINISIEPLVKL

SEQ ID NO: 5940 - protein, 375 aa, Staphylococcus epidermidis
GMKAILFDVDGVFLSEERCFDVSAITVAELLSSPDFLNCDIDIHFDGNLTENDINKIRRNVFNNDRILNQLKSLGLNSNWDMLFIVFSIHLIDKAKQLKPSLRDQLLDELLFTKETLKEIAKDLTDKTINYSLPYDVIASFRNGKDAIYEDLEVYAKNQLELNNTSLFKLKSALWTLAKDIYQEWYLGKALFNQVEYKKDIQDFKKGFIYDEVILKPIEEIQLLLQNLIEAGYQIAIATGRPRTETIIPFQSLGLKSYFKDEHIVTASEVLLAEKQFPQYQPLGKPNPFSYIATLNGNYNDQYERYATKQEDIVNKDEVYIVGDSLADLLSAKKIGATFIGTLTGLKGKAAHSELVANGADHVVEDITKIRKILL

SEQ ID NO: 5941 - protein, 47 aa, Staphylococcus epidermidis
KCNFYYNIKKRAKSLTIRLIAIQNYSTTEPIFLNFSKRSFANSSGVS

SEQ ID NO: 5942 - protein, 3696 aa, Staphylococcus epidermidis
EANLMNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQSIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKTNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 5943 - protein, 66 aa, Staphylococcus epidermidis
LIIYIKSTFMFKIIMKVVFLQKAPNDFKYKFIWGEVIVIGFYYYYIISILPQSSIISMICPDTASA

SEQ ID NO: 5944 - protein, 58 aa, Staphylococcus epidermidis
KKFLNDTIRMMWFSQILNPSYKMINRYRVNPKVDVLLESLFIQFHSQCLNQNLINDKA

SEQ ID NO: 5945 - protein, 282 aa, Staphylococcus epidermidis
RRDYMETVQFYNGRTMPKIGLGTYRVKDGDECRESVKYAIERGYRSIDTAMIYGNEETVGQGIKEGLESTGLSREDLFITSKLWLTDFGRQNVEDAYRQSVAKLGLDYLDLYLMHWPGTNEAVMIDTWRGMEDLYKQNQVKNIGVSNFTPEHFEALLAQVSIKPVINQVEFHPYLTQNKLRKYLEAQNIIMESWSPLMNSQILHDEVINEVANEVGKTPAQVVIRWNIQHDVVVIPKSVTPHRIEENLDVWNFELSDNQMERIDQLNQDKRIGPNPLEFDGK

SEQ ID NO: 5946 - protein, 443 aa, Staphylococcus epidermidis
KDCYKEIRGNGMTKNEQIIKHIESLSIGSKISVRKIAKDLNVSEGTAYRAIKDASQLGIVATIDRVGTVRIEKRSRENLDNLTFNEIANIVEGQILAGRAGLNKSVSKFAIGAMQFDDILKYIGKHTLLIVGNRENVQIEALKRETSILITGGFRPSAEIIRYADEHELPIISSSYDTFLVANIINKAMFNQKIRKEILVVEDIVKPINELSVLFDSMTIHDYKKIANETGHTRFPIVNEEFKLVGIVTSREIINMNEEDLLGKVMTKNPLSVKLTNTVASCAHLLIWEGIELLPVTDNNKKAVGVINRQDVLKSMQLLGRQPQIGETVNDQIAKHISIHQQGINVDVSPLITNHYGTLSKAVFVGIIEETIRHEMRKYKKGNVMIESMSIIYIKTVPIESTIEVHYEMLDVGRYFAKLEVTMINNGEKVANALVICQMFDGF

SEQ ID NO: 5947 - protein, 72 aa, Staphylococcus epidermidis
LSILTIRNVSSSLSNLNSTSKCFKRAFNLSLIWKTFIINTPYFRTFLQFTINNVELTEKTQIITLICYYKLM

SEQ ID NO: 5948 - protein, 386 aa, Staphylococcus epidermidis
NIFYLKGVYMMHTILLVVFMIILGAIIGGVTNMIAIKMLFHPFKPYYIFRFRIPFTPGLIPKRREEIARKIGQVIEEHLITEELIRQKLNQPQSRNMIQQLIHKQISKLKNDDVTIKKIAGFLGIDVNELVDYKLTTKFLNKLNFWYESNKYRKLSEILPQSFLDQCKGQIEYITDFLCERARNYLSSEKGERDIYEMLDTFFNEKGRIIGLLQMFMTKESIADRIQHELIRLTQHPQSQKIITKVLNDEYETFKDKNLDEIIKEQQFKNYSQLVLNELKTYLNLKDKTERPIKQVVPQFIQFLEDDTSKRMTDFIIKGTSKHLTNIMKKINLRQLVEEQINTFDLKYIENLIIDIANKELKLIMTLGFILGGIIGFFQGVIAIFV

SEQ ID NO: 5949 - protein, 248 aa, Staphylococcus epidermidis
GGILMRKLFLSILSIIIISSFCVATGFQNVNAANNEVSKPQSNVDSKTKQNIIKKIKKSNAYKKHANSTSIDSIKDDDIIVHLDKGKNTNVYSINYVFGKKLAKMNDNLAMIELKYNEANNEVFYNHMMYSKFVKYNNKEYINMKGILNGKPYYEFNIDQKGHYYDKNFKHTSKDEIEKDSAKNLPPKERGWCEWAVGALCGTGGAAGCWATATALGITTGWGGFSLATICGLISSLGCTGATNYICK

SEQ ID NO: 5950 - protein, 49 aa, Staphylococcus epidermidis
SIVYDWSRMLFIYLTRVVPRQTRPLLGTSFFMLSKVNLFNKPTIRCFIK

SEQ ID NO: 5951 - protein, 52 aa, Staphylococcus epidermidis
INPLHFKSSIKALAIDKILLNYFINLKKLKIFNKYSDISDLFKHIKKRPYKM

SEQ ID NO: 5952 - protein, 417 aa, Staphylococcus epidermidis
TILYIFSINFADILRRIKLMVKFIHCADLHLDSPFKSKSYLSPNIFEDVQKSAYESFKNIVDLALKQEVDFIIIAGDLFDSENRTLRAEVFLNEQFERLRKEQIFVYICHGNHDPLTSKITSQWPNNVSVFSNQVETYQAITKSGETIYIHGFSYQNDASYENKIDAYPSSQGQKGIHIGVLHGTYSKSSVKDRYTEFRLEDLNQRLYHYWALGHIHQREQLSDMPVINYPGNIQGRHFNELGEKGCLLVEGDHLKLTTQFYPTQFIKFEEATIETDHTSKQGLYDVIQSFKDKVRTEGKSFYRLNVRINSEDIIAPQDLIQLKEMITEFEENENQFVFIEDLNLQYVQNDEMPIVKEFSPELLDDASLFDSAMTDLYLNPRASKFLDDYNEFDKVELVNHAERLLKDEMRGEQNDN

SEQ ID NO: 5953 - protein, 101 aa, Staphylococcus epidermidis
KVAYKTMQLKYNEINKNQLISSETPFLENFQDCIKINKKNKISQSTLNCYYNALNIFDEKFGNTAIKNFSQLKYSEMLKEYAEGHIIGGHKKDIRKQVFKN

SEQ ID NO: 5954 - protein, 568 aa, Staphylococcus epidermidis
EEKYMVLFIILAILVVILIAIGVLFYMRSNKRNLIEKTEERKNEIEQLPLDDNLRKLTGLNLKGETKTKYDAMKKDNTETTNKYLAPVEEKIQNAEELLEKFKFTAAQTEIDDAHELMDQYEENYQHQVTQVDDIINLHKENEALYEKCKVDYREMKRDVLANRHQFGEAAEPLENEIENYEPKLNEYENLKSEGNYVQAHNHIAALEDQIKNLKSYMDEIPELIRETQKELPGQFQDLKYGCRDLKVEGYDLDHVKVDGTIQSLKTELSFVEPMISRLELDEANNKLENINDKLDEMYDLIEYEVKAKNEVEETKDIITDDLFKAKDMNYTLQTEIEYVRENYYINESDAQSVRQFENEIQSLISVYDDILKETSKSAVRYSEVQDNLQYLEDHVSVINKEQDKLQNHLIQLREDEAEAEDNLLRVQSKKEEVYRRLLASNLTSVPERFIIMKNEIDNEVREVNEQFRERPIHVKQLKDKVAKIVIQMNTFEDEANDVLVNAVYAEKLIQYGNRYRKDHHHVDKSLNEAERLFKNNRYKRAIEIAEEALESVEPGITKHIEEQVIKE

SEQ ID NO: 5955 - protein, 41 aa, Staphylococcus epidermidis
PTWYWGILLGNRFTIVKSGFPEMVIIWLKSFLTIDTISSSV

SEQ ID NO: 5956 - protein, 370 aa, Staphylococcus epidermidis
KLYLISIELIYHHMMEVHYMTKIKEIKKVLQKEDADAAWITTPLNIFYFTGYRSEPHERLFALLIPSNEEPVLFCPKMEVEEVKQSPFKGKIIGYLDTENPFDKYSKTFSKMLIESEHLTVKRQRELTKAFNIEHYQDVDQSIKDLRNIKSEDEIINIKKAAALADKCIEIGKSFLKEGVEEREVVNHIENEIKKYGVNEMSFDTMVLFGDHAASPHGTPGDRKLQQNEFVLFDLGVVYHHYCSDMTRTIHFGTPNKEAQNIYNIVLKAETEAIKSIKPGVTIKDIDKIARDIIEEAGYGDYFPHRLGHGLGLEEHEYQDISSVNNNQLEAGMVITIEPGIYVPHVAGIRIEDDILVTENGYEILTQYEK

SEQ ID NO: 5957 - protein, 121 aa, Staphylococcus epidermidis
MQYLYIFVGGALGALIRFCLSMLNEGSTIPLGTFVANLLGAFLMGSIGALSLSLFKTHPNIKKGLTTGLLGALTTFSTFQFELVTLFNQHHFILFTIYGVTSYILGILSCYLGVKIGGRFS

SEQ ID NO: 5958 - protein, 69 aa, Staphylococcus epidermidis
FYHLYYSKSSSIKIYLNIFLNDIRICFLRSTLNYLMIFISKKVRLRFQIKILIVLSDHICDLQCNSRIY

SEQ ID NO: 5959 - protein, 386 aa, Staphylococcus epidermidis
KPFHKETVKGKFIMAELKRGLEGVIAAETKISSIIDSQLTYAGYDIDDLAENAQFEEIIFLLWNYRLPNENELSELKEKLFDYMTLNNRVYKHFEEYVTDHVHPMTALRTSVSYVAHFDPEAENESDENKYDRAIRIQAKIASLVTAFARVRDGKEPVKPNSELSYAANFLYMLRGELPTEVEVEAFNKALILHADHELNASAFTARCAVSSLSDMYSGVVAAIGSLKGPLHGGANERVMSMLKEIGSIDNVDHYLDERFANKDKIMGFGHRVYKDGDPRAKYLREMSRKITEETGQSELFEMSLAIEKRMKEEKGLIPNVDFFSATVYHSMNIPHDLFTPIFAVSRTSGWIAHILEQYRDNRIMRPRAKYIGEQNRKYVSIEERP

SEQ ID NO: 5960 - protein, 44 aa, Staphylococcus epidermidis
NSIQYVWFAIIILIQNILKGAIRKCGSGKQKMTQKALLSLLIIF

SEQ ID NO: 5961 - protein, 574 aa, Staphylococcus epidermidis
YLIQSMLSILYIVTISILKWINSIGMLYYLNVRAYINYRMEGLGMSIDTYTETLKINQLIEKATSHFQLSSTQLYKKILKNHEGELTELGAINVKTGKYTGRSPKDKFIVTEPSYKDNINWGDINQPMDEETFLKLYNKVLDYLNQKEELYIFSGYAGSDKESRLKLKVINELAWHNLFARNMFIRPESIDEAQNIKPNFTIVSAPHFKANPKLDGTHSETFVIISFKHKVILIGGTEYAGEMKKGIFSVMNYLLPMQDIMSMHCSANVGEKGDVALFFGLSGTGKTTLSADPKRKLIGDDEHGWNKNGVFNIEGGCYAKAIHLSKQKEPQIYNAIKYGTILENTVTNDDGTVDFDDNTYTENTRAAYPIDYIENIVTPSKAAHPNTIIFLTADAFGVIPPISKLTKDQAMYHFLSGFTSKLAGTERGVTEPQPSFSTCFGAPFLPLSPTKYADLLGNLIDIHDVDVYLVNTGWTGGKYGIGRRISLHYTREMVDQAISGKLKNTKYIKDDTFGLNIPVQIDSIPTTILNPINAWNNKDNYKAQAYDLIQRFNNNFKKFGKEVEHIANKGAFNQ

SEQ ID NO: 5962 - protein, 53 aa, Staphylococcus epidermidis
FKIQIFNYRFFSISPCKMFNFYCHKAPPLTLLYQKKLYRPKNNLYNDVVLKNE

SEQ ID NO: 5963 - protein, 330 aa, Staphylococcus epidermidis
RSYQLMKLMNKIIVPVTASALLLGACGSNATESKDNTLISSKAGDVKVADVMKKMGKEQIANTSFSIVLNKVLADKYKDKVDTKDIDKDIKKEEKQYGGKDQFESMLKQQGMSLDDYKEQKKLSAYQKQLLLDKVNVSDKEIKENSKKTSHILIKVKSKSSDKEGLSDKKAKEKAEKIQKEVEKNPNKFGEIAKKESMDSSSAKKDGSLGYVIKGQMVDSFEKALFKLKEGEVSKVVKTDYGYHIIKADKETDFNSEKSNIKQKLIEEKVQKKPKLLTDAYKELLKEYKVDYKDRDIKKAIEDSILDPDKIKQQQQQQSQGGSGLTNSGS

SEQ ID NO: 5964 - protein, 456 aa, Staphylococcus epidermidis
GSCLMAENLQRELSNRHVQLIAIGGAIGTGLFLGAGQTIAMTGPSILLTYIIIGFMLFMFMRGLGEIIIQNTNFKSFADVTNTYIGPFAGFVTGWTYWLCWIITGMAEVTAVAKYISFWFPDIPNWISALFCVLILMSFNLLSAKLFGELEFWFAIIKIVTIIALIVIGVIMILFAFKTPFGNTSLTHLYQHGIFPKGASGFFMSFQMALFSFVGIEMIGVTARRNQRSRKTIPKAINSVPIRILIFYVGALAVIMSIIPWDKVDPDNSPFVRLFALIGIPFAAGIINFVVLTAAASSCNSGIFSNSRMLYGLSNQNQAPPTFASTNKHGVPHKAIIASSALLLIAALLNYIFPDATLVFTYVTTISTVLFVVVWALIIIAYINYSRKNPELHKKATYKLPGGQYMGYLILIFFVFVFALLFINVDTRRAIYCTPIWFILLGLMYLRYKKADKESR

SEQ ID NO: 5965 - protein, 83 aa, Staphylococcus epidermidis
PLDQGAMAPQVGFEPTTDRLTADSSTTELLWINKMERVMGIEPTTSAWKAEVLPLNYTRLMKYDYGAVEGNRTLECRNHNPMR

SEQ ID NO: 5966 - protein, 43 aa, Staphylococcus epidermidis
TGGQINNKIIAKIVQKNAVMIGTSRFPLKNDKAIGKFVSLNLL

SEQ ID NO: 5967 - protein, 43 aa, Staphylococcus epidermidis
TLLQYTIIFIKLKHSNFHSILNSIFKIKANNSLTFQGHVINKL

SEQ ID NO: 5968 - protein, 456 aa, Staphylococcus epidermidis
MGLQTYEYGLKPQDGFEVITHFEFTSQHLDILNRLFTPLIGVESIGLYHFMSQFIDESQQLGLTHYIFMNELKINLLDFREQMDNLEAIGLIKTFVRHEKKYSHFVYELIQPPTAYQFFNDPMLSVFLFSEVDKKRYQALKSYFEKDEKDLSKYQQTTRKFTEVFNVPKKVNVSDQINLKQIKHYDGIDLSNETFDFEMLRQMLNHHFISNEIIDKEAKNLIIQLATLYGITEDGMKNVILSSITSAQQLSFEEMRKKARTYYLIEHDNQLPKLEHQTNKINDEKKDRQAEDTTNDWLQLLDETSPIDMLASWSDSEPTQSQKSMIEELINREKMNFGVINILLQFVMLKEDMKLPKSYIFEIASNWKKIGISNAKQAYEYALQVNQPKNYETHSNDKRQNNRGRQNQFLSKEKTPKWLQNRDDQEENKEINDDTLEEDRQAFLEKLNQKWKEEDN

SEQ ID NO: 5969 - protein, 174 aa, Staphylococcus epidermidis
TPAQKEDEKFMSIENFVNLKKYVSDPPIQSYVFVYILIVTGGRFGEVQKLSRSDLDYKNNTIHLPGTKTETSDRTVDIPAADMNMLRKTLSKMPVSLSNQLFSTGVGLITHNAVSKVLQKFCLENKIGKYTLHSIRHTHCSYLLLNDVSIYYTSKRLGYKNIKTTMDAYFASIR

SEQ ID NO: 5970 - protein, 66 aa, Staphylococcus epidermidis
RIKQPQVLQQLSQLLSVKKNPLKQRSFISFNNSNYNRKKAYFRHIFYNYLFSILQVIEFQQHLLKH

SEQ ID NO: 5971 - protein, 54 aa, Staphylococcus epidermidis
FELQHLKINLLSMIVLLFYIFTSKSCIFKMIQFSFHGLTYVLNIYSSMTSHKIK

SEQ ID NO: 5972 - protein, 43 aa, Staphylococcus epidermidis
KYFNVKLHMNTKYFGETLEGTGQAEDYRLKLSPKKASQQYEVL

SEQ ID NO: 5973 - protein, 42 aa, Staphylococcus epidermidis
KFIKIRHIPTLKEKIIKTIPPIKMEELFCLIGLDDRLIYICD

SEQ ID NO: 5974 - protein, 412 aa, Staphylococcus epidermidis
GAVKVMQYDHLLVRYGELTLKGTNRKMFVNQLKDNVKRALIPLSGYHVKGKRDRMYIELSPEADINEIIQRLSKVYGIKSISPVIKIDKNEEKINQSAIQLSHDFEKGSTFKVDVKRVDKSFRLDTYELQRQVGGAILKKNNNITVNVKNPDYEIKIEVRMDAIYIYEKVIAGAGGLPVGTGGKTLLMLSGGIDSPVAGIEVMKRGVTVEAIHFHSPPFTSEKAKDKVIELTRILAERVGPIKLHLVPFTEIQKQINKVVHPRYTMTSTRRMMMRISDKVVHQINANAIVNGENLGQVASQTLKSMYAINHVTATPVLRPLLTLDKEDIIKKAKELGTFETSIQPYEDCCTIFTPKNPVTEPDFDKVIKYESVFNFDEMIENAVENIETLTIDQNYKSAKEQSTDSLIKDLF

SEQ ID NO: 5975 - protein, 345 aa, Staphylococcus epidermidis
WNVKKIYGNLELKINLVKERYVVMKKIAVLTSGGDSPGMNAAVRAVTRTAIYNNIEVYGVYQGYQGLLDDDIHKLELGSVGDTIQRGGTFLFSARCPQFKEEDVRKKAIENLRKRGIEGLVVIGGDGSYRGAQRISEECKEIQTIGIPGTIDNDINGTDFTIGFDTALNTIIESVDKIRDTASSHARTFIVEVMGRDCGDLALWAGLSVGAETIVLPEVNTDIKDVAEKIEQGIKRGKKHSIVMVAEGCMSGQECADELTKYINIDTRVSVLGHIQRGGSPSGADRVLASRLGGYAVELLKQGETAKGVGIRNNQLTSTPFDEIFAESDRKFNSQMYELAKELSI

SEQ ID NO: 5976 - protein, 128 aa, Staphylococcus epidermidis
IRTNDNAIMISGFKIFAGMYVAMIAPPPEATNISGNIFPTIFKSTLPERKNFNALVNVLKELANLFVPKATDGGKPTASNAGVEISPPPPTTESTNEAIKPKATIINIIDKFQSILSLTPLFLLHYEF

SEQ ID NO: 5977 - protein, 397 aa, Staphylococcus epidermidis
EEYNMQFDTIELAIEALRNGESIIVVDDEDRENEGDLVAVTEWMDDNTINFMAREGRGLICAPIDKSIAERLKLQSMEQNNTDIYGTHFTVSIDHYKTTTGISAHERTQTARALIDENTNPEDFHRPGHLFPLIAKENGVLTRNGHTEAAVDLARLTGAQPAGVICEIMNDDGTMAKGEDLQSFKERHHLKMITIKSLVAFRKAVELNVNLKAKVKMPTDFGHFDMYGFTTDYSDEEIVAIVKGDLKSNPNVRMHSACLTGDIFHSQRCDCGAQLEASMKYIDEHGGMIIYLPQEGRGIGLINKLRAYELIEKGYDTVTANLALGFDEDLRDYHVAAEILKYFDISEINLLSNNPKKFEGLEDYGIEIVDRIELIVPETQYNHSYMETKKNKMGHLI

SEQ ID NO: 5978 - protein, 138 aa, Staphylococcus epidermidis
FMYKHILLGVDTQIKNEKALKEVSRLAGEGTIVTVLNAINEQDAQASIRAGVHLDKLTEKRSKGLESTLKTLEDYGIDYDEVIVRGNAKDELLKFANSGKYEIIVLSNRKAEENKKFVLGSVSHKVAKRATIPVLIVK

SEQ ID NO: 5979 - protein, 49 aa, Staphylococcus epidermidis
KFLLFTQKVFMLKSQVSVQIKHLFLHINKVYDYYLTPIASITQMIIFKQ

SEQ ID NO: 5980 - protein, 295 aa, Staphylococcus epidermidis
RKDNIMPELPEVEHVKRGIEPFIKSAKIEKVTFAKNVINGKNNNRETIIKGMELDTFKKLTEGYVIKKVERRSKYIIFYIADHDDDRILVSHLGMAGGFFVVNNLDEISTPNYRKHWQVIFDLDNKQKLVYSDIRRFGEIRNIVNFDSYPSLLEIAPEPFEEVAFEHYLECLTMKKYKNKPIKQTILDHRVIAGAGNIYACEALFRAGITPDKITNSLTKQERKSLFYYVREVLEEGIKYGGTSISDYRHADGKTGQMQLHLNVYKQKKCKVCGHSIETKVIAGRNSHFCPNCQR

SEQ ID NO: 5981 - protein, 200 aa, Staphylococcus epidermidis
IIRNEYSHREEAYIMFLCTRQIDIHARFGIQRIAFLSLVATIFTFLVSYEVMYYFLDTPLSDRHFFVLIVFILLMYPIHKIVHLLFFLPYYKSFKIHKLSSKKWVPYFNTYVNTPVHKIYFCINLILPIFFLSGIFIMLSIYLPQYGHYFMFLLSLNIGCSMMDILYLKILLFSNDGHYVEEHQSGLHILNKVDNPYIQH

SEQ ID NO: 5982 - protein, 48 aa, Staphylococcus epidermidis
YKSKIILISFYFYITCLYICINNVKSGYIPLRYATTNVYLYKVAHHIK

SEQ ID NO: 5983 - protein, 211 aa, Staphylococcus epidermidis
RSILMHKVILVDDHYIVRQGLEFLLSTVDDLSVLKGFKDGATFLSYLKNNERPDIVLLDLVMPEMNGIEITEILKQQYPEIKVLVLTSYVDDEHVISAIDKGADGYEMKDVEPQKLIETIHKVLQGERIIHPQAKSVIKAVSKKPHYTNKLSKREKEVLKEMVKGKTNKEIARALFVSEKTVKTHVSHIFSKLEVSDRTQAAIYAMENKLI

SEQ ID NO: 5984 - protein, 65 aa, Staphylococcus epidermidis
VRILPVEPWLLGQAVKTPPFHGGNTGSSPVGVIQTEVKYRFCFFIIIFYHGELSELAEGARLESV

SEQ ID NO: 5985 - protein, 336 aa, Staphylococcus epidermidis
NVYKEEIMTVTIYDVAREARVSMATVSRVVNGNQNVKPETRNKVNEVIKRLNYRPNAVARGLASKRTTTVGVIIPDISNVYYSQLARGLEDIATMYKYHSIISNSDNDPEKEKEIFNNLLSKQVDGIIFLGGTISEEIKSLINQSSVPVVVSGTDGKDDHIASVNIDFKQAAEEATQYLIEKGAKTFSLIGGEYSIKAQDDVLEGLKNVLSQHQLKLDDTLHLTGNESYKSGIKTFEQLQSNLPDAVLCISDEQAIGILHSAQDAGVKVPEDLQIISFNNTRLVEMVRPQLSSVIQPLYDIGAVGMRLLTKYMNDEEIENPNVILPHRIEYRGTTQ

SEQ ID NO: 5986 - protein, 476 aa, Staphylococcus epidermidis
CGNKLASTYEGKGASMKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITSMGIPL

SEQ ID NO: 5987 - protein, 293 aa, Staphylococcus epidermidis
FNNNDLRGVNMTKHKKGSILAIIGLLIVFVVTGFIFFSMISDQIFFKHVKPVEKVEKLDKTLDKASKKQIHNYTSQQVSNKANTAWRDASGTEIKEAMDSSKFIDDDKQKYQFLDLSKYQGIDKNRIKRMLFDRPVLLKHTDDFINAAKSKHVNEVYLISHALLETGAAKSELANGVEIDGKKYYNFYGVGALDSDPIKTGAEYAKKHGWDTPQKAIYGGADFIHKHFLSHDDQNTLYSMRWNPKNPGEHQYATDIKWAESNANIIADFYKNMKTEGKYFKLYVYKDDDKHQK

SEQ ID NO: 5988 - protein, 983 aa, Staphylococcus epidermidis
EVNKMIIKSLEIYGYGQFVQRKIEFNRQFTEIFGENEAGKSTIQAFIHSILFGFPTKKSKEPRLEPRLGNQYGGKLSLIFDDGIEAEVERIKGSAHGDVKIYLKDGTIRDEVWLNKKLNYISKKTYQGIFSFDVLGLQDIHKNLDEEQLQDYLLEAGALGSTEFTSMRDRIGQKKEELYKKSGKNPIINQQIEQLKQLENQIRNEESKLDTYHRLVDDKDKSSRRLENLKQNLNQLSKMHEQKQKEVALHDQTQEWKRLEQSLNIEPINFPEKGIDRYETAKSHKQSLERDKSLREERLSILNKEAESINPVDQKYIDSFNSLYQQETEIKQKEFELRSIEKDIADKQRELEALQSNIGWQEVFYDADSTEAMKSHMSDLVLGKQEQIAYINQLERGLEENKIERNSNSNEINQVENELVPDETFEKKKEYTQQVLELHEKENLYEKLKETFEEEQTQKNKRQKFLRIGFIVLTILSAALSIFSFFTANLIFGIIFALLTVIFVVGIIFSRSKAVDYSTAISQEINDLENQLTQLEKEYNLDFDLEYQQQVREQWRHAKKNKKILEEKHQYINQSLTTANERLDSLKHSIIEIKKELRLSEKLSDELVVESISTIGQIKAHDKYIIDLNQQRNNLLKDINHFYERAQSVTEPHLKLFNQMSFFHDVKQWLKNAEEQNEAWNKNQTETQLLNNELKQLKSRLSETNQMIKQLFDYVDVDNEEDYYTHHHHFETYQSDLNRFNDLNQYLENQNYTYEMSSQLSEKTTAQLEEEDHRLAKQVDDYNDQFLEMQAEVSDLNAQINHMETDRTLAQLRHEYYSLKNRLNDIAKDWASLSYMQALVEEHIKQIKDKRLPQVINEAVSIFKNLTNGTYNMIHYTENHKIHVKHSNGQVFEPVELSQSTKELLYVALRISLIKVLKPYYPFPVIVDDAFVHFDKYRKERMLKYLRELSEHYQILYFTCTKDHVIPAKEVLTLNKLQEGGKK

SEQ ID NO: 5989 - protein, 260 aa, Staphylococcus epidermidis
GKLNKFKRKVTLMKFRRPNQHFQIVAHRGLPEDYPENTIIAYRHALMLHIDMLEIDVHYTKDKELVVIHDDTIDRTSNGKGKVSDFTLKELKALDFGFYKGEKFKGESIPTFDEVLDLADNFSQKLLIEIKKPSQYPNIENMIVDKLKERQISKSKVILQSFDFDCVKKLSAMNLDYELGLLISKKKYWHKLPNFKKIAKVADYANPNYQIVSKKFMQLAHEEELKVLPYTVNKLKESQKLIDIGVDGIISDVPEDLFEL

SEQ ID NO: 5990 - protein, 44 aa, Staphylococcus epidermidis
KYSLQSFHYINVHFEGSLSIDISGFVIYKFSHLLFYLFSFYVRT

SEQ ID NO: 5991 - protein, 48 aa, Staphylococcus epidermidis
GSVNLIALKSKVYFVMKFIIKKEPGTKCLLVSGSFYVHVYKFFNYVCQ

SEQ ID NO: 5992 - protein, 147 aa, Staphylococcus epidermidis
LPSLALLEKPLWIGGGINFFFPPPFNLNNEKLYWEYFKAQIYKKLSEPKTKTIYSQRKIDVEPVFGFMKAILGFTRMSVRGIDKAKRELGFVLMALNIRKVTAQRAENNQKNNKKDNFYIISIEIVFFYLSWDFMSHTHFFILYLKI

SEQ ID NO: 5993 - protein, 183 aa, Staphylococcus epidermidis
LFSNNKLTSIYPEIILCAQIGVNYMSFEEAYKKYNNIIHYLLKSYQITYNYDEFYQQMLIKMWQLTLDFDEQQSSSFKSYLFIRLKFYLIDLFRQKDNTLNICSIDALSELSPSFSINEIDLLIKDISQQLLPRERDWLTLYLQGYKQYEISQILDFSLTTIKKIKSNAIRKLRRYLNSSTKD

SEQ ID NO: 5994 - protein, 47 aa, Staphylococcus epidermidis
IQSKVLPKTFKVPVCQFYKLKKTAIKWIYFTRLLFYFSYIRRFERIV

SEQ ID NO: 5995 - protein, 150 aa, Staphylococcus epidermidis
ELTKERCKMGKSTNLFKIALGIGGAITVVALSRKESRDKLKQEYNKYKENPESYKSSAKDLATQIGNKANETIQEVKKNPKDYVERIKSNPKEFLEEEKSKIIGKNDQTQDDIEEGKFDAEGGATVNNNLRVVTEDDLKNNKNALQDKKE

SEQ ID NO: 5996 - protein, 283 aa, Staphylococcus epidermidis
FMTKVFINGEFVNEEDAKVSYEDRGYVFGDGIYEYIRAYDGKLFTVKEHFERFLRSAEEIGLDLNYTIEELIELVRRLLKENNVVNGGIYIQATRGAAPRNHSFPTPPVKPVIMAFTKSYDRPYEELEQGVYAITTEDIRWLRCDIKSLNLLGNVLAKEYAVKYNAAEAIQHRGDIVTEGASSNVYAIKDGVIYTHPVNNFILNGITRRVIKWIAEDEQIPFKEETFTVEFLKSADEVIISSTSAEVMPITKIDGENVQDGQVGTITRQLQQGFEKYIQSHSI

SEQ ID NO: 5997 - protein, 245 aa, Staphylococcus epidermidis
MYKKIRRHTMSQKILVVDDEQSIVTLLKYNLETAGYIVEVAYDGEEALKKVETEQPELIVLDVMLPKKDGIEVCKTIRSDKNLVPILMLTAKDDEFDRVLGLELGADDYMTKPFSPREVVARVKAILRRSQFVNEIEKEDVDDEDIIIGSIRIRPEFFEVYKEDELLELTPKEFELLLYLIERQGRVITREHMLNSVWNYEFAGDSRIVDVHISHLRDKLEENPKQPKLIKTVRGLGYKLERPKA

SEQ ID NO: 5998 - protein, 264 aa, Staphylococcus epidermidis
CNKNKGVRLNMDWNLSIMLMIVAFGFIASFVDSVVGGGGLISTPALLAVGLPPSVALGTNKFASSFSTLTSALKFLRSGKVDLKIVGKMFPLIFVASGGGAIIATYIPANILKPLIIIALSLVLIYTVIQKDWGNIRTFTDFTFTKAVLFTLIFIVIGFYDGFLGGGTGSFMLFTLLLFGFDFLSAAGNAKVLNFASNCGALLFFMILGQVNYFYGIIMASSMMIGVLLGAQFALKKGVGYVKALFLVVTAILIIKNLYDFIVQ

SEQ ID NO: 5999 - protein, 40 aa, Staphylococcus epidermidis
VVKNNISAGWSSSVARRAHNPKVGGSNPPPAIHVLLGLVV

SEQ ID NO: 6000 - protein, 415 aa, Staphylococcus epidermidis
IEKNIKRGTHDMNIPKSVWWLVIGMALNITGASFLWPLNTIFMKEELHKSLTIAGIVLMINSFGMVVGNLLGGSLFDKLGGYKTILIGTFTCVCSTTLLNLFHGWPWYAIWLVLLGFGGGMIVPAIYAMAGAVWPNGGRQTFNAIYLAQNIGVALGAALGGFVAEFSFNYIFMANLIMYVLFAIVAITQFNLEINAKFKPQDSIDLKSKENKKRFTAMMLVCAMFAICWIAYIQWETTIASFTQSINISMSQYSVLWTINGIMILVAQPLIRPIIILLKGNLKHQMFVGILIFMSSFLVTSFANHFAIFVVGMVILTFGEMFVWPAVPTIANQLAPVGKQGQYQGFVNSASTVGKAFGPFIGGILVDTFNMSMMFIGMIILLSFALLFLSFYDKVLPKNFKNQHQSRRRRNQNGI

SEQ ID NO: 6001 - protein, 42 aa, Staphylococcus epidermidis
YSENVLYLIASLKVTSRGVEMLTGLSLYLIFSILLGKNLATS

SEQ ID NO: 6002 - protein, 52 aa, Staphylococcus epidermidis
IVRKGFIFLKYFNVKLHMNTKYFGETLEGTGQAKDYRLKLSPKKASQQYEVL

SEQ ID NO: 6003 - protein, 134 aa, Staphylococcus epidermidis
MLRKYWIHFVIVTVIVSLISIKGFPLALGALYLPLLFKIVQLQLNLSKGLIDNVNVHTFIKSNQSGVVISVICCLLITGVLTYTLDDFYNELPGFLGVLVSISPVTLTIGVILFVLTAIAIVQATKAKYQQSKN

SEQ ID NO: 6004 - protein, 40 aa, Staphylococcus epidermidis
SKRKNVYTNHLIVRRSSTVMISISLYFFKLHEISLSSFCN

SEQ ID NO: 6005 - protein, 650 aa, Staphylococcus epidermidis
IGGKNMNQINIQFPDGNTKEFDKGTTTEDIAQSISPGLRKKAVAGKFNGQLVDLTRPLEQDGAIEIITPGSEEALEVLRHSTAHLMAQALKRLYGDVKFGVGPVIEGGFYYDFDMDDKVSSDDFDKIEKTMKQIVNENHKIVREVVSKEKAKDFFKDDPYKLELIDAIPEDESVTLYTQGEFTDLCRGVHVPSTSKIKEFKLLSTAGAYWRGNSDNKMLQRIYGTAFFDKKDLKAHLKMLEERRERDHRKIGKDLELFTNNQLVGAGLPLWLPNGATIRREIERYIVDKEVSMGYDHVYTPVLANVDLYKTSGHWDHYQEDMFPAMKLDEDEAMVLRPMNCPHHMMIYKNKPHSYRELPIRIAELGTMHRYEASGAVSGLQRVRGMTLNDSHIFVRPDQIKEEFKRVVNMIQDVYKDFGFEDYRFRLSYRDPEDKHKYFDDDEMWEKAESMLKEASDELGLTYEEAIGEAAFYGPKLDVQVKTAMGKEETLSTAQLDFLLPERFDLTYIGQDGEQHRPVVIHRGVVSTMERFVAFLTEETKGAFPTWLAPMQVEIIPVNIDLHYDYARLLQDELKSQGVRVEIDDRNEKMGYKIREAQMKKIPYQIVVGDQEVENQEVNVRKYGSEKQESVEKDEFIWNVIDEIRLKKHR

SEQ ID NO: 6006 - protein, 156 aa, Staphylococcus epidermidis
LILKRGTYQMSKNEFIKRVNKQLWFLNAKEEDALNKYIDSVDQNKSIDTHKPIRFSNEYLKKFIFNHKKKSTSHVFVLLICMVLAYAFLLGLFILGLVASLAIVHAYINPNIDLSVFVILTVLIVAIIIMIASLYAIKHTTALFTKKLLEYKFNKR

SEQ ID NO: 6007 - protein, 905 aa, Staphylococcus epidermidis
CVVNTKLAYSLCICIYAKIYVNLFWRLRILNKLVLIDGNSLSFRAFYALPLLSNHAGIHTNAVYGFAMLLEKIIKEEKPNHFLVAFDAGKTTFRHSKYSEYKGGRQKTPPELSEQFPYIRQLLDAYHIKRYELDNYEADDIIGKLSRQADEEDFETIIITGDRDLTQLATDNVTIYYTKKGVTDVDHYTPKFIAEKYNGLVPKQIIDMKGLMGDTSDNIPGVAGVGEKTAIKLLNQFESVEGVYEHIEEVTAKKLKEKLINSKDDALMSKDLATINVHSPIEVSLEDTKLTLQDDTTEKIELFKKLEFKQLLADIDTSSTNEEVIDKTFEIEQDFQNVDLNDLNEAVIHFELEGTNYLKDTILKFGFYTNHQHVVINAEDVKDYKHLVQWLEDKNTTKIVYDAKKTYVSAHRLGINIENIEFDVMLASYIIDPSRSIDDVKSVVSLYGQNYVKDNITIFGKGKKHHIPEEPILNEHIASVTEAIAAVTPTMKSQLEDYNQIELLKDLELPLARILSEMEEIGIYTDINDLKEMEFEIQKKLDVLISNIHESAGEAFNINSPKQLGVVLFETLQLPVIKKTKTGYSTAVDVLEKLQGEHPIIDDILEYRQLAKLQSTYVEGLQKVISKDHRIHTRFNQTLAQTGRLSSIDPNLQNIPIRLEEGRKIRKAFKPTSKDSVILSADYSQIELRVLAHITQDESLKHAFINGHDIHTATAMKVFNVESDQVDSLMRRQAKAVNFGIVYGISDYGLSQSLGITRKQAKAFIDDYLASFPGVKQYMSDIVKDAKAQGYVETLLHRRRYIPDITSRNVNLRSFAERTAMNTPIQGSAADIIKLAMVKFSEKIKETKYHAKLLLQVHDELIFEIPKSEVEDFSKFVEEIMEQALVLDVPLKVDSNYGATWYDAK

SEQ ID NO: 6008 - protein, 157 aa, Staphylococcus epidermidis
EDSKMNFEGKLVGKDLKIAIVVSRFNDFITTRLLEGAKDTLIRHEVEDTNIDVAYVPGAFEIPLVAKKLAQKGEYDAVITLGCVIRGATSHYDYVCNEVAKGVSKANDISDTPVIFGVLTTESIEQAVERAGTKAGNKGSEAAVSAIEMANLIKQIN

SEQ ID NO: 6009 - protein, 165 aa, Staphylococcus epidermidis
RNTKTTSLFKFIYKGLTSMKCISTHSLLYIQTAFSTNVETYIQYEHYAIHLPCTPEKTLHYLLELHQKSYHNQCMLSKNILNIKKFIPIYINEETILFPVTQKRAPIKYFINARNIIGIHSSIHTTMIVFEDGTTIELNIPYTLVTKKWQRNLTVGHIIKKTTFY

SEQ ID NO: 6010 - protein, 341 aa, Staphylococcus epidermidis
MATNIAINGMGRIGRMVLRIALNNKNLNVKAINASYPPETIAHLLNYDTTHGVYDKKVEPIESGIKVNGHEIKLLSDRNPENLPWNEMDIDVVIEATGKFNHGDKAVAHINAGAKKVLLTGPSKGGDVQMIVKGVNDNQLDIDTYDIFSNASCTTNCIGPVAKVLNDKFGIINGLMTTVHAITNDQKNIDNPHKDLRRARSCNESIIPTSTGAAKALKEVLPEVEGKLHGMALRVPTKNVSLVDLVVDLEQNVTVTQVNDAFKNADLSGVLDVEEAPLVSVDFNTNPHSAIIDSQSTMVMGQNKVKVIAWYDNEWGYSNRVVEVADKIGQLIDDKAMVKAI

SEQ ID NO: 6011 - protein, 835 aa, Staphylococcus epidermidis
LLANKGGNAAQVVPFKSLIVEMSFYELGGNVLNYNHKEIEKKWQNYWEENKTFKTNDNLGQKKFYALDMFPYPSGAGLHVGHPEGYTATDIISRYKRMQGYNVLHPMGWDAFGLPAEQYALDTGNDPREFTQKNIQTFKRQIQELGFSYDWDREVNTTDPEYYKWTQWIFIQLYNKGLAYVDEVAVNWCPALGTVLSNEEVVDGVSERGGHPVYRKPMKQWVLKITEYADRLLEDLDELDWPESIKDMQRNWIGRSEGAKVTFKIEQSDQNIEVFTTRPDTIYGTSFLVLSPEHPLVNEITTSDKEQEVKLYQNEASKKSDLERTDLAKEKTGVFTGTFAINPLSGDKLPIWIADYVLSTYGTGAVMAVPGHDERDHEFATKFNLPIIEVIEGGEVQKYAYTGEGKHINSRELDGLENEAAISKAIELLESKGAGEKKVNYKLRDWLFSRQRYWGEPIPIIHWEDGSMTTVPEDELPLLLPETDEIKPSGTGESPLANIDAFVNVIDEKTGMKGRRETNTMPQWAGSCWYYLRYIDPHNEKMIADPEKLKHWLPVDLYIGGVEHAVLHLLYARFWHKVLYDLGVVPTKEPFQKLYNQGMILGEGNEKMSKSKGNVINPDDIVASHGADTLRLYEMFMGPLDAAIAWSEKGLDGSRRFLDRVWRLIITDENSINKKIVDSNNHSLDKVYNQTVKKVTEDFDTLSFNTAISQLMVFINECYKTNEVYKPYIEGFVKMLSPIAPHIGEELWDRLGHENTITYQPWPTFDESLLVDDEVEIVVQVNGKVRAKINIPKDLSKEEMQDLALSNDNVKMSIEGKEVKKVIAVPQKLVNIVAK

SEQ ID NO: 6012 - protein, 60 aa, Staphylococcus epidermidis
MMANKKDSKLNYHEEENAMVTDLDDLKELGKEMEQISQENDEEKLNQSHDNEVRSDLKKQ

SEQ ID NO: 6013 - protein, 1177 aa, Staphylococcus epidermidis
IIKKGSVIMSWFDKLFGDDNGSNDDLLRKNKNRRQSQQSKQNNQDSLLPQNNDIYSRPRGKFRFPIQVSENEYTQKNENYNEHNQEETNDIMRSYNQHDNPEFDSSGKRHRRRRQAYSKHDQSKITQQKQFADNNYTNNNSVFNQNDNKKSSQQRKSIQSENIKNKANTKNTSTSPEFTYLNHSFKSSEVPSAIFGTKKRRPIENGVIPPEHKELNDKEIVQQDEVSHSTKSIDASKNVSNSNDNNIEKNQQKKQQTTAQTESSSENMHNVEKSNYQTTKRKTPNYSKVDNTINIENIYASQIVEEIRRERERKVLQKRRFKKALQQKRQQNQQSEEDSIQKAIDEMYAKQAQHYTGESSLDLENESNQDSSSNSLEKQSNSSNIDNKEAQNNTPLFNYEEIDLDTTSDVYKVNEEETESKNDEDLVSSNHYHSNDDAEVEDAEYHELDDNRQQNQSNSQDDIISSKSSTSNMYDNAISASVDNNTERAKSNEDKNDTEITHLDGTTSAKVSDEKIESNTNNHLEQDKNVKLKNVNSLKSSNSDTGQTRKQRFGGSRPFNVLMTPSDKKRMMDQNHKKVSVPELKPEKQANANHRKDSESNKSEEFKQINTNRETDSNSYESNGIEHDMNSSSDEHVYETPSKQQDEQIQKLQDDFHFENANHAKINNSNETGNQSNISHSKRSQYSTNESKNIDTQTSNSSTSNQNFQRIRKGPNIKLPSYQLLEAPEPHEKDQDWIDNKKQELNDALYYFNVPAEVKNVTEGPSVTRFELSVEKGVKVSRITALQDDIKMALAAKDIRIEAPIPGTSLVGIEVPNQNPTKVNLRSIIESPKFKNTESKLTVAMGYRINNEPLLMDIAKTPHALIAGATGSGKSVCINSILMSLLYKNHPEELRLLLIDPKMVELAPYNDLPHLVSPVITDVKAATQSLKWAVEEMEKRYKLFAQYHVRNITAFNKKAPYEQRMPKIVIVIDELADLMMMAPQDVEQSIARIAQKARACGIHMLVATQRPSVNVITGLIKANIPTRIAFMVSSSVDSRTILDSGGAERLLGYGDMLYLGSGMNKPIRVQGTFVSDDEIDEVVDFIKQQRDPEYLFEEKELLKKTQTQAQDDLFDDVCEFMVEEGHISTSLIQRHFQIGYNRAARIIDQLEQLGYISGANGSKPRDVYITEADLSKE

SEQ ID NO: 6014 - protein, 276 aa, Staphylococcus epidermidis
KMWKWETENDAKGVVVIAHNILEHTGRYAYVITMFRRNGYHVIMGDLPGQGQTSRAQKGQIDDFNTYHENILEWIKIANEYKIPTFVLGVGLGGLIILNLLEKTELPIEGILLFSPMLELKRDYKGCKNKLISNVGKISKDTRFKVGITPQDLTRNDEIIEETANDGLMLKKVTYSWYNLINEKMKETMDHIRDIKPISALIMYGTNDKILETQSINEMKDKLKSKEMYFKVWDGLYHEIHNEPERDLVMRYVLSFLNNSVNTMGFIVNEEEIEDI

SEQ ID NO: 6015 - protein, 326 aa, Staphylococcus epidermidis
IPNLTSLIQIKDLKGRFLLMTKTIGLLVMAYGTPYKESDIEPYYTDIRRGKKPTEEELQDLKDRYEFIGGLSPLAGTTDRQAEALLEALNKEQDDVNFKLYLGLKHISPYIEEAVEQMHNDGIKEAVTVVLAPHYSSFSVGSYDQRAQEKADEYGIQLTHIKHYYQQPKFIKYWTEKINETLEQIPNQEHDETVLVVSAHSLPKGLIERNNDPYPHELHETAEILKQESNIIHVAEGWQSEGNTGTPWLGPDVQDLTRDLYKEHQFKHFIYTPVGFVCEHLEVLYDNDYECKVVCDDIGVNYYRPEMPNTHPLFIGAIVDEIQSHI

SEQ ID NO: 6016 - protein, 388 aa, Staphylococcus epidermidis
LKFEGEVLSVIYLDNAATTKADQDVVDSFVKVNQTLYFNPNSPHHAGVQAEQLLLKAKSEINRILNLNNQFDIIFTSGATESNNILLKGIAYMKKETANEIITSVLEHPSVLEVMRYLEREKGFKLKYVDVTKEGKLDTEHLKSLMTDKVGLVTCMYVNNIMGQIQPIEEIANIVKNYPRAHFHVDAVQALGKVPMQINHIDSLSLSGHKFNGLKGQGLLLLKNIQNIEPIVHGGGQEYGLRSGTINLPMAISMVRAIKNAVDQTKELNLRLSNYKNKLLSFLAEYKNVFINSPQNASPHIINIGFPGVKGEVLVNAFSKQNVMVSTTSACSSKMNKLNEVLLAMEIAESKIEGSIRISLGAHTTENDILSFMNAFESVYKEIKELLK

SEQ ID NO: 6017 - protein, 44 aa, Staphylococcus epidermidis
FQSEVFLLVYKKTKVVNQIVNLVLIILLNPLVSFKIFITSSLAC

SEQ ID NO: 6018 - protein, 73 aa, Staphylococcus epidermidis
NDDLPLVIVRHSRFVPVQELVQVLIIKVGNTALYIPPIIRFIYFSKNSEYLKPLLYSYHIIKTFTCLKFVIAI

SEQ ID NO: 6019 - protein, 44 aa, Staphylococcus epidermidis
TGNDIIKLPGHCTRVVAMATLFFYTKKATKKSLLKVLFLFIKIH

SEQ ID NO: 6020 - protein, 554 aa, Staphylococcus epidermidis
VMSESKEMVRGTFLITISILITKVLGVLFIIPFTALIGGQANMAPFTYAYAPYNIAIAIATAGVPLAASKYVAKYNALGAYKVSQKFYKSSFVVMSITGIVGFLVLYLLAPYIAELTLSRNTHGNSGWTVADITWIIRIISMVVIFIPVLATWRGIFQGYKSMGPTAVSEVTEQIARIVFILVGSYLTLNVFGGTVLQANGIATFAAAIGAIAGILTLWYYWIKRRKNIKKMVDSDTANLNVSYGKMYKEIIAYSIPFVIVSLNFPLFNLVDQFTHNGALNLVGVKPGLQDIFFNMLNMSTNKIVMIPTSLSAGFAVSLIPFITKTYEEGRYAEMHRQIRTSIGVLMFITVPASIGIMALAQPLFTVFYGFDPVVHGHDPNFDGSRLLFYYAPVAILISLLSVTASMLQGIDKQKLTVFVILGSVLIKLILNYPLIMLLHTPGAVLSTAIALLFAICCNFYILKKYANFKFSYSWIHLAKIILISIIMMIGVEVIFFILRLFLEPTRFNYLIIVAIGVIVGAIIYGGITIKTKLADEFLGDIPAKIRRKVKMLR

SEQ ID NO: 6021 - protein, 208 aa, Staphylococcus epidermidis
RKSEIMSKVIGITGGIATGKSTVSELLTAYGFKIVDADIASREAVKKGSKGLEQVKEIFGEEAIDENGEMNRQYVGEIVFNHPDLREALNEIVHPIVREIMEQEKNNYLEHGYHVIMDIPLLYENELQDTVDEVWVVYTSESIQIDRLMERNNLSLEDAKARVYSQISIDKKSRMADHVIDNLGDKLELKQNLQKLLEEEGYIQSESE

SEQ ID NO: 6022 - protein, 48 aa, Staphylococcus epidermidis
KLNELKIIKKFKKDNFYIISIEIVFIYLSWTFLSQLLYFFIITILCQL

SEQ ID NO: 6023 - protein, 85 aa, Staphylococcus epidermidis
MTLDMPASMILSTQGGVEPWCVQGSNETYMVAPWVFKPAISIACTSACLSPFFKCAPKPTILPFLTTTDPTGGLTPVCPFTIFAN

SEQ ID NO: 6024 - protein, 315 aa, Staphylococcus epidermidis
LMLDFEKPLFEIRNKIDSLKESQEKNEVDLQDEIDMLEASLKRETTKVYTNLKPWDRVQIARLPERPTTLDYIPYIFDSFIELHGDRSFRDDPAMIGGIGYLDGKSVTVIGQQRGKDTKDNIYRNFGMAHPEGYRKALRLMKQAEKFNRPIFTFIDTKGAYPGKAAEERGQSESIAKNLMEMASLTVPVIAVVIGEGGSGGALGIGISNRVLMLENSTYSVISPEGAAALLWKDSNLAQIAAETMKITALDLLDLGIIDEVINEPLGGAQKDEEVQALSIKKMFLKHLNELNQLTPEELANDRFEKFRKIGSVVE

SEQ ID NO: 6025 - protein, 69 aa, Staphylococcus epidermidis
RHLEASNLILSISTIIIFQLIILLLLLLFKYRNISPLYLFFIFFVNYKKYNIDDIWCSTLKSITSVIKG

SEQ ID NO: 6026 - protein, 413 aa, Staphylococcus epidermidis
QMSEQEKNQHHYRNSSQKRHTFPWIKTIIVAIIAGIIGALLVLGIGKLLNKTGFNNEGATVHQVSNSHGGNQLDGKSNQYKSVHDMIKDVSPAIVGVINMQKSTNLDDLFNGKASKSKEAGIGSGVIYQISDGSAYIVTNNHVVDGASEIKVQLHNSKQVDAKLIGKDALTDIAVLKIKDTKGIKAIQFANSSKVQTGDSVFAMGNPLGLEFANSVTSGIISASERTIDANTSAGNTKVNVLQTDAAINPGNSGGALVDINGNLVGINSMKIAAAQVEGIGFAIPSNEVRVTIEQLVKHGKIERPSIGIGLINLSDIPENYRKELHTHKDKGVYVAKVDSENAIKKGDIITGIDGKQIKDDTDLRTYLYESKKPGEMVTLKVIRDGKTQDINVKLKKQASASESSQSQSQFAQ

SEQ ID NO: 6027 - protein, 263 aa, Staphylococcus epidermidis
KHLDFIKEKRMPIEYETHFFNEVTYLVDYLKVKALMMIPKNKKDIKRIVIYLRGGKGQVGRVRAARLMQFANEYTLVIGPYYRGNNGSEGRDEFYRGDLNDVTHLIRLLNQNYPSAFIHMVGFSRGGLQGLLTFNDLPVDSYMIWGGVSDIHLMYEERVDLRGMLRRMVGHPKKDAKAYKSRDAMQFIKKDSPPILIIHGGKDIQVGIHQAYDLEKKLKSKGIYYQTYYQLDEGHVPRPPAMRDVIRYIHQWMNDVENKNLNI

SEQ ID NO: 6028 - protein, 427 aa, Staphylococcus epidermidis
KGMEVIIMYQTIVIGGGPSGAMAAVAASEKNKSVLLIEKKKGLGRKLKISGGGRCNVTNRLPYDEIIKNIPGNGKFLYSPFSVFDNLSIINFFETRGVKLKEEDHGRMFPVSNKSQDVVDVLINQLKENHVEVKEETPVVSVSYDHNFKVKTQIGEFESHSLIIATGGTSVPQTGSTGDGYKFAKSLGHSITELFPTEVPITSSETFIKSNRLKGLSLKDVNLSVLKKNGKKRVSHQMDMIFTHFGISGPAALRCSQFVYKEQKNQKKKNIHMQLDVFPELNVDQLSQKVRKILNAEPDKYIKNSLRGLIEERYLLFILEQSGINDEMTAHHLSNQQFQTFINLLKTFTFTVDGTLPLDKAFVTGGGISLKEIEPKTMMSKLVPGLFLCGEVLDIHGYTGGYNITSALVTGHVAGMFAGEFKIDQNK

SEQ ID NO: 6029 - protein, 53 aa, Staphylococcus epidermidis
HTLLRNNFITVLVSTIKYLVILWVNTIIFISMNYKYCYTCNFCEKFLMYPEYE

SEQ ID NO: 6030 - protein, 497 aa, Staphylococcus epidermidis
AQLLIFNKQVGIIIRVYNLEECIVNFWLQEQAQSNGNRLAIVTNQLSLTYEELYHRAKTIAEYLTSLNQKRIGLYISNDIDSVVLIHACWLAHIEIAMINTRLTRHEMINQMNSVDIATIVHTLPLELEGFNLYHFNDLTQLDKHDVSGYKFNLESIASIMFTSGTTGPQKAVPQTFNNHLASAKGCKQSLGFEQNTVWLSVLPIYHISGLSVILRAVIEGFTVRLVKKFQTDDMLTQIKTYPITHMSLVPQTLKWLMDAGLTQPFSLEKILLGGAKLSPQLIEQALTYRLPVYNSFGMTETCSQFLTASPQMLKERFDTVGKPSENVEVKIKNPNAYGHGELLIKGENVMNGYLYPKYLKDTFDNDGYFQTGDIAEIDDEGYVIIYDRRKDLIISGGENIYPYQIETIAKDFEGIEDAVCVGISDDTWGQVPILYYVTNQDINQTELIEHFENHLARYKIPKKYYQVKSLPYTSTGKLQRKKVKSEDLNEGKNNES

SEQ ID NO: 6031 - protein, 40 aa, Staphylococcus epidermidis
LTALISLNQIEKAINAHDCKTLQDLSNYFNLPTTHLFLTM

SEQ ID NO: 6032 - protein, 490 aa, Staphylococcus epidermidis
MYKLLQHLGRSLMLPVAVLPAAAIIVGIGHVLDALNILPQAALFFTSVGTTILEQLGILFAIGVAIGMAKKNDGAVALAAALGFFIVTVVLSPEKLATLLQIKESKIDLAFSQMNNGNVFVGIIIGLIAAYSYNKFSETNLPMALSFFSGKRLVPIMTAFFCTILAIILLLIWPPVYNGIVTFGKWIVGMGPFGALLYGFFNRLLIPTGLHHALNNVFWFDTAGINDIGKFQSGKNAIKGITGRYQAGFFPVMMFGVPAAALAMYHTAKTNQKKQVYAWFLASSVSAFFVGVTEPIEFAFMFVAPVLFVIHAVLTGLSLFIAAMFHWTAGFSFSAGLIDYVLSLVNPISNQPWMLLLQGVVFFIIYYVIFRVVIQVFNLSTIGRGDNELIDPTSNDTSEMEVLQNKTTTSKYYQNAKRILDGLGGKENIISLNHCATRLRLELKDNSIIDEQKIKNAGAIGITQNGHHYTQVIIGTHVQQVANEMDHQMN

SEQ ID NO: 6033 - protein, 91 aa, Staphylococcus epidermidis
IFSWRPLSMLKKILLSLVVFYQRFISPLTPPTCRFYPTCSQYTREAIEYHGALKGLYLGVRRILKCHPLHKGGFDPVPLKKDKNSKTTHHH

SEQ ID NO: 6034 - protein, 539 aa, Staphylococcus epidermidis
LNLWRLLDMSHKILVSDPISEDGLQSILKHPEFDVDIQTDLSENDLVNMISTYDALIVRSQTQVTERIINAATNLKVIARAGVGVDNINIEAATLKGILVINAPDGNTISATEHSVAMLLAMARNIPQAHQSLRNKEWNRKAFRGVELYGKTLGVIGAGRIGLGVAKRAQSFGMKILAFDPYLTEDKAKSLDIQIATVDEIAEKSDFVTVHTPLTPKTRGIVGSSFFNKAKQNLQIINVARGGIIDETALIEALDNNLIDRAAIDVFEHEPPTDSPLIQHDKIIVTPHLGASTVEAQEKVAVSVSEEIIEILTKGNVEHAVNAPKMDLSKVDKTTQSFIGLSTTIGEFAIQLLDGAPSEIKVKYAGDLAQNDTSLITRTIITNILKEDLGNEVNIINALAILNQQGVTYNIEKQKKHSGFSSYIELELVNDQDKIKIGATVFAGFGPRIVRINDYSLDFKPNQYQLVTCHKDKPGIVGQTGNLLGSHGINIASMTLGRNDAGGDALMILSIDQQASEEVIKILNETSGFNKIISTKLTI

SEQ ID NO: 6035 - protein, 395 aa, Staphylococcus epidermidis
ILLWEECTMQYYQPLLLTPGPTPVPEQILSAVQLPMVGHRSTDFEEIASEAFKGLKPVFGSKNEVLILTSSGTSVLEASMLNIANPDDHIVIIVSGAFGNRFKQIAQTYYNHVHVYDVNWGEAVIVDDFITYLKQLNVPVTAVFTQFCETSTGVIHPVHQLGHALKAFDNSLYFIVDGVSCIGAVDVDLTKDKIDVLVSGSQKAIMLPPGLAFVAYSDRAKKRFADVKTPRFYLDLNKYIKSQEQNSTPFTPNVGLFRGINAYVELVKKEGLNHVISRHFKIRNALRAALKALELELLVKDDAHASPTVTSFVPKNQEELNIIKNQLKSQFNITIAGGQGHLKGQILRIGHMGKISPFDILAVVSALEIILTSNRNVNYIGTGITQFMEVIRHES

SEQ ID NO: 6036 - protein, 388 aa, Staphylococcus epidermidis
NSICNFKKVAKLMNNKLKKEIIDFAHSIGIDSIGFTTADPFDELKQKLEEYHAKGYASGFEESNISLRTEPKLSLPSARSIIAIAVGYPNKLKGAPKSVKGDRRGMFARASWGQDYHSIMRKRLDKLADFIKEKVPDVEIQSMVDTGVLSDRAVAERAGLGFTGRNGFVISPELGTWSYLGEMLVSIPFEPDDPLLDSCGDCTICVDRCPTGALVGNGQLNSQKCISFLTQTKGYLQDEYRYKIGNRLYGCDTCQQVCPKNRGINTQHDDIVLEPEILKPRLVPLLQMSNKKFKSTYGHLAGAWRGKKPIQRNAIIALAHFKEESAIPELKEVALNDPRPMIRGTAYWAIGQILEDDAISFIDEHYENEIEEVQLEMKKGLQMRREQK

SEQ ID NO: 6037 - protein, 322 aa, Staphylococcus epidermidis
KGKCIMGNYFPYAFEDKRYHTWNYHLKNKFGQKIFKVALDGGFDCPNRDGTVAHGGCTFCSAAGSGDFAGNRAEPIEVQFKKIKERMHEKWSEGQYIAYFQAFTNTHAPVEVLKEKYEPVLKEDGVVGLSIATRPDCLPDDVVEYLAELNQRTYLWVELGLQTVHQSTSDLINRAHDMQTYYDGVTKLRKHNINVCTHIINGLPGENYDMMMETAKEVAQMDVQGIKIHLLHLLKGTPMVKQYEKGMLEFMSQQDYTNLVCDQLEVLPPEMIVHRITGDGPIDLMVGPMWSVNKWEVLNEIDNELARRNSYQGKMNKQSIQS

SEQ ID NO: 6038 - protein, 471 aa, Staphylococcus epidermidis
SRMWKEKVLEYENQMIEDLKGLLSIESIRDDSKATADAPVGPGPREALDYMYNLGKRDGFSTHDVDHIAGRIEAGKGEDVLGILCHVDVVPAGDGWDSNPFQPVVTDNAIIARGTLDDKGPTIAAYYAVKILNEMKVDWKKRIHIIIGTDEESDWKCTDRYFKTEEMPTLGFAPDAEFPAIHGEKGITTFDLVQNEVTEDTDEPDYELLKFESGQRYNMVPDYAKAEVLVKENMTDVIQNFENFLQQNQLQGESTVDSGILILTIEGKAVHGMDPSLGVNAGLFLLKFLASLNLNKSAKDFVEFNERYLFESHFGEKMGMKFHTDIMGDVTTNIGVISYDKEKAGSYGINLRYPEGFKFEDAIDRFRSEINELGFNLELGKVQKPHYVDKNDPFVKTLVNAYRNQTGDMTEPYTIGGGTYARNLDKGVAFGAMFADSEDLMHQKNEYITKKQLINATSIYLEAIYALCVED

SEQ ID NO: 6039 - protein, 66 aa, Staphylococcus epidermidis
GIFRAIASNIATECSVAEIVLPSGALITKIPFKVAASILILSTPTPALAMTFKFVAALIIRSVTWV

SEQ ID NO: 6040 - protein, 62 aa, Staphylococcus epidermidis
SILLFEKIPLLHEEAAAVKTTKLIIPAANGIPINANNLTNGLLSGSTLSHGIMDMMTANAPT

SEQ ID NO: 6041 - protein, 67 aa, Staphylococcus epidermidis
PEGRWFKSASRNTCFIRSRSVAVNTPACHAGDRGFDSRRDRHYNYGSVAQLVEQWIEAPCVGSSTLS

SEQ ID NO: 6042 - protein, 74 aa, Staphylococcus epidermidis
IGMLLYNYVPQNKWSQWFKTYGVEESVNLNKRMKWYTVIQAIGLIQWYEEQKRYRDMNTWLKFLNEVMNSNLFI

SEQ ID NO: 6043 - protein, 323 aa, Staphylococcus epidermidis
IIFRSLKGVINMEVKMNEIMEALEQSELIIIHRHLRPDPDAYGSQLGLKYYLQKKFPNKQIYAVGANEDSLKFIGLMDEIDDDMYKKATVVVCDTANAPRIDDQRYDTGTKLLKIDHHPATDQYGDINYVNTKASSTSEIIYEFILHFNDEHIIDEQVARVLYLGIVGDTGRFLFNNTTPRTMQITGKLLTYPFDHNQELNKMSEKDPKLLPFQGYILQNFDLNDKGFCKVKITKDILEKFQIQPNEASLFVNTIADIRGLKIWMFGVDEGDQIRCRLRSKGHIIINDVANTFGGGGHPNASGVSVNSWEQFEQLAEALNDKL

SEQ ID NO: 6044 - protein, 109 aa, Staphylococcus epidermidis
CLSRRQFMARSKKYFYLSLLMIILSFFFNTNNSLLSNIFQSFMKIVVVTSIVNIIILILSIVFADKSIKYAKESSDWIRFASKILPLIILITIIIHILSSLHTFGYIFK

SEQ ID NO: 6045 - protein, 51 aa, Staphylococcus epidermidis
CKSSWFLHFIPSNLAFYHYYTSHSLFLKTHNVDVIKTFKIKQVIESCKYMI

SEQ ID NO: 6046 - protein, 40 aa, Staphylococcus epidermidis
IHTRSATNIKNNISGSQAQFTAGWEFHPAPKEIYEIVMIN

SEQ ID NO: 6047 - protein, 139 aa, Staphylococcus epidermidis
KTYSRKANEIILATRVENLLSKDEIIYTYLNIVPFGHDYNGANITGISSASYSLFGIPAKDLNIAQSAYLIGLLQSPYGYTPYDEHGKVKPYHLLKLSMKRQQYVLKRMRVEGKISKQQYENAKKYNIKQHLLKQSKDE

SEQ ID NO: 6048 - protein, 461 aa, Staphylococcus epidermidis
MSVRIEHDTFGEIEVPEDKYWGAQTERSKRNFPVGKEHMPIQVIYGFAQLKRGAALANHELGKLSDEKKNAIVYACDRILNGELDNHFPLVIWQTGSGTQSNMNVNEVVSYVANEYLKKHGSKETIHPNDDVNKSQSSNDTFPTAMHVALFHEVETKLEPALNHLRQTFKEKEDQYQSIIKIGRTHLQDATPIKLGQEISGWRYMLEKCEQLLSESKKHILNLAIGGTAVGTGINAHPEFGHKVAKYISQNTGYAFVSSENKFHALTSHDEIVQLHGTLKALATDLMKIANDIRWLASGPRAGLAEISIPENEPGSSIMPGKVNPTQCEMLTMVAVQVMGNDTTVGIASSQGNFELNVFKPVIMHNTLQSIYLLADGMNTFNKNCAIGIQPIEENINNYLNQSLMLVTALNPHIGYEKAAQIAKKAHKEGLTLKESAIESGYVTESQFEEWIKPEDMVDPH

SEQ ID NO: 6049 - protein, 68 aa, Staphylococcus epidermidis
NLVRKSLLQKVGAVMPSGMVIKDAQLRGVDSSGMICSMKELNLPNAPKEKRNYGTLTMTMILGQAIFE

SEQ ID NO: 6050 - protein, 209 aa, Staphylococcus epidermidis
NIWLTKNYFLSHFLVESEVNVLEQFYQLGWTLDSAGGASGEAYMAEQDGQKLFLKRNSNPFIAALSAEGIVPKLVWTKRIETGEVVTAQHWKNGRELNEDEMNQTRVAELLHKIHGSRPLLTMLKRMEMEPITPDIMLNKINASLSREVLTHHVVRRALTYLEDHLPNLEPRFFTVVHGRVKHNNWLLSESDELYLVDWGRCMIAKPAN

SEQ ID NO: 6051 - protein, 42 aa, Staphylococcus epidermidis
KRNSSKTLSFCFFSVMRLYYNYNSFGNFHSKYGGCRFLIQQT

SEQ ID NO: 6052 - protein, 77 aa, Staphylococcus epidermidis
NICSIFCYFFTIIKYFKIHCHVNYTPLSLLFYLSRFNLKYTLCINYQTIIFYWLTINITFLGFILHLLYLLALIMKG

SEQ ID NO: 6053 - protein, 409 aa, Staphylococcus epidermidis
MSLRDDALEMHRENQGKLEITPNVKVTNKQQLSLAYSPGVAEPCKEIHEDSRKVYEYTIKGNTVAVVTDGTAVLGLGNIGAEASIPVMEGKAALFKSFAGINGVPISLDTTDTQEIIKTVKLIAPNYGGINLEDISAPRCFEIEETLKKETNIPIFHDDQHGTAIVTMAGLINALKIVDKELTNIKVVLNGAGAAGIAIVKLLHAYGVNNMIMCDSKGAIYSGRNFGMNDTKTYVAKWTNKDKVEGSLEEVIKDADVFIGVSVADILTQDMVKTMADDPIIFAMANPNPEINPNEAKQAGAKVVGTGRSDFPNQINNVLAFPGLFRGALDVEATHINEDMKKAAVEAIVHLIDENELHPDYCIPGPFDKRVAPSVAKNVAKAAMESGVARIKIDTQEIFDKTMKLTDLK

SEQ ID NO: 6054 - protein, 601 aa, Staphylococcus epidermidis
ISKRIINLNLFGRIIKMRKTKIVCTIGPASESEEMLEKLMNAGMNVARLNFSHGSHEEHKARIDTIRKVAKRLNKTIGLLLDTKGPEIRTHNMKDGLIVLEKGKEVIVSMNEVEGTPEKFSVTYENLINDVNIGSYILLDDGLVELQVKEINKDKGEVKCDILNTGELKNKKGVNLPGVKVNLPGITDKDADDIRFGIKENVDFIAASFVRRPSDVLDIRQILEEEKAEITIFPKIENQEGIDNIEEILEVSDGLMVARGDMGVEIPPESVPMVQKDLIRKCNKLGKPVITATQMLDSMQRNPRATRAEASDVANAIYDGTDAVMLSGETAAGQYPEEAVKTMRNIAVSAEAAQDYKKLLSDRTKLVETSLVNAIGVSVAHTALNLNVKAIVAATESGSTARTISKYRPHSDIIAVTPSEKTARQCAIVWGVNPVVKEGRKTTDALLNNAVATAVETGRVSNGDLIIITAGVPTGEKGTTNMMKIHLVGDEIAKGQGVGRGSVVGHAIVADSASDLEGKDLSDKVIITNSVDETLVPYVEKAIGLITEENGITSPSAIIGLEKGIPTVVGVEQATKEIKNDMLVTLDASQGKVFEGYANVL

SEQ ID NO: 6055 - protein, 71 aa, Staphylococcus epidermidis
VLKSERLNAPILPIKKAPNKFATNVPNGMVEPSLSIDKQNLINAPKAPPTKIYRYCIYISPQNIKELIIII

SEQ ID NO: 6056 - protein, 307 aa, Staphylococcus epidermidis
LMKSFRNIMGDSQNLDKRIQKIKQNVINDTDVKHFLEKNRSNITNEMIDEDLNVLQEYKDQQKVYDGHRYDDCPNFVKGHVPELYIENERIKIRYLPCPCKIKHDEERFDSQLITSHHMQRDTLHAKLKDIYMNNRERLDVAMAADQICTAITNDEKVKGLYLYGPFGTGKSFILGAIANQLKSQKISSTIVYLPEFIRTLKGGFKDGSFEKKLQRVREANILMLDDIGAEEVTPWVRDEVIGPLLHYRMVHELPTFFSSNFNYSELEHHLSITRDGTEKTKAARIIERIKTLSTPYYLTGKNFRNN

SEQ ID NO: 6057 - protein, 338 aa, Staphylococcus epidermidis
MRERIMKVKAINLYTYKEPFKSPISTPKVKLTHRESLFTEIVTYSGETYYGECNAFLTNWYDKETILTVVNRLRQWIPQVLHKDMTSFDSWLPYLNQMNDVPAARSMVVMAVYQMYNDLHDFEVQYGATVSGLTNSQIETLLETRPKRIKLKWSTSLIKDLETIRLLNFDCDIAIDANESLTKPSFLQLANVNTSDIIYIEEPFKILEDLNDIDMSIFPRIAIDEKALSIEKIQSIIQQYPIQVVVLKPFRLGGIDRMLNAMKILKEKNIRFVVGGMYEFGLSRYFTAMLAKEGSYPGDITPHGYYFSNDIVETSGILKGGMIYFTPPKVKRSLLNKV

SEQ ID NO: 6058 - protein, 320 aa, Staphylococcus epidermidis
ITGRREKMRNVEKLNPGDSVDHFFLIHRATQGVTAQGKDYMTLFLQDKSGDIEAKLWTATKDDMQTLKPETIVHVKGDIINYRGRKQMKIHQIRLAQAEDKVSTKDFVDGAPMSPTEIQEELSHFMLDIENANLQRITRHLIKKYQDRFFTYPAASSHHHNFASGLSYHVLTMLRIAKSVCDIYPLLNRSLLYSAIILHDLGKVRELSGPVATTYTVEGNLLGHISIASDEVAETAKELGIDGEEVMLLRHMILAHHGKMEFGSPKLPHLKEAEILYFIDNIDAKMNMFDKAFKKTEKGQFTERIFGLENRQFYNPTTLD

SEQ ID NO: 6059 - protein, 217 aa, Staphylococcus epidermidis
LMMRVRYKPWAEDYLKNHPDLVDMDGAHAGKMSEWFEKEQPIYIEIGSGMGQFITTLAAQYPEINFVSMEREKSVMYKVLDKTKEMGLKNLKMICNDAIELNEYFKDKEISRIYLNFSDPWPKKRHAKRRLTYHTYLALYKQILKDDGEIHFKTDNRGLFAFSIESMSQFGMYFTKMNLNLHDEDDEDNIVTEYEKKFSEKGSRIYRMEAKFHKCFE

SEQ ID NO: 6060 - protein, 160 aa, Staphylococcus epidermidis
EEVRNVEFEDKDGRIVTLNYKNENDMPNGNHVLAIPVYNNQLLFTNHQHRGIEFPGGKVEISEQSKEAVIRELYEETGAIAKFIYYFAQYSIKMEHDEPFIKDVYFVEVSHLEYVDTYYETLGPCLYHQINDIPLNKRSFLINDKAILHCLERVKTLGFY

SEQ ID NO: 6061 - protein, 153 aa, Staphylococcus epidermidis
LNWRSIHMVRHDFKVKTEWLGGREEVGKLRGDIINENISIPSSLGGQGEGTNPDELLVSAASSCYIISLAATLEKSGFTNVKINQQSIGTASFENKKFKMERITHYPSIKVPSSQTEKLKSILDKLLVIADNNCMISNAIRNNVIISIEPNLI

SEQ ID NO: 6062 - protein, 252 aa, Staphylococcus epidermidis
SQWRCLMTVKVEHLTGGYGKKPVIKDLNFELEKGEIVGLIGLNGAGKSTTIKHMLGLINPMEGKLSISNIKINEDIENYRRKLSYIPESPVIYDELTLEEHIEMTAMAYQLSREEVMRRAKPLLKVFRLENELKVFPSHFSKGMKQKVMIICAFIVDPELYIIDEPFLGLDPLGIQSMLDLMVEKRNENRTVLMSTHILATAERYCDRFIILDKGEIVAFGNLDELREQTGLKDKTLDDIYIHVTQGSSAYE

SEQ ID NO: 6063 - protein, 425 aa, Staphylococcus epidermidis
TNDGGQCLMSKLILAVNAGSSSLKFQLIKMPEEKLVTKGVIERIGLSDSIFTIHVNGEKLTDIRDIHNHEEAVNIMLDSFKEHEMIKDITDIQGTGHRVVHGGETFPKSVVVTDEVESQIEELSELAPLHNPANLMGIRAFRKLLPEIPHVAVFDTSFHQTMPEQAYLYSLPYHYYEDYGIRKYGFHGTSHKYVSRRAAQIVGRPIEDLRIISCHIGNGASIAAIDGGESIDTSMGFTPLAGVTMGTRSGNLDPALIPFIMEKTGKTADEVLEILNKESGLLGLTGTSSDLRDLTEEAKHGRQRSRVALDLFASKIHKYIGSYAARMHGVDVIVFTAGIGENSHIIRGKVLEGLEFMGVYWDPKKNESLHGEEGYINYPHSPVKVLVVPTDEEVMISRDVIKYGKLNDNTPKKEEFDTNESIEVN

SEQ ID NO: 6064 - protein, 41 aa, Staphylococcus epidermidis
RREGGAYMILDIFVHIITTVISGCIVALFTHWLRQRNDKHR

SEQ ID NO: 6065 - protein, 56 aa, Staphylococcus epidermidis
VVEGHGPNETQQPLYLKKGAKPFADKYGLNDKSEWTFKSLLSIYIVKKALLFSSHI

SEQ ID NO: 6066 - protein, 199 aa, Staphylococcus epidermidis
SVFIYNRINKGVRGKMTDIIIVHSKHGNSKNHWYEWLRHNLTLEGYDVSLFNLEANDHAQIDEWVNEMKQQLHIRKKDTYFVTHGFGSIAALKFLEETHHHIEGFFSIAGFKEDAQDIDEDVDLKGVTIDYDKIKEQVDKFYGLTSKDDQYVSYKETQRLMNSLNGHTRVVEDGGHFLEEEGFVTFTSLINRMQGYMTR

SEQ ID NO: 6067 - protein, 179 aa, Staphylococcus epidermidis
CIIIKKEVKTMKCLFKMLSIIIIMLSTFTLFISPSTYANEDENWTKIKNRGELRVGLSADYAPLEFEKTIHGKTEYAGVDIELAKKIAKDNHLKLKIVNMQFDSLLGALKTGKIDIIISGMTTTPERKKEVDFTKPYMITNNVMMIKKDDAKRYQNIKDFEGKKIAAQKGTDQAHPCTN

SEQ ID NO: 6068 - protein, 485 aa, Staphylococcus epidermidis
SRYMAYFNKFLSNSERKRGKVSKKVAIIGAGITGLSSAYFIKKQDPSIEVTIFEASNRVGGKIQTYRSDGYTIELGPESYLGRKTIMTDVAKDIGLENDLITNTTGQSYIFAKNKLYPIPGGSIMGIPTDIKPFIKTRLISPIGKLRAGLDLFKKPIEIEDDISVGSFFRQRLGNEVLENLIEPLMGGIYGTDIDQLSLMSTFPNFKEKEEQFGSLIKGMKDEKEQRIKKRQLYPGAPKGQFKQFRHGLSSFIEALVKDIESKGVHIRYNTPVKDILISQKDYEILLEDDSKEKFNGLLVTTPHQVFLNWFSHDPAFDYFKNMDSTTVATVVLAFDEKNITNTYDGTGFVIARTSQTDITACTWTSKKWPFTTPEGKVLIRAYIGKPGDTVVDDHTDEEIVSIVRKDLSQMMTISGNPDFTIVNRLPKSMPQYHVGHIKMIKEIQQHIKTTYPRLRVTGAPFEAVGLPDCIQQGKNAVDEILEEL

SEQ ID NO: 6069 - protein, 116 aa, Staphylococcus epidermidis
TNDMNYVRGEFVMKSVNFKKITILFFSTAFLILIFSLIFLTKKKLYNAELLLNEVKTYFREVKGSYIVQEPIVLENINHNQPIYQGGITVLKNDHLINYEFYADAVSGQIIDIIEL

SEQ ID NO: 6070 - protein, 157 aa, Staphylococcus epidermidis
INSIDRQSFTDLIQTKFKMVRIEAGYTQDTMAQTIGLSKKTLVQIEKERVLPNWTTCVSICALFRDSDVLNSTFGCDPLEIVQTISRNHCAYPNHSTTSDIYWNTIDTRNGFILQSNKVSNIYRVLNNEKQPIFGTSKMREAETYFNRNAKEELIHV

SEQ ID NO: 6071 - protein, 442 aa, Staphylococcus epidermidis
VRSIEMTHYHFVGIKGSGMSSLAQIMHDLGHEVQGSDIESYVFTEVALRNKGIKILPFDANNITKEMVVIQGNAFPDNHEEIVRAHELKLDIIKYHDFLGHVINQYTSVAVTGAHGKTSTTGLLSHVMNGDKKTSFLIGDGTGMGLPGSDYFAFEACEYRRHFLSYHPDYAIMTNIDFDHPDYFKNIDDVYDAFQHMALNVKKGIIAWGDDEYLRKLDVDIPVYYYGFKETDDIYAKNIQITEKGTQFDVYIKGEFYDQFLSPQYGNHNILNALAVIAISYLENMNVENIKEALITFGGVKRRFNETKVSNQVIVDDYAHHPREISATIETARKKYPQKDVVAVFQPHTFSRTQAFLNEFAESLSKADQVFLCEIFGSIRENTGDLTIEDLINRIDGSTLIDENSIDVLEKFDNAVILFMGAGDIQKLLKAYFEKLGVKNDF

SEQ ID NO: 6072 - protein, 65 aa, Staphylococcus epidermidis
LFFITKFYSVNLVTLNIISYSLNSLYSYWNVRMSEFCSFIYFPSIYSLLFGEISRKKYLTISVLI

SEQ ID NO: 6073 - protein, 79 aa, Staphylococcus epidermidis
LGFITSKKDMDYITKNINSFTKRLAEAINGRQINALKSNPSSKKITWNWGGTFYPNAPKSGIRVRRSLGINGAIVESGS

SEQ ID NO: 6074 - protein, 146 aa, Staphylococcus epidermidis
RSVIIMSETIFSKIISGEIPSFKIYENDYVYAFLDISQVSKGHTLLVPKKPSANIFETDEETMKHIGVALPKVANAIKNAFHPDGLNIIQNNGEYADQSVFHIHFHLIPRYENDIDGFGYKWETHEDVIDDETKQKIATQIQAQIS

SEQ ID NO: 6075 - protein, 52 aa, Staphylococcus epidermidis
NVYMFKICDSYMIYIKLGSIEIMTLFRIALDIIQLLSAITNNLSKILLSFSV

SEQ ID NO: 6076 - protein, 68 aa, Staphylococcus epidermidis
SLYIRHLVNFVYWYLLNYAKGPYFSKYFNVKLHINSKYFGETLEGTGQAEDYRLKLSPKKASQQNEVL

SEQ ID NO: 6077 - protein, 211 aa, Staphylococcus epidermidis
AGDIMYNFISKILDVILVKMSKSLYVIGKENIPKDSKYVVTCTHESYNEVIMLGMALLPNQIHYMAKKELFKNQWAGKFLKSLNAFPVDRENPGPSTLKKPVNLLKEHKTIGIFPTGHRTSVEGAPLKRGAATIAMLGKAPILPAAYVGPKKIHGLITGQALIKIGKPIEMDDIPKDLKRNEKVDFLTKEIERRTTQLQKELNEISCSLKK

SEQ ID NO: 6078 - protein, 50 aa, Staphylococcus epidermidis
AWDIIIVPGFLIYILLFLNPWILHRLSTNRYGKMKEYKVKLFLIIHTVKF

SEQ ID NO: 6079 - protein, 371 aa, Staphylococcus epidermidis
HLSILKYLIKCNMLSLVRMIQLWGDSRVRSKNDTILKAIKGESTSHTPVWFMRQAGRSQPEYRKLKEKYSLFEITHQPELCAYVTHLPVDNYQTDAAVLYKDIMTPLKPIGVDVEIKSGIGPVISNPIQTVKDVERLSQIDPKRDVPYVLDTIKLLTEEKLNVPLIGFTGAPFTLASYMIEGGPSKNYNFTKAMMYRDEETWFALMNHLVDISIDYVVAQVEAGAEIIQIFDSWVGALNVKDYRYYIKPAMNKLISGIKAYYDVPIILFGVGASHLINEWNDLPIDVLGLDWRTTIKQADKMGVNKAIQGNLDPSVLLAPWDVIESRLKDILNQGLNRGKHIFNLGHGVFPEVKPETLRKVTEFVHNYTAK

SEQ ID NO: 6080 - protein, 42 aa, Staphylococcus epidermidis
LNGISSSNSSQLIMFVELKNGNHHIYYGSYRMNYSCNIISLH

SEQ ID NO: 6081 - protein, 189 aa, Staphylococcus epidermidis
LLLIKYSVYYVKIELRKIKGAIMMISYKNILIAVDGSHEAEWAFNKAVGVAKRNDAQLTIVNVIDSRTYSSYEVYDAQFTEKSKHFSEELLKGYKEVATNAGVKNVDTRLEFGSPKAIIPKKLARDVGADLIMSGTSGLNAVERFIVGSVSEAIVRHAPCDVLVVRTEEMPEDFQPQVATPQLREKYQD

SEQ ID NO: 6082 - protein, 288 aa, Staphylococcus epidermidis
GVLIMNVFQMRDKLKARLKHLDVEFKFDREEETLRIVRIDNHKGVTIKLNAIVAKYEEQKEKIIDEICYYVEEAIAQMGDEVINNVEDIQIMPVIRATSFDKETKEGHAFVLTEHTAETNIYYALDLGKSYRLIDENMLQTLNLTAQQVKEMSLFNVRKLECRYSTDEVKGNIFYFINTNDGYDASRILNTSFLNHIQHQCEGEMLVGVPHQDVLILADIRNKTGYDVMAHLTMEFFTKGLVPITSLSFGYDNGHLEPIFILGKNNKQKRDPNVIQRLEANRKKFKKD

SEQ ID NO: 6083 - protein, 47 aa, Staphylococcus epidermidis
DSSFFFFVVMKKQKRVLHAYRDILFYVSSPYSDSYATRPHWEQHRAR

SEQ ID NO: 6084 - protein, 103 aa, Staphylococcus epidermidis
MESITVDELKKKILDSNPVNIVDVRTNEETEMGVIPGAKTIPMDEIPDNLKEFNKNDTYYIVCAAGSRSAKVVSYLEEQGVHAVNVEGGMNAWGDEGTVIDNI

SEQ ID NO: 6085 - protein, 564 aa, Staphylococcus epidermidis
LYKIKGLNILAQLSDLEIANLSKLKPISEIARKVGITEDALEPYGHYKAKIDINQIQEQKKKGKVVLVTAMSPTPAGEGKSTVTVGLADAFNKLNHNVTVALREPALGPTFGIKGGATGGGYAQVLPMEDINLHFNGDFHAITTANNALSAFIDNHLHQGNELGIDQRRIEWKRVLDMNDRALRHVNVGLGGTTHGVPREDGFNITVASEIMAILCLSRNIKDLKEKISRITIGYTRHHKPITVSDLKVEGALTLILKDAIKPNLVQTIEGTPALVHGGPFANIAHGCNSILATETARNLSDIVVTEAGFGSDLGAEKFMNIKAREAGFDPSAVVVVATIRALKMHGGVAKDQLQHENIEAVEAGLVNLERHVNNIKKYGVEPIVALNAFIHDTPSETACVKQWAKDNQVRIALTEVWEKGGEGGIELANQVFDVMQKPQNFKHLYELKQPLEAKIETIVKEIYGGSKVNFSSKTQKQLKQFKENGWDEYPICMAKTQYSFSDDQTLLGAPNDFEITIRELEAKTGAGFIVALTGAIMTMPGLPKKPAALNMDVTDDGKAIGLF

SEQ ID NO: 6086 - protein, 380 aa, Staphylococcus epidermidis
GDKMEKPTRLALLKEIAEFLNEETEIYSMMQGALRLLINGSDFSTGWIFYIDEEGHHDLVSSVDLPEALSKNHCYYLTNGSCWCVQAYQNHKLTKASNIINCSRINLANHAYDKETNHITHHATVPLQSGSERFGLLNVASPNKEHYSEEDLELLESVAFQIGSAIKRIQLTNKEKENAKINERNRLARDLHDSVNQMLFSLKLTAHAAKGITTDEQAQRAFKTIEETSQNAVNEMRALIWQLKPVGLEQGLIHALHYYSKMLGLDLKVTINGLIDLSNDIEENVYRIIQEAMNNVIKHAKTNKVYLDLSQNVDYLEVDIRDNGQGFDTQSINTFLFNGLKNIKQRTQYLNGKVTIESKINQGTRIYIKIPLKLKEHPYA

SEQ ID NO: 6087 - protein, 277 aa, Staphylococcus epidermidis
EEKMKFTIPKQFNDYTLREIFQYLKLPKKDLHQLNMSKEILINKEYGTLLNNVKTGDHVEIPTPNEVSNYLPSYRYAQIYYEDDDLAIVMKPKGVKTHPNDLKESNTLMNHVIYTVDSEYVEPIHRLDQETVGLLIVAKNPLMKKILDRMLEYNEITRIYKANVKALLPIKPQTIDMPIGKDKFHSNKRRISNTGQRAITHIINSKMIKEGVCQLDIKLDTGRTHQIRVHLAEIGHPVIGDPLYGTSTLRQLELNSHQIEFTHPLTQEIISVSLDDK

SEQ ID NO: 6088 - protein, 48 aa, Staphylococcus epidermidis
IHRIQYREFFLQYHLHVVKTHLLAIMLGNYVPASLFFMSFNAKNKRRQ

SEQ ID NO: 6089 - protein, 119 aa, Staphylococcus epidermidis
IFLITILLVMLGGGIGAVLRALITNICQRLFNSKIPIATSIVNITGSLIIGFMMGHALDSHHMFPFFVTGVLGGLTTFSTLSSELVNMLSPQFKPIRFVVYSLLQFILGFIACFYGYRI

SEQ ID NO: 6090 - protein, 242 aa, Staphylococcus epidermidis
VPVINIKNLNKKFGANEVLRDINLTVEKGEVVAIIGPSGSGKSTLLRCMNLLDVPSKGKVIFEDNELTQHNVHLDNLRQKMGMVFQNFNLFPHKKVIENVMLAPLLLHKDSKDQLKEKALYLLEKVGLKDKADSYPNQLSGGQKQRVAIARALAMEPDVMLFDEPTSALDPEVVGDVLKVMRQLANESMTMVIVTHEMNFAKEISDKVVFMADGVVVESGTPQNIFENPQHSRTENFLSRVL

SEQ ID NO: 6091 - protein, 167 aa, Staphylococcus epidermidis
CTVIKLGRVTYMKCPKCNSTHSRVVDSRHADEANAIRRRRECENCGTRFTTFEHIEVSPLIVVKKDGTREQFLREKILNGLVRSCEKRPVRYQQLEDITNKVEWQLRDEGQTEISSREIGEHVMNLLMHVDQVSYVRFASVYKEFKDVDQLLESMQGILSDNKRSDK

SEQ ID NO: 6092 - protein, 350 aa, Staphylococcus epidermidis
LKKMMQNVIKTSKILKAKKLLRKKGQIKPTLAQTEIEDSKISSLNRLPEAILSVKSGKVAGVVVEKPVGEAYLKQNSELTFSKIKFNEEKKQTCIAVPKNSPVLLDKLNQTIDNVKEKNLIDQYMTKAAEDMQDDGNFISKYGSFFIKGIKNTILISLVGVVLGSILGSFIALLKISKIRPLQWIASIYIEFLRGTPMLVQVFIVFFGTTAALGLDISALICGTIALVINSSAYIAEIIRAGINAVDKGQTEAARSLGLNYRQTMQSVVMPQAIKKILPALGNEFVTLIKESSIVSTIGVSEIMFNAQVVQGISFDPFTPLLVAALLYFLLTFALTRVMNFIEGRMSASD

SEQ ID NO: 6093 - protein, 427 aa, Staphylococcus epidermidis
FRRILSMANALIEDLKWRGLIYQQTDEEGIEELLNKEQVTLYCGADPTADSLHIGHLLPFLTLRRFQEHGHRPIVLIGGGTGMIGDPSGKSEERVLQTESQVEANVKGLSNQMHRLFEFGSDKGAKLVNNKDWLGQISLISFLRDYGKHVGVNYMLGKDSIQTRLEHGISYTEFTYTILQAIDFGYLNRELNCKIQVGGSDQWGNITSGIELMRRMYGQTEAYGLTIPLVTKSDGKKFGKSESGAVWLDPEKTSPYEFYQFWINQSDEDVIKFLKYFTFLEKEEINRLEQSKNEAPHLREAQKALAENVTKFIHGEAALKDAIRISKALFSGDLKSLSAKELKEGFKDVPQVTLSTKTTNIVEALIETGIASSKRQAREDVNNGAIYINGERQQSVDYELSSKDLIEDEITIIRRGKKKYFMVNYQS

SEQ ID NO: 6094 - protein, 235 aa, Staphylococcus epidermidis
TCYFSSNRYTGGRFMQQETTSWYKQEWFIVLSLLFIFPLGLFLMWKFSKWPSIARTIITVAISVIVLASITYYGNLQMIVPATSNSNNETKETTENNVNDKDERNHKTAVEETKTNYDSTKENTKEPGKENESATRLENSALEKAKSYYDDFHMSKLGIYDILTSEYGEKFDKEDAQYAIDHLEADYEKNALEKAKSYAKDMHMSNDSIYDLLVSNYGEKFTESEAKYAIEHLDN

SEQ ID NO: 6095 - protein, 427 aa, Staphylococcus epidermidis
QMHLNEAFTYLSAFVLGGKFMEHYNRDNFEKSHTSEELYHRTSRSQSNSLKRKDFVVSFIASAIVGSAVGLYYKNKIYKKTDELKEKEQDLRSKVENYRQRAEDTVVSVKSKVEQLKYDSKDNIHADELQAQKAAIQRETDLADESPEAQAIQEAKKETKQVDDVRPSATELAAQQNAIQHETDLADESPEAQAIQEAKSEVDSNNKTSTTHIDSEKEPSAEEIAIAQTAVKEEARNHDLANLSASGEDTKSKSETETEKLAAAAKAKKDRINNNNEVASNTKNLMQEEAIKASNNSDVPNLVTNLNQSQASDTNSVAYRLAQAAKEKRSKLTNGSKETQLTEALLKEPSIAKAQTKLKRIPTLITESKKHSNNPHSQKNSNQTKNITATKEDSKGKQQHTPNQNKRNKQQKVEKTSSKIEKRTFND

SEQ ID NO: 6096 - protein, 60 aa, Staphylococcus epidermidis
TLNFNFNIICQVLYYNYYLKLCHPIPFTIIKIKRYGGYHHVSNNCYRRWPKWGYGCGCCK

SEQ ID NO: 6097 - protein, 90 aa, Staphylococcus epidermidis
VKLVLPNGVLNANKIMITPITIKAMIVTILMIANQNSSSPNNFALNKLKDIRISTQNKALIQLGMSGNQKLIYLATAVTSAIPVIIQHSQ

SEQ ID NO: 6098 - protein, 307 aa, Staphylococcus epidermidis
RSVVLMDFSSPTVIGLIVAILVAVLFFILFLIANHSKKKVKNQTEAHYKEKEQHLKESHEEALEKERVENKKVVTKQKEDFDVTVSNKNREIDALKLFSKNHSEYVTDMRLIGIRERLVNEKRIRPEDMHIMANIFLPSNELTNIERVSHLVLTRTGLYIIDSQLLKGHVYNGISGAQFKELPTMSQVFDTLDLDSSQPQTLVLDQNEDQHSLSFVNYSDKIKHIEKLAGDLQNELNTKYTPTSILYFNPKKDNDVTISHYTQSSNVKVLVGPEQLDEFFNKFVFHGRIQYNVDDLQDIMVKIESFN

SEQ ID NO: 6099 - protein, 235 aa, Staphylococcus epidermidis
SEDVAMRLDKFLANMGVGTRSEVKQLLKKGSVKVNQNIVKLPKLHVNPNSDEIMVNDEVVSYIDKVYIMLNKPKGYISATEDEVHPTIIDLIPEYAHLNIFPVGRLDKDTEGLLLVTNDGQFNHEVMNPNKHVSKTYEVYSKHPITQFDIDKFKSGIELSDGKLKPAILKKVDNYVSHVTIYEGKYHQVKRMFHSIENEVLELKRIKIAQLELDHNLDLGSYRLLTQIDFDNLKN

SEQ ID NO: 6100 - protein, 62 aa, Staphylococcus epidermidis
FLCVYYHFVDVDIKILTILLKGMFFILAEICNSLFKTFCICFISFIAIEMILLADFVIVLLK

SEQ ID NO: 6101 - protein, 63 aa, Staphylococcus epidermidis
NISVSGFFINNKFKINLFLSYLEHSLCLNFIFLLLKFPLRKYMLKLLFRIIVKGKFITFIKIM

SEQ ID NO: 6102 - protein, 136 aa, Staphylococcus epidermidis
RLFFCTSLAKRKYYSFNKWTNSTITIWKGILIFMIKLESEQQFEELKKGYTVFEFTAGWCPDCKVIEPDLPKLEKKYSQLQFVSVDRDQFIDICVQNDILGIPSFLIFKEGQLLGSYIGKERKSIDQIDQFLSQHI

SEQ ID NO: 6103 - protein, 204 aa, Staphylococcus epidermidis
RSVVNMAMNFKVFDNSEKVAEYTADILRKQFNNNPTTIAGFHLSKEHAPVFDELKKNVENHTVDFSQINILDYDDNHSYYEALGVPTGQIYSISYENDAIDFISDKIKTKENKGKLTMQVLTIDENGKLDISVRQGLMEAREIFLVITGANKRDMVEKLYRENGKTSFEPSDLKAHRMVNVILDKEAAAGLPEDVKEYFTARFA

SEQ ID NO: 6104 - protein, 43 aa, Staphylococcus epidermidis
SLKVITLSNPLDAHHLFWAKGKSTDIVKTTPSSAEASSLNFRV

SEQ ID NO: 6105 - protein, 337 aa, Staphylococcus epidermidis
LFRVNSYYQSRMDTFLNRKGYFMSEENTIMERLFHKLDDKAKTLNKENGQSFIENLGLAMEDIYTNQRELLEQATLQDRRKAFQFAYLSLLQEENIQANHQITPDSIGLILGFLVQRFLEHKKEMHIVDIASGAGHLSAAVKEVLSDKTIMHHLIEVDPVLSRVSVHLANFLEIPFDVYPQDAIMPLPLEEADVVIGDFPIGYYPLDERSREMKLGFEKGHSYSHHLLIEQSINALKGAGYAFLVVPSHLFEDDKVKQLENFIATETEMQAFLNLPKTLFKNEKARKSILILQKKKSGETRPVEVLLANIPDFKNPQQFQGFISELNQWIVTNHTKK

SEQ ID NO: 6106 - protein, 121 aa, Staphylococcus epidermidis
LKGVQRLMAVNLYDYANQLEQALRDSDEYKAIKDAFAKVKENEESKKLFDEFRETQMSFQQKQMQGEEIPEEDLQKAQEQAQAIEKDENISELMNAEQKMSQVFQEINQIIVKPLDEIYAD

SEQ ID NO: 6107 - protein, 1067 aa, Staphylococcus epidermidis
ETMVAHLNIHTSFDLLDSSLRIDALIDKAKKEGYRALAITDTNVLYGYPKFYDACIAAHIHPIFGMTIYLTDGLYTIETVVLAKNNQGLKSLYQISSAIMMRNKEEVPIEWLKRYDEHLIIIFKEAELSHKQIIDAFEGKKELYLNHNSNNTLTGKRVWMQSARYLNEDDAETIPALHAIRDNTKLDLIHEKETLDEHFPSIEELQTLNLSEDMITNANEIEELCQAEIAYHQSLLPQFVTPNGETSKDYLWTILIHRLREWELNDKTYFNRLKHEYKIITDMGFEDYFLIVSDLIHFAKTHEVMVGPGRGSSAGSLVSYLLGITTIDPLKYNLLFERFLNPERVTMPDIDIDFEDTRREKVIKYVQDKYGEHHVSGIVTFGHLLARAVARDVGRIMGFDETSLNEISKLIPHKLGITLEEAYQKPEFKAFVHRNHRNERWFEVSKKLEGLPRHTSTHAAGIIINDQPLFKFAPLTTGDTGLLTQWTMTEAERIGLLKIDFLGLRNLSIIHQIILQVKKDLNINIDIEAIPYDDKKVFDLLSNGDTTGIFQLESDGVRSVLKRLQPEHFEDIVAVTSLYRPGPMEEIPTYITRRHNPNQVAYLHPDLEPILKNTYGVIIYQEQIMLIASQVAGFSYGEADILRRAMSKKNRAILESERQHFIDGAKNNGYGEQISKQIFDLILKFADYGFPRAHAVSYSKIAYIMSYLKVHYPHYFYANILSNVIGSEKKTAAMIDEAKHQRISILPPNINQSHWYYKASNKGIYLSLGTIKGIGYQSVKLIIDERQQNGPYRDFFDFSRRIPKRVKNRKLLESLILVGAFDTFGKTRATLLQAIDQVLDLNSDVEQDEMLFDLLTPKQSYEEKEELPDQLLSDYEKEYLGFYISKHPVEKKFEKKQYLGIFQLSNGSHYQPILVQFDHIKQIRTKNGQNMAFVTMNDGRTMMDGVIFPDKFKKYETSISKEQMYIVLGKFEKRNQQMQLIINQLFEVEAYEQTKLSNSKKVILRNVTHLEPQFEHSKVESNEQHALNIYGFDESANKMTMLGQIERQRQNFDLLIQTYSPADIRFI

SEQ ID NO: 6108 - protein, 428 aa, Staphylococcus epidermidis
NMEVNCMSAEKITQSKDGLNVPNEPIIPFIIGDGIGPDIWKAASRVIDAAVEKAYNGEKRIEWKEVLAGQKAYDETGEWLPQETLETIKEYLIAVKGPLTTPIGGGIRSLNVALRQELDLFTCLRPVRWFKGVPSPVKRPEDVDMVIFRENTEDIYAGIEFKQGTSEVKKVIDFLQNEMGATNIRFPETSGIGIKPVSKEGTERLVRAAIQYALDNNRKSVTLVHKGNIMKFTEGSFKQWGYDLAHNEFGDKVFTWQQYDEIVEQKGKDAANEAQSKAEQEGKIIIKDSIADIFLQQILTRPAEHDVVATMNLNGDYISDALAAQVGGIGIAPGANINYETGHAIFEATHGTAPKYADLNKVNPSSEILSSVLMLEHLGWQKAADKITDSIEATIASKIVTYDFARLMDGAKEVSTSDFADELIKNIR

SEQ ID NO: 6109 - protein, 152 aa, Staphylococcus epidermidis
MNLFYNPKGVGDVAFIQIEPSVGPFEYEQKHGVVEIKKENEVVGYNIFNVSNNVTINDNGHIKLTTELIKDLQQLITEAGFDYQLDTDVSPKFVVGYVETKEKHPNADKLSVLNVNVGTEKLQIVCGAPNVESGQKVVVAKSWGRYAKRNGN

SEQ ID NO: 6110 - protein, 243 aa, Staphylococcus epidermidis
GILLKDITFRRVTLMKLSFHGQSTIYFEGNGKKVIVDPFISGNDKCDLDEQTLEVDYIILTHGHADHFGDVVELANRNHATVIGSAELQGYLSTYHGVENVHGMNIGGKAKFDFGTVKFVQAFHSSSFTHDNGVPVYLGMPMGIIVEAEGKTIYHTGDTGLFSDMKLIADRHPVDVCFVPIGDNFTMGIEDASYAINEFIKPTISVPIHYNTFPLIEQDPEQFKDAVQVGEVQILKPGESVEF

SEQ ID NO: 6111 - protein, 148 aa, Staphylococcus epidermidis
SCIFLVILGMKYYYNYPTNKVRRIIMKVSRILFGLGVGAVAGFAVALRHRDNQSVKNHTIDASQPTGAQSELQREIENMKQSFNDILNYGSQIKNESIEFGSSIGEEFKGLIGNFKSDINPNIEKLQSHIENLQNRGEDISNNLSNDK

SEQ ID NO: 6112 - protein, 293 aa, Staphylococcus epidermidis
QRIFGGLPMFKDFFNRSKKKKYLTVQDSKQNDVPAGIMTKCPKCKKIMYTKELNENLNVCFNCDHHIALTAYKRIEAISDEGSFIEFDRGMTSANPLDFPGYEEKIEKDQQKTGLNEALVSGTAKLDGIQYGVAVMDARFRMGSMGSVVGEKICRIIDYCTEHRLPFILFSASGGARMQEGIISLMQMGKTSVSLKRHSDAGLLYISYITNPTTGGVSASFASVGDINLSEPKALIGFAGRRVIEQTINEKLPDDFQTAEFLLEHGQLDKVIHRKDMRETLSNILKIHQEVSN

SEQ ID NO: 6113 - protein, 369 aa, Staphylococcus epidermidis
KYSLSVQTLYVNAFLNLIFMIHYLKISYSSITEVLHMSLFKDFFIALSNHTYLNKIAKKMGPQMGANRVVAGNTIHQLIETIQYLNDYNISVTVDSLGEFVNTREESIKAKEEILEIIDAIYNNNVKAHMSVKISQLGSEFDLNLAYENMREILLKADKNGKMHINIDTEKYDSLSKIQHIIDRLKGEFKNVGTVVQAYLYEADDIIDKYPELRLRLVKGAYKEDASIAFQSKKEIDANYIRIIKKRLLNSKNFTSVATHDNEIINQVKQFMKENHISKDKMEFQMLYGFRTELAQKIANEGYFFTVYVPYGNDWFAYFMRRLAERPQNLSLAIKEFTKPKILKKATLGIGIFATLLTSLILGIKRHKK

SEQ ID NO: 6114 - protein, 41 aa, Staphylococcus epidermidis
KKSFRTHFYFNRKNFLLNVNGLFQHCSYNLNSAILQLNKEQ

SEQ ID NO: 6115 - protein, 350 aa, Staphylococcus epidermidis
GDQLSRFMDDAIQLAKMVNGQTGVNPPVGSVVVKNGRIVGLGAHLKKGDKHAEVQAIEMAGLNTQGATIYVSLEPCTHHGSTPPCVDKIIEAGISKVIYAVKDTTLVSKGDEILREAGIEVEFQYNENAAALYRDFFTAKRNEVPEVTVKVSSSLDGKQATDFNESKWITNKEVKEDVYQLRHEHDAVITGRRTIEADNPLYTTRVPDGKHPIRVILSKKGQLDFNQQIFKDTASEIWIYTENEKLKTNKSFIKIINISNCDTTTILQDLYQRGIGKLLVEAGPNITSQFLQSKHLNELILYIAPKLIGGSGKHQFYKTDEVIDLPEATQFEIVDSKLINQNLKLKLRKK

SEQ ID NO: 6116 - protein, 149 aa, Staphylococcus epidermidis
NSQFFIWEMLILANSEKNRVYGILQLETLFKEIDSIFNTIKEEYGMSKEEILILLTLLEKGSMTLKEMDKYVHIKPYKRTRTYNNLVNLEWIYKERPQDDERTVIIHFNDKQNSKKEDLLKFIDDSIKIKSEPMQSSLQSILAVEFNVL

SEQ ID NO: 6117 - protein, 41 aa, Staphylococcus epidermidis
KRQFLYYFNRNCLYLLILDLLVPVSILYVLKLLNTDRKDAI

SEQ ID NO: 6118 - protein, 56 aa, Staphylococcus epidermidis
KPLSSDYSMTRKGGCNYIIDSDLIMHILFINIKNVASILCKGFKKSVLYIRIVYLV

SEQ ID NO: 6119 - protein, 63 aa, Staphylococcus epidermidis
MNSSTSLFSMDAYSTMWMIYKISWLKSSHSIKLLKKYFIFHMSAYYSLQNNYYKLIVLKAFLI

SEQ ID NO: 6120 - protein, 51 aa, Staphylococcus epidermidis
VLTSFSNNSALYSFFFVKKMREKINIKKAVEKNNIVIFLKLTDFITNSPLT

SEQ ID NO: 6121 - protein, 83 aa, Staphylococcus epidermidis
LISSLGKKMGSNVKDSKITPNKISLFTGSLVTNEITTIVQYKNMESIFFRFTRRLGIGCFLVAAGAYKIVIINPTNAIDKRTK

SEQ ID NO: 6122 - protein, 71 aa, Staphylococcus epidermidis
MSLSNEEMISNIRQKLNIVNQALLNPEKFKSTPHQDISEIYEFVMSKDSFSPSEVTAIADHLGQLRQDMED

SEQ ID NO: 6123 - protein, 498 aa, Staphylococcus epidermidis
IFKSIGDVKVYQYNDDSLMLHNDLYQINMAESYWNDGIHERIAVFDLYFRKMPFNSGYAVFNGLKRVVNFIENFGFTNEDITYLKSIGYEEDFLNYLKDLKFTGNIKSMQEGEICFGNEPLLRVEAPLIQAQLIETILLNIINFQTLIATKASRIRQIATHDTLMEFGTRRAQEIDAALWGARAAFIGGFDSTSNVRAGKLFNIPVFGTHAHALVQTYGDEYIAFKKYAERHKNCVFLVDTFHTLKSGVPTAIKVAKELGDTINFIGIRLDSGDIAYLSKEARRMLDEAGFTEAKIIASNDLDEQTITSLKAQGAKVDGWGVGTKLITGYDQPALGAVYKLVSIETDDGTMSDRIKLSNNAEKVTTPGKKNVYRIINNKTGKAEGDYITLEGENPNDESPLKMFHPVHTYKMKFIKSFKAVNLHQSIFENGKLVYHLPDEYEAQDYLKNNLSILWEENKRYLNPQDYPVDLSTKCWENKHKRIFEVAEHVKEMEDENE

SEQ ID NO: 6124 - protein, 252 aa, Staphylococcus epidermidis
RSIPLYISYECCSIERWRNMTRKYISTEMLIIFTALMIIANFYYIFFEKIGFLLVLLLGCVLVYVGYVYFHKVRGLLSFWIGTLLIAFTLLSNKYTIIILFIFLIVVIIRYLVYKFKPLKVIATDEDITSPIFIKQKWFGEQHTPVYVYKWEDVQIQHGIGDIHIDMTKAANIKETNTIVVRHILGKVQVVVPLNYNINLHATLFYGTAYVNDKSYKIENNHVQIEEKTKDDNYTVNVYVSSFIGDVEVIYR

SEQ ID NO: 6125 - protein, 458 aa, Staphylococcus epidermidis
KRTFLIKNVIMYSFCRSYNTYDRSLQRMIERYSRDEMSSIWTDQNRYEAWLEVEILACEAWSELGYIPKEDVKKIRENAKVNVERAKEIEQETRHDVVAFTRQVSETLGDERKWVHYGLTSTDVVDTALSYVIKQANEILEKDLERFIDVLAAKAKKYQYTLMMGRTHGVHAEPTTFGVKMALWYTEMKRNLKRFKEVRKEIEVGKMSGAVGTFANIPPEIEAYVCEHLGIDTAAVSTQTLQRDRHAYYIATLALIATSMEKFAVEIRNLQKTETREVEEAFAKGQKGSSAMPHKRNPIGSENITGISRVIRGYITTAYENIPLWHERDISHSSAERIMLPDVTIALDYALNRFTNIVDRLTVYEDNMRNNIDKTYGLIFSQRVLLALINKGMVREEAYDKVQPKAMESWETKTPFRELIEQDSSITDVLSSEELDDCFDPKHHLNQVDTIFARAGLS

SEQ ID NO: 6126 - protein, 44 aa, Staphylococcus epidermidis
ELCPGLLFYEIVKNIVFTRIFTIHVKLVFLIKSADNFNLKIQSL

SEQ ID NO: 6127 - protein, 168 aa, Staphylococcus epidermidis
LKMLSKELLAALNEQMNQEYFAAHAYMAMAAYCDKESYDGFANFYIEQAKEERFHGKKIYDYINDRGEHAIFDTIKAPKVEFSSILETFKDSLAQERDVTQRFYNLSELARNDKDYATISFLNWFLDEQVEEESTFETHIDYLTRIGDDCNTLYLYEKELAARSFNEQ

SEQ ID NO: 6128 - protein, 99 aa, Staphylococcus epidermidis; identical to SEQ ID NO: 3780

SEQ ID NO: 6129 - protein, 59 aa, Staphylococcus epidermidis
HYYPSFSLRRILIMENIFNLFIKFFTTILEFIGTVAGDSVCASYFDEPEVPEELTKLYE

SEQ ID NO: 6130 - protein, 116 aa, Staphylococcus epidermidis
AIIPHMTPLIVNGMAIIKCFKYTGIIILAAPMSNTTLTPRELTLKDPNKKVTQAATIPIFAAPLPKPVRLIAVAIATNEIGVTINKENVTQINIDINNGFNSVNLFTNFPSDCVIT

SEQ ID NO: 6131 - protein, 100 aa, Staphylococcus epidermidis
RLPPTYYRGCWHVVSRGFLIRYRQDVHSYLHICSSLITEFYDPKTFITHAALLRQAFAHCGRFPTAASRRSLDRVSVPVWPITLSGRLRIVALVSRYLTN

SEQ ID NO: 6132 - protein, 70 aa, Staphylococcus epidermidis
TLTFPKCISKGATYKYRRHCFFISTHPTFHIFFSVLEGNAHHFVHDLLLINHRHKLFTIQSLTANTLKCP

SEQ ID NO: 6133 - protein, 279 aa, Staphylococcus epidermidis
PLFTIKYIIYIYRWREKFFFLNLAQKTRFVKLRYPLLTRFYSHGLAQILPGLVLGSHLLGDMYKMQTAQTMSIMQVSIFIIAALLIIFMQATIKNPTQLEQGHKEPKRYIFAWVLLGFCIVMIYQIIISIILFAINGSPQRSPNTERLMAIAKQMPIFIVLISIVGPILEEYVFRKVIFGELYNFIKGSRVVSFIIASIVSSLIFALAHNDFKFIPVYFGMGVIFSLAYVYTKRIAVPIGIHMLMNGSVVLTQVVGGDSIKKLQELKAPNIYIPSYILK

SEQ ID NO: 6134 - protein, 279 aa, Staphylococcus epidermidis
KGEFEKRRKPMKRSDKYTDDYIEQRYESQRPHYNTYYQPIGKPPKKKKSKRIFLKAIITILILLIIFFGVMYFISSRANVDDLKSIENKSDFVATENMPNYVKGAFISMEDERFYKHHGFDIKGTTRALFSTISDRDVQGGSTITQQVVKNYYYDNERSFTRKIKELFVARKVEKQYSKNQILSFYMNNIYYGDNQYTVEGAANHYFGVTVDKNNSNMSQISVLQSAILASKVNAPSVYDVNDMSNNYINRVKTNLEKMKQQNFISESQYQEAMSQLGN

SEQ ID NO: 6135 - protein, 384 aa, Staphylococcus epidermidis
IVYTYTIKIRNEIIMKIVEVKSKNGTNFMILDGNNEPIVDAVRYLKYLDSVKKSLNTKKTYAYALKNFFVYLESKKICYKEVSFDNFVDFIRWMKTPFEYENVLSYHRKEKSISPKTINLTMTVVSNFYDYLYRSKKLDVNFYDFMHMESKYSKKYKSFMHHINKDYRTLKNILKVKEPKKKIEVLTNAEVKKLLEEANNIRDKFLIQLLYETGLRIGEVLSLRIDDIKFDFRKGHQIVLKNRFNDNGTYLKTGERKIFISQSLIDLYDDYVYEIIDELSICSDYLFVKIKGRNVGEAMNYSDIYSLFKRLKHKTSINVHPHLFRHTHATVFYNETKDIKQVQERLGHSNIQTTINLYVHPTEEDIREDWNKVKHQFQVFNKGE

SEQ ID NO: 6136 - protein, 362 aa, Staphylococcus epidermidis
EAHTTMKDNKPNNSKLIQTYLSKKTLRYGTASALTLALYLFNSNVTVYADENTANQNQGTSPKISQTAPTNNTENTDATAITTDQNNNDEEEYDASYELPILYVTVWLDDQGNIIKDAVEDAKTPASERQPVKIPGYQHYRTSVSDGITKFIYRKISTAQSPIVENNQQDNNTNKVVETTNQNKDEVNGKEQNQANTSVTNTQITKNEKDEDTKTLKKDKDEKESKDTKTPKKDKEKKDIKTPKKDREEKKPVIPSNGKVEKDEDTKTPKKDKEKKITKTLKKDREEKSPVIPKSGKDEKDTKITKKDKEDEITTTSKKDNNNDVQDKLPETGKTKDIQNPALIMLLTGLGLLGLFRNKIRE

SEQ ID NO: 6137 - protein, 236 aa, Staphylococcus epidermidis
IKEFHKMYDITKWKHMFKLDPAKSISDENLEALCMSNTDAIIIGGTDDVTEDNVIHLMSRVRRYPLPLVLEVSNVESVMPGFDFYFIPTVMNSKDTKYHNEILLEALKKYGHVINFDEVFFEGYVVLNANSKVAKITKAYTQLGIEDVEAYAQMAEELYRFPIMYVEYSGTYGDVDKVKAIANMLQHTQLFYGGGITNIDKANEMSNIADTIVVGDIIYNDIKKALKTVKIKESNK

SEQ ID NO: 6138 - protein, 50 aa, Staphylococcus epidermidis
ITWFRVYDQILNALFRLAFAAAPHLLLNLASDRNSPVHSTKGTPSPINGL

SEQ ID NO: 6139 - protein, 192 aa, Staphylococcus epidermidis
SKWLNTIKVVWSMVKESIPKEGENIKIQSYKHDGNIHRVWSETTILKGTEHVIIGGNDHTLVTESDGRTWITREPAIVYFHSEYWFNVICMFREDGIYYYCNLSSPFACDEEALKYIDYDLDIKVYPNGKYHLLDEDEYEQHMNQMNYPHDIDIILRRNVDILQQWIEQKKGPFAPDFIKVWKERYKKIRDY

SEQ ID NO: 6140 - protein, 79 aa, Staphylococcus epidermidis
TKLTRCLMYKDYNMTQLTLPMETSVLIPTNDISRHVNDIVETIPDTEFDEFRHHRGATSYHPKMMLKVVLYAYTQSVFI

SEQ ID NO: 6141 - protein, 41 aa, Staphylococcus epidermidis
TKLTRCPKYKNYDMTQLTLPMETSVIILPINDCTLMLLLYD

SEQ ID NO: 6142 - protein, 100 aa, Staphylococcus epidermidis
PFATLPEQFETIYQYMIDQNKVSRPVLSDDQLSQLNIHLHEALQQSRPVNIKYYEEGYINFIELIVHRIDSINYEIEGTAPHSRERHKVSFLDIIDISFI

SEQ ID NO: 6143 - protein, 55 aa, Staphylococcus epidermidis
NNKTNGAKIKQIEIRKQNRISNAMITTGIKIINNDKIPRLNDASIALTMFAKVGL

SEQ ID NO: 6144 - protein, 402 aa, Staphylococcus epidermidis
MKRTIFLLMSILLLLTACGDGHKQTSSDKEQSEHKDNHNKNQVKQIATDKKVQGDNYRTILPFKESQARGLLQDNMANGYNGEDFESGLLELSKEIFPTNKYLYQDGQYLDKKTINAYLDPKYTKKEIDKMSEKEKKSKNANENLGLNPSHNGETDEEKIAENSPAYLSNILEQDFYGNSDSKGKNIKGMTIGLAMNSVYYYKKEKDGETFSKDLSDKEIEKQGKQMASEMLSRLRENSDLKDIPIHFAIYKQSSQDSITPGEFIVGTTVEEGKTKINSWDNINEKAALIPSSTAADYDETLNNNFKQFNDNLQSYFSNFTQAVGKVKFVNKKAKQLTVDLPIDYYGQAETIGITQYVTEQAEKYFDKLDEYEIRIKDGNTPRALISKTKDDKEPQVHIYHN

SEQ ID NO: 6145 - protein, 48 aa, Staphylococcus epidermidis
QNLTKSDIIIIIFIVHFAHNQNKVDGNFLILGVINYDNIKQIPYFYQQ

SEQ ID NO: 6146 - protein, 97 aa, Staphylococcus epidermidis; identical to SEQ ID NO: 3795

SEQ ID NO: 6147 - protein, 691 aa, Staphylococcus epidermidis
RGMTMSIPINLPTNSTMINELCTLQSRTINIKGEVLITEIYDDYFFKNDEWHITAFNKFKQFQDSIKNYRDKRKNVFFRIKSKNLNLEFKYLFLKLIVKEDWSLSNLFNTGAVKLNKIAKFFNEVYPNLNSLLDCDINTLEKHWFNWLTENNIPIKRRSSTIVFGDYEYKSGLASFLKNMYINLIKFIDKREEWEKDKWDIRNLEKYGLSYNKTLTGNYLNFEKIESIKMRELAKKYLKNRLITGDIAFATARFYIRVLTRFFQNISKNKETRNSLNELDRCHIEAYIEFLFEYAANKHLQSTKNFVREELKTIRRFLNDIITQNYAIAPYQDIRFLIYPQDLPKHEKKNSSQIDYIPDFVLEQLFEHINDLHKDLIPVVWIAFKTGLRISDVLTLQNNCLAKVNGKYSIITDIAKTFVKGHRIPIDNKLADIIAVLIADSKSKSTKDNNPNNYIFAIYKGKRKGMPFTQHMVRAHLNHLSKTKNIIDEQGEIFHFKTHQFRHTYAVKLLNGGADILTIQELLAHSSPEMTLRYAKLLDDTKRKAFESVIDQGAFSFDVDGKIKNIQHSSELSEKALNSLWQEHKLNAMDNPYGTCHARLSGDCPYMEAPPCLTCNSGKPCKDLAIGFSDLDVEKYELHIKSTVKSIELAKNNNRQDMVEKHINILNKYEEILGNIKDGNIIFGRSNRIKV

SEQ ID NO: 6148 - protein, 116 aa, Staphylococcus epidermidis
LPVTNRRKVGMTSNHHAPYDLGYTRATMDNTKGSETARSSKSHKVVLSSDCSLQLDYMKLESLVIVDQHATVNTFPGLVHTARHTTRVCNTRSRWSNHLELAVEGGTNDWGEVVTR

SEQ ID NO: 6149 - protein, 41 aa, Staphylococcus epidermidis
SCKTHTHNDMCGCVHKCSLFSSLFNIYYNLKVEITKLTYFK

SEQ ID NO: 6150 - protein, 82 aa, Staphylococcus epidermidis
SPKTYVKTTANNAPITVAGNLLYPFFNDALAVGSIVTIAVSMAKIGVRFNNIQNKDVKKVAKPVLIVRAPIICLYHLSFISY

SEQ ID NO: 6151 - protein, 491 aa, Staphylococcus epidermidis
MGRTLKMSIRFESIEKLTELIKNKEIKPSDVVKDIYAAIEETDPTIKSFLALDKENAIKKAEELDELQAKDQMDGKLFGIPMGIKDNIITKDVETTCASKMLEGFVPIYESTVMNKLHDENAVLIGKLNMDEFAMGGSTETSYFKKTLNPFDHTAVPGGSSGGSAAAVAAGLVPFSLGSDTGGSIRQPASYCGVVGMKPTYGRVSRFGLVAFASSLDQIGPITRNVKDNALVLEAISGVDANDSTSAPVDDVDFTSDIGKDIKGLKIALPKEYLGEGVSEEVKTSVKEAVETLKSLGAEVDEVSLPNTKYGIPSYYVIASSEASANLARFDGIRYGYHSKEAQSLEELYKMSRSEGFGEEVKRRIFLGTFALSSGYYDAYYKKSQKVRTLIKNDFDKVFESYDVVVGPTAPTTAFNIGEEIDDPLTMYANDLLTTPVNLAGLPGISVPCGQSNGRPIGLQLIGKPFDEKTLYRVAYQFETQYNLHDAYENL

SEQ ID NO: 6152 - protein, 41 aa, Staphylococcus epidermidis
TTPAYLKLERKIGFAPISHSGKECVLRVELLPHNIKIWSGR

SEQ ID NO: 6153 - protein, 52 aa, Staphylococcus epidermidis
LINAVLMSIFIVFKIYKALITLKMPETVIVSGIFVLLAVIKNKNYFTYNQNC

SEQ ID NO: 6154 - protein, 306 aa, Staphylococcus epidermidis
TIDANITIVILLIYRNYNCNIGGYILKKLILLIAIALVLSACNSTSSHAKELNNLEKKYNANIGVYALDTKSGKEVKFNADKRFAYASTSKAINSAILLEQVPYNKLNKKVHINKDDIVAYSPILEKYVGKDITLKELIEASMKYSDNTANNKIINEIGGIKKIKKRLKKLGDKVTNPVRYEIELNYYSPKSKKDTSTPAAFGKTLNKLIANGKLSKKNKNFLLDLMLNNKNGDTLIKDGVPKDYKVADKSGQAITYASRNDVAFVYPKNQSEPIILVIFTNKDNKSDKPNDKLISETAKNVINKF

SEQ ID NO: 6155 - protein, 148 aa, Staphylococcus epidermidis
GGRALASIREDVQFSNPTISESSFKINENFDSENFEGFGDIKLNLKKYYYEENNEIDNNNNNNGSALLSLEIIIGDIDWKYPFMFKVEIESFFEWENFKGTDIDKFLEINGAAILYSYSRAHISHITNTSKYPSFDLPFYNFTDNDYQ

SEQ ID NO: 6156 - protein, 370 aa, Staphylococcus epidermidis
LKGAFNLRLGARIFKTGIAIILAMSIASLLPDNIGLKTLAGVSAVVAMQPSVYRSIKTVSEQAIGNVIGALLAVTMVTIFSNNFIIMGVTVILLIAILFQFNLAHVATLASVTALIIMGQHTGSFYVAAFFRFVLVMIGVLSSSVVNLIFLPPKFETKIYYNSMNISSDIFVWFKLVLNDTSEFHNIKQDGDQLNSRINKLEKIFDYYNEERPLTKKHIYQQNRKKILFREVVRTTRQAYEVLKRMSRYQNDLYQLNNQLLLQIKLELDSLVTLHEQIFKSLSKKARYDVTQLDYEVDNPQKKNLMDAFQQELIKNPHQTQYSYSNMMQIIAEIEEYRYQLEHLDRIRLSFFTYHRSDTDIDISDEDFDL

SEQ ID NO: 6157 - protein, 105 aa, Staphylococcus epidermidis
GGFYLMTKVTREEVEHIANLARLQISPEETEEMANTLESILDFAKQNDSADTEGIEPTYHVLDLQNVLRDDKAIEGIPQELALKNAKETEDGQFKVPSIMNGEDA

SEQ ID NO: 6158 - protein, 70 aa, Staphylococcus epidermidis
VKIYLMSEYISTYSTLYLYSVNTFVLYICKTKSYVKRKRLYKLLQPLLLIYDYLYEIAKQSYYFIITLSQ

SEQ ID NO: 6159 - protein, 215 aa, Staphylococcus epidermidis
ACFLKNVAQNCIMTPEESSKQVKIIDKKIEQFAQYLQRKNNLDHIQFLKIRLGMQVLAINIEKSIVVYGLAIIFHTFFYTLLTHLSYFLIRRHAHGTHANSSLLCHIQNIIFFIIFPYLIIKLDINYFVLLSMALVGLIITILYAPAATKKQPIPRRLVKRKKILSIFLYCTIVVISLVTKEPVNKLILFGVILESLTLLPIFFPKEDINHGKHF

SEQ ID NO: 6160 - protein, 99 aa, Staphylococcus epidermidis
VVLLEEGLQKLIDRHHITATINRIYGSLTLYFTNEKVTHYEQVENSDGDAFAQFFKLMLNQGINLAPSKFEAWFLTTEHTEEDIDRTLEAADYAFSKMK

SEQ ID NO: 6161 - protein, 360 aa, Staphylococcus epidermidis
QYILMKLIERKGFMYLENSFKKDIEDWFHKNQRDMPWRETTNPYYIWLSEVMLQQTQVNTVIDYYYRFIHRFPTIQSLSEANEDEVLKYWEGLGYYSRARNFHTAVKEVNNNYDGEVPYDPESFKKLKGVGPYTQAAVMSIAFNHPLATVDGNVFRVWSRLNNDYRDIKLQSTRKAFEQELHPYVLKDAGTFNQAMMELGALVCTPKSPLCLFCPIQEHCEAFHMGTTQELPVKTKSLNKKTIEQKVFLIRNDNGQYLLEKRKEKLLNGMWQFPMREQTNANDVISDDLGKSIETINEPVFKLKHQFTHLTWEIKVYNVTAPLNIKENDLPKQMTWFNLDDREQYTFPVPMDKIYKFIEG

SEQ ID NO: 6162 - protein, 54 aa, Staphylococcus epidermidis
PLHYGTIKTEEEGFEPPRAVKLLSVFKTDPFSRTWVFLQNYMDLAGLEPATERL

SEQ ID NO: 6163 - protein, 111 aa, Staphylococcus epidermidis
HSIYQSAKSHVNEGGTIMLKPLGNRVIIEKKEQEQTTKSGIVLTDSAKEKSNEGVIIAVGQGRLLDNGTQVAPQVSEGDTIVFQQYAGTEVKRGDKTYLILNEEDILAIIE

SEQ ID NO: 6164 - protein, 41 aa, Staphylococcus epidermidis
INIYKVMYYRVMLKLNLRMLLTIHSYEANREERFYVSRKFF

SEQ ID NO: 6165 - protein, 82 aa, Staphylococcus epidermidis
EISLSCHKGIFSYAVVIYPRITRDIPVIFSEPIGFLLCGIADDPFCPFANASSTSLVSVFCKLRISTANFSIDVAISANVAM

SEQ ID NO: 6166 - protein, 42 aa, Staphylococcus epidermidis
IKPYLFYYTANTGISILKVKHKKQRRLLCQKKRKQLLNILIQ

SEQ ID NO: 6167 - protein, 318 aa, Staphylococcus epidermidis
QYMYKEILKMTKTFIFGHKNPDTDAISSALIMADFEQQTGNTEAKAYRLGEISAETQFALDYFNVEAPELLNEDLKGQDVILVDHNEFQQSADTISNATIKHVIDHHRISNFETAGPLYYRAEPVGCSATILYKMYKERGFEIKPEIAGLMISAIISDSLLFKSPTCTKEDVDAAQALKDIANVDLEAYGLEMLKAGASTTDKSAETLVNMDAKSFNMGDYVTRIAQVNTVDIDEVLDRKEEFEKVMLEMSANEKYDLFVLVVTDIINSDSKILVVGAEKDKVGEAFKVQLDDGMAFLSGVVSRKKQVVPQITEVLTQ

SEQ ID NO: 6168 - protein, 163 aa, Staphylococcus epidermidis
YIQYIPDEIEISTNFSKSLYKSVYIVYIMYIQKKRGTSMKIILKNNSESPIYEQIKQQIKENVLKGYVSPGEHLPSMRELAKDLKVSLITTKRAYEDLEKDGFVTTIRGKGTFVKEQDNSILKEKQFFVIENLAHSMSKEAKTIGMPLEELIEILTMIYEEDD

SEQ ID NO: 6169 - protein, 49 aa, Staphylococcus epidermidis; identical to SEQ ID NO: 3811

SEQ ID NO: 6170 - protein, 43 aa, Staphylococcus epidermidis
HPFHCIEKNRIEFELSLMVNPLPKEYICNLMLLMILTHFSSRQ

SEQ ID NO: 6171 - protein, 44 aa, Staphylococcus epidermidis
NSIHSVLLGKILLTYPVFNVQNIMVETSGIEPLTSCVQSRRSPS

SEQ ID NO: 6172 - protein, 63 aa, Staphylococcus epidermidis
VVAQMSKKFRVEDKETIADCLDRMKKEGFMPIRRIEKPVYKENKDGSIEILKQDIIFVGALIQ

SEQ ID NO: 6173 - protein, 378 aa, Staphylococcus epidermidis
AHNHYLKYMRSYNMFINAKDFGLKGKSKYKDTRAIQKALNYAKKGRHTVYIPKGTYYIRKALVIYDSTTLLLEEGATLLRKGKDALLKNGRRLKLYHGYNGNSHIYIKGGTFDMNGGEYPYNNTAMCMGHAEDIQILGVTFKNIVGGHALDACGINGLHISECEFKGFLDIDGDRSFSEAVQLDIQVPGAFPKFGTTDGTITKNVVIEKCYFGCSDHPKMKAWNRAIGSHASRYNCYYENIHINQNIFDNLNEYALTPLKSKDTFITKNKFINCNGGIRFLGVKDGKNAADPITGQVMETQAGENFNVIGNTFIGKMKRDAIHIRSYHHVQHQNVFIAANQFEDASQSIHLENINGLTLNQEQTKIKIKSIDVKNISN

SEQ ID NO: 6174 - protein, 181 aa, Staphylococcus epidermidis
MKLHCAYAILIRTRVKVVTQVRIQSRWLIFAIFLTGAISLLIGLTYYKSIKSVDLSGYSVNQISLNHGFNQKGFVVNKKIKLDRYTFYNDKNHKDFTVKVKNKTHKVKGMVLVKDDKVETNFGIKMGDPIDKVINKLGENYKINKVGKNYHSMTYVDRFNKLKLNILYKDNIVKRIEFFSK

SEQ ID NO: 6175 - protein, 47 aa, Staphylococcus epidermidis
VTMHVLTVPNQKATANYVPAAAVIRRWQALSGIIGRKARVGGFLSLM

SEQ ID NO: 6176 - protein, 228 aa, Staphylococcus epidermidis
QTFKLTIIFWQGVSSNMKATRVFNVVVFLQFSTYLLFGMNIQLLFDKKESDYLFFIIPLFFTYIFDNSYTVLIDFCKPTEKLKKVESNNIRFINIIMLLAIIIYAYIYKNKKIRWFKDLVDSANENWCLSIILIIIMSLLISYIWSKYFIKSDYIEKLKEEDFDILGIENVINWLTKSNIKSKDISEGTNVEIEKIELLLKDEKNIDDFSYGEVKSILAYVKYVRESK

SEQ ID NO: 6177 - protein, 434 aa, Staphylococcus epidermidis
KEVKTMMNPLAQKLNDEIKQSSPEVLDMMSQLGKDMFYPKGILSQSAEAKRTTYNATIGMATKKEGKMYANSLNQMFNDLTPDEIFPYAPPQGVEELRDLWQKKMLKENPDLKSKSISRPIVTNALTHGLSLVADLFVDTDDTVLLPTHNWGNYKLVFSTRHGAHIDTYSIFDNSGHFTTSELVKTLKEYKKDKVIIILNYPNNPTGYTPNKEEVNTIVNAIEELANKGTKVVTVVDDAYYGLFYEEVYQQSIFTALTQVKSSNLLPVRLDGATKEFFSWGFRVGFMTFGIDHETLKNALEAKVKGLIRSNISSSPLPSQSAIKHVLKHHEQFDKEIDQNINILKERYEVTKQVVYDNKYAKYWQAYDFNSGYFMSLKLNQVDPEELREHLINNYSIGIIALNSTDIRIAFSCVEKEDIPYVFESIANAIDDIK

SEQ ID NO: 6178 - protein, 177 aa, Staphylococcus epidermidis
FMANTNRKSKKMSDAKCIKTRQVYPQDTNHHHTMFGGTLMANIDEIAAITAMKHAGNPVVTASTDSVDFLRPITTGDILSYEAMVSYAGTSSMEICVQIVIDDVYKNERHLAALSFLTFVALDSDGKPTSVPDVEPETSVEKWFHETAPQRVARRKERRKESIDTIEYLSRVRHIEK

SEQ ID NO: 6179 - protein, 208 aa, Staphylococcus epidermidis
HDYKKMKTSYRNQLEKNYDSRITGKRLNEETLLFLGTGAIAQRAAYLAKAFGMKVIGVSKSGKNVEHFDEVYTIEELDDVIEKANIIVNALPETEETIYLLKRKDFIQMDNNALFINVGRGTIVDEEVLINVLKDRLIRHAYLDVFEKEPLSKDNPLYDLDNVTITAHITGNDSNNNREATDIFKKNLEHFLNNYDVIENKVDLDYGY

SEQ ID NO: 6180 - protein, 40 aa, Staphylococcus epidermidis
LLYNITANYSYNNTVLDHSPLQHRAFLSIKKTPHLSDVIN

SEQ ID NO: 6181 - protein, 126 aa, Staphylococcus epidermidis
MANKQVEISMAEWDVMNIIWNKKSVSANEIVVEIQKNKEVSDKTIRTLITRLYKKEIIKRYKYNNIYFYSSIIKEDDIKMKTAKTFLNKLYGGDMKSLVLNFAKNEELNNKEIEELRDILNDISKK

SEQ ID NO: 6182 - protein, 51 aa, Staphylococcus epidermidis
IVCNVSLLFIGINVDILSFSFQCSLTLTIHYCNKQNLLSQELICISFLVIS

SEQ ID NO: 6183 - protein, 98 aa, Staphylococcus epidermidis
KSCKEVIEMNLEKIYEEISNEIKAMTDDEIKEVSDILYESKLLNVDYSNLKSFKADTKHSYKVKENEYNVIEKNINEKPNLENHEVNQVKNNNIIIAA

SEQ ID NO: 6184 - protein, 100 aa, Staphylococcus epidermidis
KRGNSTMENKLVPGILIGAVIGGAAALADKSTRHSLKQSFKDIKEGNRTRKPSKISSIKDEVMYWKDTLDEIRRNNPELERSIKDAKETFVNRKNQRLGK

SEQ ID NO: 6185 - protein, 464 aa, Staphylococcus epidermidis
FGGNFMTIIRDKFNNSKAFFNTHKTKNLKFRKQQLKLLSKNIKNHENELLDALYKDLGKSKVEAYATEIGMLLKSIKLMRKELKNWSKTKQTDTPLYLFPTKSYIKKEPYGTVLIIGPFNYPVQLVFEPLIGAIAAGNTAIVKPSELTPHVAIVIKDIIEDTFDEAYVSVVEGGIEETQTLLSLPFDYMFFTGSEKVGKIVYEAAARKLIPVTLELGGKSPVIVDDTANIKVASERISFGKFTNAGQTCVAPDYILVQRKVKNDLIKALKKTITEFYGENIEKSPDFGRIVNQKHFNRLNDLIQIHKDNVVFGGNSSKEDLYIEPTLLDNITNDNKIMKEEIFGPILPIITYDNFDEVLEIIQSKSKPLSLYLFSEDENMTHRVVEELSFGGGAINDTLMHLANPNLPFGGVGSSGIGQYHGKYSFDTFSHMKSYTFKSTRLESSLFFPPYKGKFKYIKTFFKN

SEQ ID NO: 6186 - protein, 74 aa, Staphylococcus epidermidis
ANILVVWATPHPFPLNIYFGTLAGGLGCFPFEHGPYHPCSDSQVKLIGIRSLSEFGNPRGAPRPNSALPPIIIT

SEQ ID NO: 6187 - protein, 66 aa, Staphylococcus epidermidis
TTLNSITLYNIVCGLFSTMLQFNCIHVLYYTTPSLVPADLGFFGHLFAFPFYFQPNTKDNEYATGN

SEQ ID NO: 6188 - protein, 49 aa, Staphylococcus epidermidis
LNNNYKYNLNISLIYSVNLFYSHKKIAMKKSINLNFFIANFFHLNLLTA

SEQ ID NO: 6189 - protein, 195 aa, Staphylococcus epidermidis
RFLNTYWEAVLMSNKALIIVDYSFDFIDDNGKLTCGKPGQEIETFITQRIKNYHNNQQEIFFLMDLHYENDKFHPESKLFPNHNIHQTPGRELYGEVGRLYNSIKDQMNVHYLDKTRYDSFYGTPLDSLLRERQINDIEIVGVCTDICILHTAVSAYNLGYNITIPIRGVASFNQDGHQWALSHFKNSLGAKVEE

SEQ ID NO: 6190 - protein, 56 aa, Staphylococcus epidermidis
TSLKNLAILLSFTAPVLNKLDKDQSSLTISFKKRYLNSKFKFLLLILKKTFFLLSL

SEQ ID NO: 6191 - protein, 128 aa, Staphylococcus epidermidis
MKIKQFSFQHILFLIWKKLQIISFFLSEGEIIFNESKDKLSQKYQILNGSNEHGHEELDELLIYKESKQTGYIGLTEYYQTFNELFGSGVEIKDASIEQLMIYLEKSKHKRNTNSKYKVRFNYEAIND

SEQ ID NO: 6192 - protein, 47 aa, Staphylococcus epidermidis
LFVNNKIQEYFYFNYYLIIKCKLKLYPKPNKISKFMLVQYSCMYRLT

SEQ ID NO: 6193 - protein, 43 aa, Staphylococcus epidermidis; identical to SEQ ID NO: 3838

SEQ ID NO: 6194 - protein, 540 aa, Staphylococcus epidermidis
TMAKDLKFSEDARQAMLRGVDKLANAVKVTIGPKGRNVVLDKDYTTPLITNDGVTIAKEIELEDPYENMGAKLVQEVANKTNEIAGDGTTTATVLAQSMIQEGLKNVTSGANPVGLRQGIDKAVQVAIEALHEISQKVENKNEIAQVGAISAADEEIGRYISEAMDKVGNDGVITIEESNGFNTELEVVEGMQFDRGYQSPYMVTDSDKMIAELERPYILVTDKKISSFQDILPLLEQVVQASRPILIVADEVEGDALTNIVLNRMRGTFTAVAVKAPGFGDRRKAMLEDLAILTGAQVITDDLGLELKDASLDMLGTANKVEVTKDHTTVVDGNGDENNIDARVGQIKAQIEETDSEFDKEKITESLGKLPGGVAVNQVWGGSETELKERKLRIEDALNSTRAAVEEGIVAGGGTALVNIYQKVSEIKAEGDVETGVNIVLKALQAPVRQIAENAGLEGSIIVERLKHAEAGVGFNAATNEWVNMLEEGIVDPTKVTRSALQHAASVAAMFLTTEAVVASIPEPENNEQPGMGGMPGMM

SEQ ID NO: 6195 - protein, 117 aa, Staphylococcus epidermidis
NNKKYSGGLILKIVSLNRLNEIENELRKQFPNEEFKFYDKAINIPINDRKTMDILIGYDGKIDRTFIEHCINLKWIGWFATGVNNLPLNYIKERDIILRNGKGIQAKQVSEYIKTFI

SEQ ID NO: 6196 - protein, 279 aa, Staphylococcus epidermidis
RMKKLFISGLIIFIIFFASGAMTWFTIDKNKYDNRHYTKTINSKIEHLSISTVTTNVNIISGKKLAVYFTGDNKINVTKNNKRLSIKEKRAVDRGYGLNFNPFHSNNRKLTIVVPEKDLKSLNIQSLLGEIDLNQVNLKHVSLETDRIIQLKRSELNQVNIESSKANFYITDCLIREGRMKLDKGITHVKNSTLSDTVFLVNRGDISMTDMKSNNDIKASTQRGNINYHFGEKPKNTLLKLHPGHGNKEIKNRYFDKGKVGNSDNILEFYTVDGDIKIE

SEQ ID NO: 6197 - protein, 53 aa, Staphylococcus epidermidis
IIRKCLIFLEYFNVKLHIRAKYFGETHEGTGQAEDLYRLKLSHKKASQQYKVL

SEQ ID NO: 6198 - protein, 52 aa, Staphylococcus epidermidis; identical to SEQ ID NO: 5769

SEQ ID NO: 6199 - protein, 213 aa, Staphylococcus epidermidis
EKRNNMSAIAQNPWLMVLAIFIINVCYVTFLTMRTILTLKGYRYVAAVVSFMEVLVYVVGLGLVMSSLDQIQNIFAYALGFSVGIIVGMKIEEKLALGYTVVNVTSSEYELDLPNELRNLGYGVTHYEAFGRDGSRMVMQILTPRKYELKLMDTVKNLDPKAFIIAYEPRNIHGGFWVKGVRKRKLKAYEPEQLEVVVDHEEIVGGSSNEQKV

SEQ ID NO: 6200 - protein, 191 aa, Staphylococcus epidermidis
TVIEPYNKYRSENMKIFKLTSLTLAALTLAFPFSHVAQAHTYLEKHHQTNETKQSHSFSLEGEAGENPTFLTQPQFINSLDNGHLNINGYQIQQDDTNDIEYKKVYDQEIRATSNHTAISVRFSINNQSLSLESMKDAYPNERLNHIPHTSNDSQYPEDGIYVYHGKMIKLQYKVTHGFVTSVTIGEGVDE

SEQ ID NO: 6201 - protein, 143 aa, Staphylococcus epidermidis
NDDEVVNMIPNPNAPDEYKYETDYRKIPRKYLNPKIPQGRGKIKWQAFATLPQQFEILEQIIKDQNKIEKPLLTHDSLDNLDQIFQIKIQNDELCTISYWEDGNISKYTGKILKKDEISNTFSFSDTNNNIYNLNNANVCSIT

SEQ ID NO: 6202 - protein, 430 aa, Staphylococcus epidermidis
DMDDINLFPFAGLQIFLMIWVTKVIINMKFNFRDYIIVFTIVIPSAIMYYFWQSKALIVLVIIIIIFFYTKIKLYSILVVLFTTMILYITNFITVYIHLTIKDYIPFKFVLQLIHFTFFVIITLIIAYLTQLLFNKLKVSYLSLNKRYLFIITIVLFISFILLYMVSQTDMRGNDTLKLYAILLMGIMVFLSVVILVMSNFTLREMRYKRNVKEIEAYYEYTLRIESINNEMRKFRHDYVNILTTLSDYIREDDMPGLRKYFNENIVPMKDKLKTRSIKMNGIEKLKVREIKGLITTKIIQAQEKRIPISIEVPDEIDRIDMNTVELSRIIGIIVDNAIEASENLEEPLINIAFIDNEEAVTFIVMNKCSDDIPKIHELFEQGFSTKGDNRGLGLSTLKELTDSNENVLLDTVIENGYFVQKVEINNKES

SEQ ID NO: 6203 - protein, 363 aa, Staphylococcus epidermidis
CLRFIIHWRRRGDLQMNHYIRAIGSMLILVYSMLIAFLFIDKVFVNIIFFQGMFYTQIFGIPVFLFLNLLIVLLCIIVGSVLAYKINQQNDWIISQIERSIEGQTVGINDQNIELYTETIDIYHTLVPLNQELHRLRMKTQNLTNENYNINDVKVKKIIEDERQRLARELHDSVSQQLFAASMMLSAIKESKLEPPLNQQIPILEKMVQDSQLEMRALLLHLRPIGLKDKSLGEGIKDLVIDLQKKVPMKVVHEIQDFEVPKGIEDHLFRITQEAISNTLRHSNGTKVTVELFNQEDYLLLRIQDNGKGFNVDEKFEQSYGLKNMRERALEIGATFHIVSLPDSGTRIEVKAPLNKEENSSGD

SEQ ID NO: 6204 - protein, 157 aa, Staphylococcus epidermidis
EIGEYMISKGEQFPSFSLENQDGNFISNETIKGRKTILYFYPRDNTPTCTTEACEFRDHIEDFNQLDVDIYGISADSKKKHQNFIKKHQLNFDLLVDKDYQLANKVGVYQLKKSFGKENMGIVRTTFILDENGNIIDVIEKVKVKTQIETIKNILEG

SEQ ID NO: 6205 - protein, 342 aa, Staphylococcus epidermidis
SLFEFPFLKRSQYDMNDKWYRHIIGARTIKTGLATFFTSLFCMLLNLTPIFAILTAIVTIEPTAKASLKKGYKRLPATVIGALFAVVFTYVFGDQSPLSYALSATFTILICTKLNLQVGTTVAVLTSVAMIPGIHEAYVFNFFSRLLTALIGLVTAGLVNFIILPPKYYHQLEEQLALSEKKMYRLFYERCNELLLGKFSSEKTSKELSKLNIIAQKVETLMSYQRDELHYHKNEDNWKLLNRLTNRAYNNRLFISHLSNIIYLPKHTSIAFDANEKIALINISNSINGIIQKGSFARQKKSIATLKSSVKQMDEFDQNQMKSTLIYEILLIYKILDSRYAK

SEQ ID NO: 6206 - protein, 104 aa, Staphylococcus epidermidis
GLFEMQIEKLRGQSLDELFDAILALENREECYQFFDDLCTVNEIQSLSQRLQVAKMIKQGYTYATIEEESGASTATISRVKRSLQWGNDAYTMILDRLNIETKA

SEQ ID NO: 6207 - protein, 423 aa, Staphylococcus epidermidis
DSLDKIWRINMTNYHNKLKQYAELLVRVGMNVQPQQPVFIRSSVEALELTHLIVEEAYKAGAEDVRVSYTDPKLKRLKFENESVEHFEKQELKQYDIEERLDYVNRGAANLALIAEDPELLNGIDAQKLKAYQTVYSKGFKPYMEASQKNQFPWVVAAFPTRDWARRVYPELDVESAYIKFIDEVFDIVRVDGQNPIENWEKHIKDLSVHAKRLQEKNYQALHYISEGTDLIVGLPKGHIWEDATSYVNGDGQPFIANIPTEEVFTAPDRNNVNGYVTNKLPLNLNGNIIDGFTLTFKDGVIIDVKAEKGEKLLKDLIATDEGACRLGEVALVPDDSPISNRRTIFYNTLFDENASCHLAIGSAYSFNIKGGTEMTTEEKIANGLNDSNIHEDFMIGSPDLTIYGILQDETKELVFKNGNWAK

SEQ ID NO: 6208 - protein, 51 aa, Staphylococcus epidermidis
LRIECPTTPTSKLVGLGSSRFARRYSGNRFFFLFLRVLRCFSSPGLPSDML

SEQ ID NO: 6209 - protein, 54 aa, Staphylococcus epidermidis
YLIECLRVLEVETLTFVSFIFKVYTNAMCQPLFIFKLLGGKAHDKTIFKVCKTL

SEQ ID NO: 6210 - protein, 355 aa, Staphylococcus epidermidis
MLIDKARSFIQTMYSELKYNTNEVENRMKEIEQEINLTGSYTHTYEELSYGAKMAWRNSNRCIGRLFWGSLNVKDARDVCDEKEFIKFIHTHIKEATNGGKIKPYITIFSPEDTPKIYNNQLIRYAGYENVGDPSEKKVTRLAEHLGWKGKGSNFDILPLIYQLPNDTIKIHELPSDIVKEVSIHHEHYPKLSKLGLKWYAVPIISNMDLKIGGITYPTAPFNGWYMVTEIAVRNFTDTYRYNLLEKVAEAFEFDTLKNNSFNKDRALVELNHAVYHSFKADGVSIVDHLTAAKQFEMFERNEHQQNRDVTGKWSWLAPPLSPTLTSNYHHGYDNTMHHTNFFYKKEEPMKCPFH

SEQ ID NO: 6211 - protein, 105 aa, Staphylococcus epidermidis
FVIEQYFLRDGKFVQDVDMKDGGPEDSTILTLQKDDFNKALDSLSENFKVQQSQKESGEIIIKAQNDYRELLKSLSQLDIYPKYIETRKSSLRDTYFNINQRGDK

SEQ ID NO: 6212 - protein, 247 aa, Staphylococcus epidermidis
NEQDKKNFYKQIKKKEVCIMTTTTYQGTSQDVWNVLFDNRKYKGLLDEVNKLIEDTKRLYKQGYRLEAIDEQQKPKVTELENKFKQFATDRLNEIEQRCNEIEKESQQDNVKDPQTEIIKRQNLEARLSFYNDNEIVDYINSKDVTSTDIYELSLLQQKYDNQLNESQQRQVAFKLEELKQGVLYPYTTNEEYKNLMFEYSVINQTGMAKTGVVITKNEQYGGVEIKQLTERYKNAINEVKQSNNRR

SEQ ID NO: 6213 - protein, 46 aa, Staphylococcus epidermidis
IMKDIFNEMDYRNIPRDMLDKNIPTGRGMVKWAPFVICTNLIKNLI

SEQ ID NO: 6214 - protein, 326 aa, Staphylococcus epidermidis
AFMDTATHIVMGVGLTALATQDPVMAESFAATATTLIAGSLIPDGDTVLKLKDNATYISHHRGITHSLPFTILWPILITFFIFVIFSQTNPLHVWLWAQLAVFLHVFVDIFNSYGTQALRPITNKWIQLSVINTFDPIIFIILSTGVLLWILGIHPYIVFFPIILILIGYYIVRFKMQAAIRKQALQKIEQSHTPVKVFVAPTIKFHVWRVAIQTDKHDYVGVSKWKNVDFTDKVKRQSMTPDSILWKVKGNKDIYTFLNFSSIYRWQTTPLDDGTTEIRLMDLRYLNKGRYSFVAIAHLTLENEIDHSYIGWVFSEDKLQRKLFS

SEQ ID NO: 6215 - protein, 150 aa, Staphylococcus epidermidis
VSAELESIDHELEESIASLRKAGVRITPQRQAIMRYLISSHSHPTADEIYQALSPKFPNISVATIYNNLRVFKDIGIVKELTYGDSSSRFDFNTHNHYHIICEKCGKIVDFHYPQLDEVEQLAQHVTDFDVTHHRMEIYGVCKECKEEGN

SEQ ID NO: 6216 - protein, 258 aa, Staphylococcus epidermidis
FIKERDKMIVKTDEELQALKEIGYICAKVRDTMKEATKPGVTTRELDHIAKDLFEEHGAISAPIHDENFPGQTCISVNEEVAHGIPGKRVIHEGDLVNIDVSALKNGYYADTGISFVVGKSDQPLKQKVCDVATMAFENAMKKVKPGTKLSNIGKAVHATARQNDLTVIKNLTGHGVGQSLHEAPNHVMNYFDPKDKTLLKEGQVIAVEPFISTHATFVTEGKNEWAFETKDKSYVAQIEHTVIVTKDGPLLTTKIDD

SEQ ID NO: 6217 - protein, 398 aa, Staphylococcus epidermidis
KAKEIVMSKKEKTTSKYLNSIEDKEHKKNKKIEVDRTYIEPQEFQSKKPKKKNQVFFVSRLNKPAKYTENSNFFSYLIYRIGKDDAAGLAAQMTYHFVLALFPMLIFLLTLLGQFITIDANQINQKVSQYVPDQETASIVGGIVKDISDTASGGILSVGLILAIWSASNGMSAIINSFNVAYDVEDSRNGVVVKLLSILYTLVLSAVFVVAVVLITLGPVINKFLFGPLGIDNQIEWIFNLVRIVIPLIIIFIIFTVLYSVAPNVKTKLRSVIPGAIFTSIIWLLGSFAFGYYISNFSNYSKTYGSLAGIIILFLWLYITSFIIIIGAEINAIIHQRKVIAGHTPEEAAIKHDDNNENHYNENTTYEYYEDSKDVDISNEDDTYNINHQSKEEHHTSD

SEQ ID NO: 6218 - protein, 74 aa, Staphylococcus epidermidis
AHGFKFSFTPLPGYFSPFPHGTGSLSVTREYLALGDGPPRFRRNFTCSVVLRIHSRENMFPTTGLLPSLIHLSR

SEQ ID NO: 6219 - protein, 54 aa, Staphylococcus epidermidis
KTFCDAKSYLLSSFECIIIHLSGDNGKEVTPVPMPNTEVKLLSADGSRTDVTLE

SEQ ID NO: 6220 - protein, 56 aa, Staphylococcus epidermidis
IIDCAKTVAVVVPSPAISFVLFATSCTNFAPIFSYGSSNSISLAIVTPSLVIKGVV

SEQ ID NO: 6221 - protein, 207 aa, Staphylococcus epidermidis
GGRLMNAIELKDVNYRSNAFQLQDVSFNVPKGYVTGFIGGNGAGKTTIIRLIMDLIQSESGTISVFEKDIKIHPREIKNKIGFVYSEIYFNQKWTVKKLENIIAPFYDRWDHEIFIKYLKFFQLPYKNKIKTFSTGMKMKLSLAIAFSHHAELFILDEPTSGLDPLIRNELLEIIQQELIDENKTVFFSTHIISDLEKIADYIVFSQ

SEQ ID NO: 6222 - protein, 359 aa, Staphylococcus epidermidis
CFKWRFNMSHSQINGKRFFNNILNAVGAGVVIALLPNALLGELLKFFKEGNHVLETIFQLVTIIQSFMAFIIGVLAAHQFKFKGTGAAIIGISAMLGSGAVHYNGQTIELKGIGDIINVILVVILACFIYMFLEGKLGSLEMIILPVLVPVISGLIGLLTLPYVQVITQSLGKLVNRFTELNPLLMSILICVTFSLLMVTPISLVAIATAINLTGLGSGAANMGIVAACVTFLFGSLRVNSLGVNVVLLIGAAKMMIPVYLKHLIIAIPLTINGVICGIIAYILKIKGTALSAGFGYTGLVGPINALNRMSGNPSMNIILLIIGYFVIPFAGAFIVHKICKKVLSTYSDEIYKFEISKD

SEQ ID NO: 6223 - protein, 58 aa, Staphylococcus epidermidis
KLMWNFIKGLFKFVFSLLAITTVVVGIGVVAFAYIFKKDFEDIERKTKEIVSDIENNN

SEQ ID NO: 6224 - protein, 56 aa, Staphylococcus epidermidis
GGECSYLINNHCRKITDTQLRDNGDRNQKSKTNVLSINLFVLAFVLKSHKKKTINY

SEQ ID NO: 6225 - protein, 56 aa, Staphylococcus epidermidis
IKLRYQMLMILIYSVSIIDKIYTIRYLIYNISCILIFHNLISPNNTKDFLLLSTLK

SEQ ID NO: 6226 - protein, 43 aa, Staphylococcus epidermidis
MILLYLLAFKTPQSSLYVSIYCFLNNIGNCHKFVDTILEFIKK

SEQ ID NO: 6227 - protein, 40 aa, Staphylococcus epidermidis
NRIRIKFNGQSITKGIYLQFDVIDDFDSFFKPSINLNEKN

SEQ ID NO: 6228 - protein, 51 aa, Staphylococcus epidermidis
PFGRRFESCKVHIILEEYPSPAEGIGLENRQELNGSRGFESLFLRFNGPVV

SEQ ID NO: 6229 - protein, 491 aa, Staphylococcus epidermidis
LILRLISNKIITTSNLRLGMPHIIFLTFLYVGGKKLETIKKNEVKTGKVIDLTHEGHGVVKVDRYPIFIPNALIDEEIKFKLIKVKKNFAIGKLIEVISESDDRVTPPCIYYAKCGGCQLQHMTYRAQLDMKREQVVNLFHRKGPFENTVIKETIGMVNPWRYRNKSQIPVGQSNSNQVIMGFYRQRSHDIIDMDSCLIQDRQHQEVMNRVKYWLNELNISIYNEKTKTGLIRHLVVRTGYHTDEMMVIFVTNGATFKQSELLVNKLKKEFPNITSIKQNINNSHSNVIMGRQSMTLYGKDKIEDQLSEVTYHISDLSFYQINSSQTEKLYQQALNYAQLTGKEIVLDTYCGIGTIGLYMAPLAKHVYGVEVVPQAIKDAEDNATKNQLKNTTFECGKAEDVILTWKSQGIKPGVVMVDPPRKGCDETFLTTLLKLNPKRIVYISCNPSTQQRDAQILAEQYELVEITPVDMFPQTTHIETVALFVRKDEE

SEQ ID NO: 6230 - protein, 729 aa, Staphylococcus epidermidis
MNALVKNMNSEQSEAVRTTEGPLLIMAGAGSGKTRVLTHRIAYLLDEKDVSPYNILAITFTNKAAKEMKARVEHLVGEEAQVIWMSTFHSMCVRILRRDADRIGIERNFTIIDPTDQKSVIKDVLKSENIDSKRFEPRMFIGAISNLKNELKTPEDAQKEANDFHSQMVATVYKGYQRQLSRNEALDFDDLIMTTINLFERVPETLEYYQNKFQYIHVDEYQDTNKAQYTLVKLLANKFKNLCVVGDSDQSIYGWRGADIQNILSFEEDYPEAKTIFLEQNYRSTKNILNAANEVIKHNSERKPKGLWTANSGGDKIQYYEAMTERDEAEYVVKEIMKHQRSGKKYSEMAILYRTNAQSRVLEETFMKSNIPYTMVGGQKFYDRKEIKDLLSYLRVIANSNDDISLQRIINVPKRGIGPSSVEKIQTYALQNNISMFDALAEVDFIGLSKKVTQECISFYEMIQNLIKEQEFLEISEIVDEVLQKSGYRDMLDREQSIESRSRLENLDEFMSVPKDYEENTPLEEQSLINFLTDLSLVADIDEADTQNGVTLMTMHSAKGLEFPIVFIMGMEESLFPHIRAIKSEDDHEMEEERRICYVAITRAEELLYITNATTRMLFGRSQSNMPSRFLKEIPEDLLDSHTGQKRQTIYPKSQPKRGFSKRTTSTKKQVSSSDWKVGDKVMHKAWGEGMVSNVNEKNGSVELDIIFKSEGPKRLLAQFAPITKKEDS

SEQ ID NO: 6231 - protein, 65 aa, Staphylococcus epidermidis
NLERKIGFTPISHSGKECVLRVELLPHNNLEAATGFEPVIKVLQTSALPLGYAANNWASWIRTSA

SEQ ID NO: 6232 - protein, 311 aa, Staphylococcus epidermidis
SHILSVYIYNLIVTTVIKKINFIIFGGYHMKKRFLSICTMTIAALATTTMVNTSYAKTDTESHNHSSLGTENKNVLDINSSSHNIKPSQNKSYPSVILPNNNRHQIFNTTQGHYDAVSFIYIPIDGGYMSGSGVVVGENEILTNKHVVNGAKGNPRNISVHPSAKNENDYPNGKFVGQEIIPYPGNSDLAILRVSPNEHNQHIGQVVKPATISSNTDTRINENITVTGYPGDKPLATMWESVGKVVYIGGEELRYDLSTVGGNSGSPVFNGKNQVIGIHYGGVDNKYNSSVYINDFVQQFLRNNIPDINIQ

SEQ ID NO: 6233 - protein, 268 aa, Staphylococcus epidermidis
NDRRVNILKIQILQFNVERGNVDKNMQNIKTKFNQYLDKDTSVVVLPEMWNNGYALEELEQKADKNLKDSSLFIKDLAHTFNVDIIAGSVSNIRENHIYNTAFAINKNKELINEYDKVHLVPMLREPDFLCGGNVVPEPFYLSDQTLVTQIICYDLRFPEILRYPARKGAKIAFYVAQWPSSRLDHWLSLLKARAIENDIFIVACNSCGDDGHTNYAGNSIVINPNGEILGHLDDKEGVLTTHIDVDLVDQQREYIPVFRNLKPHLYK

SEQ ID NO: 6234 - protein, 582 aa, Staphylococcus epidermidis
EGRRMIKRYLKFVKPYRYRIIATIIVGIIKFGIPMLIPLLIKYAIDGVINNHSLTNQEKFSHLGVAIGIALFIFLIVRPPIEFIRQYLAQWTSNKILYDIRKQLYNHLQALSVRFYANNQVGQVISRVINDVEQTKDFILTGLMNIWLDCITIIIALSIMFFLDVKLTFAAIFIFPFYILTVYFFFGRLRKLTRVRSQALAEVQGFLHERVQGMSVIKSFAIEDNEAKNFDNHNKNFLQRAFQHTRWNAYSFAAINTVTDLGPIIVIGVGSYLAITGSITVGTLAAFVGYLEQLFGPLRRLVSSFTTLTQSFASMDRVFQLMDEDYDIKNGIGAQPIKISKGQIDLKHVSFKYNENEKEVLHDINLTINKGETVAFVGMSGGGKSTLINLIPRFYDVTQGEILIDHHNVKDFLTGSLRNQIGLVQQDNILFSDTVKENILLGRPDATDDEVVEAAKMANAHDFISNLPNGYDTEVGERGVKLSGGQKQRLSIARIFLNNPPVLILDEATSALDLESEAIIQEALDVLSKDRTTLIVAHRLSTITHADRIVVMENGRIVETGTHQQLINKRGAYEHLYSIQNL

SEQ ID NO: 6235 - protein, 43 aa, Staphylococcus epidermidis
HIIRCFIKDFEFYIPTLCTKKGVKQISSCPTPLNLFSYRLNMF

SEQ ID NO: 6236 - protein, 43 aa, Staphylococcus epidermidis
SRELGRDSRLDNLLLRECFYSYFFNLFFGDVINYEKILVNLSI

SEQ ID NO: 6237 - protein, 45 aa, Staphylococcus epidermidis
WSRSVAVNTPACHAGDRGFDSRRDRHLLNFNSYLPIICGGIPKSG

SEQ ID NO: 6238 - protein, 59 aa, Staphylococcus epidermidis
SARRRFFKSDVKAHGSTVEGHWKLENLSAEEESGIPCVAVKCAEIWRNTSGEGDFLVCN

SEQ ID NO: 6239 - protein, 68 aa, Staphylococcus epidermidis; identical to SEQ ID NO: 3866

SEQ ID NO: 6240 - protein, 137 aa, Staphylococcus epidermidis
SLISDEVISLNILDLYLQQFIKRITKKSINDYKMSLDKQIKNIDTYINYLREKRLQLKKLIDTLTLSLENKYIDLVNNQAIYCAEEIHDNDIDMIKSQLNDAESYYARIEADINLQSRMKITTEEAFHFIYHMSAVA

SEQ ID NO: 6241 - protein, 43 aa, Staphylococcus epidermidis
LVISRLGVQVLWPAPSFEPLAQLVEHLTFNQRVRGSNPLWLTI

SEQ ID NO: 6242 - protein, 196 aa, Staphylococcus epidermidis
MGRLILVIRSDDMDKLTPKQERFANEYIKTLNVTQSAIKAGYSPNSAHVTGSRLLRKEKVDKYIKSKKDEIMDDTILSAKELLYLLTQAAVGDETETKEAVVKKGTFERNPDSGRMNLVYNEHVETVEIPIKPSDRLKARDLLGRYHSLFTEKVDLNVATPVFIDSIDEDDEKNERDIENLSKQYPNAEFHIDDIR

SEQ ID NO: 6243 - protein, 40 aa, Staphylococcus epidermidis
IKIRFFYIITKLFSIANNNYSNLDIVIVVLINNYSNLINE

SEQ ID NO: 6244 - protein, 45 aa, Staphylococcus epidermidis
REQRWQYRDFKTGYYICRCFNPINMINYRMLKPRTLTIVLGIFMH

SEQ ID NO: 6245 - protein, 506 aa, Staphylococcus epidermidis
LMGSSIVLKLLKVTHYYRNHNSKKWYRPLGYDAEDINLNNISLHIYQGEALGIIGEPGSSKTLIGRILSGSVKPDKGKVVRTKNLYFGDIDDRKINNLTVSQYVSELVQLFPYEVTEHKVEQIIQWAHLGDYIEEKVSNLSEKSYAQLLLSIARSSKNDIIILNHVLSHLDETFIERATVLSKDYIEANKTLVLIDNDVEKISKTSNYITWVSHGQIRKEGSLNQVLPTFREHEKDRTSLKSEMEIENFDYDWKQNRSRIPEMTYNFKRIERYNHAKPPRFLVRFWTLFVSFLIGLVLMSVLFFNNLGMVKLGNINTQASIQNQNKDTYEEKLAYGLALDGSVTLNGSKDLKVPKYSLITITGENNKRYRVEMNQRRYSVSKNQVFYFNPAGLYESHTFKKLSPYIKSNYSTYVEYFNSHLHQKHDKVTETLRPDKDKKYVVPITQQPIKMIFGDNDKLSGFVIPMTNKTELKKTFNITKDVWITKSGSGYFIADMKEEKWIYIEL

SEQ ID NO: 6246 - protein, 193 aa, Staphylococcus epidermidis
FRLRACVNMDKITFLNELELALDDLPREEKDSIMHKYENLFYEEELKGISESQIIKKLNDPYHISKEVKARSAIHYASYKPTLANIVRAILASLSLGILSLFIILIPVVIIALLILFCFLISICFIFAPFVLLFYSVLHGFENAISNVFFSISFTGLGIMFIVITLKIGEIIHKLILKYLLWYIKTVKGSVKE

SEQ ID NO: 6247 - protein, 44 aa, Staphylococcus epidermidis
NAQRYGGTPVAKATFWSVTDADVRKRGDQTGLDTLVVHAVNDEC

SEQ ID NO: 6248 - protein, 244 aa, Staphylococcus epidermidis
IMKSLQLVKYDLISILKSPYTYLAFILVIGMTVFQASMMANYSSAHKVNIDMVFNLANWLFLFAGLLFIIKTITRDYSQGTIQLFMSRITSRMGYIITKTVSIVLISFLFTIIHYLVIIIIQSTTKSEKMDGDRFLNNIWFYLIFFLFFGLFLLLITLIVEKPAVIFTLGIFLILIVPFIQPFIPMIPNIGDDIQDSFKYIPFTYLTEKMTGEIKFSNWQWFISIASIVVLFIANMLYASKRDI

SEQ ID NO: 6249 - protein, 215 aa, Staphylococcus epidermidis
IRRRIQVAIKVLFVDDHEMVRIGISSYLSTQEDIEVVGEGASGKDAITKAHELKPDLILMDLLMDDMDGVEATTEIKKDLPQIKVVMLTSFIEDKEVYRALDSGVDSYILKTTSASDIADAVRKTYEGESVFEPEVLVKMRNRMKKRAELYEMLTEREMEILLLIAKGYSNQEIASASHITIKTVKTHVSNILSKLEVQDRTQAVIYAFQHNLIQ

SEQ ID NO: 6250 - protein, 46 aa, Staphylococcus epidermidis
VLSGLDSIHDKFMLNKVKVFKTLAKSPGLSYLGVIRKIVVFGCSIK

SEQ ID NO: 6251 - protein, 68 aa, Staphylococcus epidermidis
YLGGKMIKLTNPAVTSPIRAVSNREKKLNTYASCIPGIIATEVNTATVVPTCKLSLVHIRMVNVALKA

SEQ ID NO: 6252 - protein, 167 aa, Staphylococcus epidermidis
YNILNYSREGFYIRNLETYFNKSQTLNEFINKIQESKDNLLSIYNFFHLPLNDARLNQLRESNYYKVLIIKEDWCGDAMMNIPILKHTIEFLNIIARVFHRDDDTHLIDQYLTNGKSRAIPIFVFMNDSFEQLTVWRPRAKKYKVLSIKLEVINCQIKPILILIFTQ

SEQ ID NO: 6253 - protein, 666 aa, Staphylococcus epidermidis
GMQGVKKRVEKLHDLLNQYSYEYYVQDNPSVPDSEYDKLLHELIEIEEKYPEFKSTDSPTVRVGGEAQSSFEKVNHDTPMLSLGNAFNEEDLRKFDQRIRDSIGKVEYMCELKIDGLAVSLKYENGRFVQGLTRGDGTTGEDITENLRTIHAIPLKIKEPLNFEVRGEAYMPRRSFIHLNNEKEQNGEQPFANPRNAAAGSLRQLDSKLAAKRKLSVFLYSVNDLTEFNATTQSEALEELDQLGFKTNQERERVSDIEGVLNYIEKWTSKRGSLSYDIDGIVIKVNDLSQQEEMGYTQKSPRWAIAYKFPAEEVITKLLDIELSIGRTGVVTPTAILEPVKVAGTTVSRASLHNEDLIHERDIRIGDSVVIKKAGDIIPEVVKSILDRRPNESEIYHMPTHCPSCGHELVRIEGEVALRCINPKCQAQLIEGLIHFVSRQAMNIDGLGTKIIHQLYENQLIKDVADIFYLKEEDLLPLERMGKKKVDNLLLAIEKSKEQSLEHLLFGLGIRHLGVKASQVLAERYETMDQLFKVTESELIEIQDIGDKLAQSVVTYLENSDIRSLIEKLSNKNVNMSYKGIKTTEIEGHPDFSGKTIVLTGKLEQMTRNEASEWLKMQGAKVTNSVTKSTDIVIAGADAGSKLAKAEKYGTEIWTEAAFIEKQNGI

SEQ ID NO: 6254 - protein, 273 aa, Staphylococcus epidermidis
FKRGGIMHLYYLGPKGTFSYLAAKQFESHEQYDFIPLSNLHEVIQSVSKDKQAVGIVPIENSIEGTINIVADSLAHHDVYAHGEIQLDIDFSLYGHHSNSLDDIHKVYSIAPAISQTINYIHRQQFDYDYVDSTIQSLNMIKDGIGAIAPLGSGETYGYHTLDQHIQDYPHNVTRFLVVKNHTHFIEHPNTTIFLITPKYDKPGLLASVLNTFTLFNINLSWIESRPLKTQLGMYHFYVQADTAINNDVNKIISILETLDFQVKIIGAFNKKN

SEQ ID NO: 6255 - protein, 186 aa, Staphylococcus epidermidis
RTGGVNVHKIDLSGNKFQIQRFVLLQIVLALFTILFTYKWAYQTTHIIEQNLVMNLIFGFVGFAVLVILHEFIHRILFIIFSKGEKPSLKYDKNKIIVQFSQTCFHRWQFTIIMIAPLVIISATLLALIQIYSFSSLIFMFSIHTSYCMIDVFLVALALQSKFKYIQTYGEGLYLYHQKPTQTYYE

SEQ ID NO: 6256 - protein, 348 aa, Staphylococcus epidermidis
FYGGFGMTLGYIGSYTKKSGKGIYRFKLNDETGVIEALETGYEIEASTYLTRNESFLYAITKEGEECGVASFSIKEDGQLELINKCLASKQGTGCYIQVSSNGKYLFEAVYGAGLARIYKLNPITGAIEKLIEELEHEFPTGSHERQDSSHVHFLNETPDHKYVVATDLGTDRVVTYKFGEDGLKQYAVSQFKNSDGPRHIAFSNDGRHAYIVHELSNEVSVTEYQDGKFIELERHSTIPSDFNGESKLAAVRLSHDGKHLYISNRGHDSIAIFEVLEDGRSLRSIEIQPSYDAFPRDFNITESDNYLICAHQEGESKVSIFERDNITGKLSLKDKKAIANEGVCVLL

SEQ ID NO: 6257 - protein, 56 aa, Staphylococcus epidermidis
DGGGGQIRTAEPEGADLQSAAFSHFATPPKWCRPEDLNPQPTDYKSVALPIELGRL

SEQ ID NO: 6258 - protein, 54 aa, Staphylococcus epidermidis
NELGVCLNIINWGDYDLWLTQIEKAKKCQMLNASKQDRYIHKIPIIITQCSVEL

SEQ ID NO: 6259 - protein, 187 aa, Staphylococcus epidermidis
IEMGKLGQQIIGYHCNDEVKIDKFKNREVSLLISYEDDIWLGNGMYFWENKSNLDYWKRNRERNYPDKNFSSVEVMLSLDFLLDLSDKEHRKFCKKVLSDLIERGKDNGIDESIFNNDLGEVINVLFSKTDILASHFNVLRTHGLYNWSEDKFLVGNDNKYQSVNRPTSNVKTIYCVKNERAILEIL

SEQ ID NO: 6260 - protein, 44 aa, Staphylococcus epidermidis
RAAGVRIPLPPPLIISAGWSSSVARRAHNPKVGGSNPPPAILLI

SEQ ID NO: 6261 - protein, 518 aa, Staphylococcus epidermidis
LIKGVLIMLTLGTALSNQIDANWQTYVMIIVYFIILLIIGFYGYRQATGNLSEFMLGGRSIGPYITALSAGASDMSGWMIMGLPGSVYSTGLSAIWITIGLTLGAYINYFVVAPRLRVYTEIAGDAITLPDFFKNRLDDKKNIIKIISGLIIVVFFTLYTHSGFVSGGKLFESAFGLNYHAGLLIVAIIVIFYTFFGGYLAVSITDFFQGVIMLIAMVMVPIVALLKLNGWDTFHDIAQMKPTNLDLFRGTTVLGIVSLFSWGLGYFGQPHIIVRFMSIKSHKLLPKARRLGISWMAVGLLGAIGVGLTGISFISERHIKLEDPETLFIVMSQILFHPLVGGFLLAAILAAIMSTISSQLLVTSSSLTEDFYKLIRGSDKASSHQKEFVLIGRLSVLLVAIVAITIAWHPNDTILNLVGNAWAGFGAAFSPLVLYSLYWKDLTRAGAISGMVAGAVVVIVWISWIKPLATINAFFGMYEIIPGFIVSVLITYIVSKLTKKPDDYVIENLNKVKHVVKE

SEQ ID NO: 6262 - protein, 238 aa, Staphylococcus epidermidis
MKIFVCEDDQRQREHMVSIIKNYIMIEEKPMELALATNDPYEVLEQSKELNDIGCYFLDIQLEADMNGIKLASEIRKHDPVGNIIFVTSHSELTYLTFVYKVAAMDFIFKDDPSELKMRIIDCLETAHTRLKLLSKESNVDTIELKRGSNSVYVQYDDIMFFESSTKSHRLIAHLDNRQIEFYGNLKELAQLDERFFRCHNSFVINRHNIESIDSKERIVYFKNGENCFASVRNVKKI

SEQ ID NO: 6263 - protein, 69 aa, Staphylococcus epidermidis
DNIIVVNTSKKEFQYLMSEQQTIDQIKTRLNKFIEDIDHVNPDEVRVEDIDEWIGLLDQLEEKVKQVSK

SEQ ID NO: 6264 - protein, 175 aa, Staphylococcus epidermidis
CHIMAKKVAIILADEFEDIELTSPKEALENAGFETEVIGDTANHEVVGKHGEKVTVDVSIADAKPENYDALLIPGGFSPDHLRGDEEGRYGTFAKYFTKNDVPTFAICHGPLVLVDTDDLKGRTITGVINVRKDLSNAGANVVDESVVVDNNIVTSRVPDDLDDFNREIVKKLEA

SEQ ID NO: 6265 - protein, 222 aa, Staphylococcus epidermidis
DLTMKQLMIRNLKLRTWTLIIYALLLLFFPIYHLLNKDTPLYSIISGPIGLILTMICLIDIGHLFRVNRRLRGSSSYYFFYSLPVSKRDLLNANYMTCILLTFIGELIISLYGYYTSTIKTDSIYFSTTFSFIVGNFFSIPIAFSKSTERKDRDIPYIAYIVGIMVVLPFTLSVIFILINYLTHNDSHIPMIYSYFLNYGLLVVSSIFLVINYLIQIKKIKY

SEQ ID NO: 6266 - protein, 466 aa, Staphylococcus epidermidis
FFYILELTKDCNGEVVEFMKKFNIKHSFMLTGFAFMVTTSLFSHQAHAEGNHPIDINFFKDQIDRNTAKSNIINRVNDTSRTGISMNSDNDLDTDIVSNSDSENDTYLDSDSDSDSDLDSDSDSDSDSDSDSDSDSDSDSDSDSDSDSDSDSDSDSDSDSDSDSDSDSDSDSDSDSDSDSDSDSDSDSDSDSGTSSGKGSHTGKKPGNPKGNTNRPSQRHTNQPQRPKYNQTNQNNINHNINHTRTSGDSAPFKRQQNIINSNLGHRNQNNINQFIWNKNGFFKSQNNTEHRLNSSDNTNSLISRFRQLATGAYKYNPFLINQVKNLNQLDGKVTDSDIYSLFRKQSFRGNEYLNSLQKGTSYFRFQYFNPLNSSKYYENLDDQVLALITGEIGSMPELKKPTDKEDKNHSAFKNHSADEITTNNDGHSKDYDKKKKIHRSLLSLSIAIIGIFLGVTGLYIFRRKK

SEQ ID NO: 6267 - protein, 50 aa, Staphylococcus epidermidis
QAYISKLIIDLKISFLIFHLVSIVIKNLIKICNYIHITTYVEKDRTMNLF

SEQ ID NO: 6268 - protein, 41 aa, Staphylococcus epidermidis
VFNIEKVWIVHPHSMTNYSLILFLNNPNKPNPVSNIIKAGF

SEQ ID NO: 6269 - protein, 608 aa, Staphylococcus epidermidis
INNITIVIFASIVYYKYLKEGVEMAKLLIMSIVSFCFIFLLLLFFRYILKRYFNYMLNYKVWYLTLLAGLIPFIPIKFSFFKFNNLNNQEPTVESNSHNLNPNINTTKPVHEFTTDIHKFNWDSIDNICTVIWIVLVIILSFKFLNSLLYLKYLKKQSLYLNEKEKDKINKILFNHQYKRNIVIRKAESIHSPITFWYGKYIILIPSLYFKSINDKKLKYIILHEYAHAKNRDTLHLIIFHIFSIAMSYNPLIQIVKRKMIHDNEVEADRFVLNNINKNEFKSYAEAIMDSVLKTSFFNKNILSHSFNGKKSLLKRRLINIKEGNLKKQSKLILIFICIFTFFIMIIQSQFLMGQSLTDYNYKKPLQSDYQILDESKNFGSNSGSFVMYSMKKDKYYIYNEKESRKRYSPDSTYKIYLALFGLDRHIISDKNSRMSWNHNHYPFDSWNKDQDLNTAIQNSVNWYFERISNQLSKNYTSDQLKQLNYGNKNLGSYKAYWLEDSLKISNLEQVIVLKNMMEQNNHFSKNEKKQLSSSLLIRKNENYELYGKTGTGIVNGKYNNGWFVGYVITNHDKYYFSTHLSDEKASGENAKFINEKILKEMGVLNGQ

SEQ ID NO: 6270 - protein, 44 aa, Staphylococcus epidermidis; identical to SEQ ID NO: 3889

SEQ ID NO: 6271 - protein, 355 aa, Staphylococcus epidermidis
SKNIRRDYKMQKVRSDIMTHRGSHYDLGVKTALWLQTTPLLKNRNKEWRKRIPRFDIDVKETYDIFQIYSPQIWEEIIGMQDVLNLPTKQMILNFGHYRFTDLKDSGCTVYKGRDFLVRNYDYHPATYDGRYLLFQPNDGGLSQIGPTSRVTGRMDGMNEYGLVMAYNFMHRKKPANGFVCYMVGRLILENCKNVTEAIKFLKEVPHRSSFSYILMDRHSNYAIVEVTPRSIDVRYEHICTNHFELLTHENRNYTRESKERLNRVINKTTPSTNKDIAFKLFNDPQYEIYSNLFKSWSGTIHTSLYEPNSLIAWMALGQNSHPTSINFSNWLKGKKLNINYFEGEIDTPLTFATY

SEQ ID NO: 6272 - protein, 128 aa, Staphylococcus epidermidis
NKSIEVKMEKFNRQEQLKQLHAERKVKTEKKVDKAINDLVQKNKEINFNIVSKHSKVSKATLYKNNKIRKKIEKLREQNREIFVHKNKNDGKDALISSLKRKVNSLEKEKKMLKEEISVLYSRLYEDI

SEQ ID NO: 6273 - protein, 460 aa, Staphylococcus epidermidis
LRIFFVIPFTCYNYSSANWRRKRMRQWTATHMAKLARKASIAVGKKGTDLPGQIARRVDHNILRKLAKQVDDIVFISGTNGKTTTSNLIGHTLKKNQINIIHNNEGANMAAGITSAFIMQSSKNTNIAIIEIDEGSIPRVLNEVTPSMMVFTNFFRDQMDRFGEIDIMVDNIAKSISNKGIKLLLNADDPFVSRLKIASHSIVYYGMKKFAHDFEQSTMNESKYCPNCGRLLQYDYIHYNQIGHYHCECGFKREEPTYEVSSFDASPFLKMIINQSEFNMKIAGDFNSYNAIAAYTVLRELGLNDDAIRKGFETYTSDNGRMQYFSKNKKEAMINLAKNPAGMNASLSVGEQIDDKKIYVISLNDNAADGRDISWIYDADFEKLATQDIEAIIVSGTRAEELQLRLKLAEVEVPIKVEKDIYKATALTMKYSSFTVAIPNYTSLTPMLEQLNRSFEGGQS

SEQ ID NO: 6274 - protein, 41 aa, Staphylococcus epidermidis
YNIIHKWLIKYCFYKLIPLYSFHFYLFSRLISKLRHSFLIL

SEQ ID NO: 6275 - protein, 101 aa, Staphylococcus epidermidis
SDLIKYLDQIYEIKSDIIIIKIIDKHQFSLAESTKSLNHLIFLFLYIYAYIIIARSIIIFINLMLLLSTFFNFSVGLQKSINTVYELSNIYVKNKGIIKKR

SEQ ID NO: 6276 - protein, 285 aa, Staphylococcus epidermidis
CVIIYVRKTFEYRSRDSKMPKVTKIEVQKKNKERFNLFLDGEFEMGIDIDTLVKFNLKKDQILEPSDMQNIQEYDHYRRGVNLAIQYLSYKKRTEREVIQYLEKNDIQSNAIQDVIDYCYKEKFIDHEDYAESLKNTMIHTTDKGPEIYRQKLYQLGIEVTIIEKYVEAYEQQQPLDDVIKVAEKVMKSKKGPEAKVKQKVTQSLLQKGYKFETIQLVMNEIDFSQDEETLDHLLQRDLEKVYNKNCRKYDSDKSVIKTIEALMRKGYNYDKIKSKLEESGISNE

SEQ ID NO: 6277 - protein, 193 aa, Staphylococcus epidermidis
RKIIERNEIMVQNAFVALDFETANSKRTSICSVGMVKVIDNQITESFHTLVNPFDYFTETNITVHGIHPEDVQDAPGFKHVYPYMLKFIDQLPVVAHNAAFDMNVLHQSLKSHNIDTPSLTYFCSYQLAKRTINAYRYGLKHLMNHYHLDFHGHHDALNDAKACAMITYRLLKHYDDLQSMLSIYGKNLKDKG

SEQ ID NO: 6278 - protein, 381 aa, Staphylococcus epidermidis
IMIISNKSPISINNDPWEAYNDILEHNQLTLSNIEFTTTNLCNMRCSHCAVGYTLQTKDPDPLPMDIIYRRLDEIPNLRTLSITGGEPMFSKKSIKNVVKPLLKYAKHRGIYVQMNSNLTLPQDRYLDIAEYIDVMHISHNWGTIQEFTDVGFGAMRKQPPLKAKLKLYEQMLENSSTLSDQGMFVSAETMLNQSTVPYLSKIHNEVVNDMKCSRHEIHPMYPSDFASQLNVLSLKEMKEAIHHLLDIRDENTWMLFGTLPIYPCLNDEYDQHLLQRLRKSKNVTMRNDPDGRSRLNVNVFTGDVIVTDFGDENGTISNIQKDKLTDVFNQWLNTDLAQSLNCHCAEYQCLGPNVLVKNMYYPNTDFKKKEQIMHQHQIFS

SEQ ID NO: 6279 - protein, 59 aa, Staphylococcus epidermidis
NHKIGTILRFYFYYFHNNLISNFNSISIHYSNSFYIIHIKLITRNKKRLFNIFTLFIFS

SEQ ID NO: 6280 - protein, 52 aa, Staphylococcus epidermidis
ELKISTKTCKNTASCAHNHTCKGFVWLNITNIKNVINIGHNIVKGNECVIPL

SEQ ID NO: 6281 - protein, 479 aa, Staphylococcus epidermidis
GVEIMHFETVIGLEVHVELKTDSKMFSPSPAHFGAEPNSNTNVIDLAYPGVLPVVNRRAVDWAMRASMALNMDIATNSKFDRKNYFYPDNPKAYQISQFDQPIGENGYIDIEVDGETKRIGITRLHMEEDAGKSTHKDGYSLVDLNRQGTPLIEIVSEPDIRSPKEAYAYLEKLRSIIQYTGVSDCKMEEGSLRCDANISLRPYGQKEFGTKTELKNLNSFNYVKKGLEYEEKRQEEELLNGGEIGQETRRFDESTGKTILMRVKEGSDDYRYFPEPDIVPLYVDEDWKARVRETIPELPDERKAKYVNDLGLPEYDAHVLTLTKEMSDFFEGAIDHGADVKLTSNWLMGGVNEYLNKNQVELKDTQLTPENLAGMIKLIEDGTMSSKIAKKVFPELAENGGDAKQIMEDKGLVQISDEATLLKFVTDALDNNPQSIEDYKNGKGKAMGFLVGQIMKASKGQANPQKVNSLLKQELDNR

SEQ ID NO: 6282 - protein, 159 aa, Staphylococcus epidermidis
FGVILMIHVAFVCLGNICRSPMAEAIMRQRLQERGISDIKVHSRGTGRWNLGEPPHNGTQKILQKYHIPYDGMVSELFEPDDDFDYIIAMDQSNVDNIKQINPNLQGQLFKLLEFSNMEESDVPDPYYTNNFEGVFEMVQSSCDNLIDYIVKDANLKER

SEQ ID NO: 6283 - protein, 359 aa, Staphylococcus epidermidis
GESMTERRIIHIDMDYFFAQVEMRDNPKLKGKPVIVGGKASHRGVVSTASYEARAYGVHSAMPMTQAHKLCPNGYYVTSRFDTYREVSGQIMKIFRSYTELVEPMSLDEAYLDITHLVRPDLPASTIANYIRRDIYEVTSLTASAGVSYNKFLAKLASGMNKPNGLTVIDYNNVHEILMQLDIGDFPGVGKASKKKMHQHHIYTGQDLYNKDEFELIRLFGKRGRGLYNKARGIDHNEVKASRVRKSVGTERTFSTDVNDDDVILRKIRELSGKTAERLNKIQKSGKTVTVKIKTYQYETISKQKSLRDPIRTETDIYNIAYTLYNDLKDPEIPIRLIGVTVGSLEQSDFKNLTIYDFI

SEQ ID NO: 6284 - protein, 45 aa, Staphylococcus epidermidis
FSKIFCLATSYSSVTSVRLPSALRSLTSVFGMGTGVTSLPLSPDK

SEQ ID NO: 6285 - protein, 56 aa, Staphylococcus epidermidis
MKHLTKIFVGLAIVLFIVGYYLQATDHDSQGIKLLLAAIMFMICAFINRHNERKKK

SEQ ID NO: 6286 - protein, 144 aa, Staphylococcus epidermidis
ISFVLPVSGNLSCTSLLLSFLEVVVISSSLSFLVIFVSFSSLPLFGITGLFSSLSFFKVFVIFFSLSFFGVFVSSSFSTLPLLGITGFFSSLSFFGVFMSFFSLSFFGVFVSLDSFSSLSFFSVFVSSSFSFLVICVFVTEVFA

SEQ ID NO: 6287 - protein, 40 aa, Staphylococcus epidermidis
TQVVISKISFTYQNSVFYHLFNAIKKTVEKVKNFNNSLNQ

SEQ ID NO: 6288 - protein, 300 aa, Staphylococcus epidermidis
ALNVGKISISVFLKLLNTLKRWRMKMSRLQDVVVNEMKVKKQIDSVEEIQEIKQFIKAYVKSHSFIQTLVLGISGGQDSTLTGKLAQLAVNELKEEGRNCKFIAVKLPYGVQQDAHEVEDALEFINPDTTYTVNIKPAVDQSVQSLSEAGIKLTDFQKGNEKARERMKVQFSIASNTQGIVLGTDHSAENITGFYTKYGDGAADIAPIFGLNKRQGKQLLAYLGAPKHLYEKVPTADLEDDKPQLPDEEALGVSYHDIDDYLEGKEIPGTARETIEKHYVRNAHKRELAYTRYSWPKYNK

SEQ ID NO: 6289 - protein, 281 aa, Staphylococcus epidermidis
IVGVKMIDNLIVYIKNLPHLFSFCTQRLKQTWKWFAISLIIGLVIILALEGFFNFNHTTDIVQVRWLFRISSFIIFSIIIQSIYIAYKYYIRDFVVMKSFHISAVTPTIVIAMLGLITILILGIVIIILKPVNFEASILSFLYYLVILAIFISVTSIILGLLSYAIKHVKLIFIIVSAISFFMVPITYIPNTNLNVVNHIMMLNPLYYFVNGSSQAIVFGTISMSNLPYHLYIIILIGIICVINYALVRHIAFDKYQNQSNQKNYSKKNKEKECLNVKLDK

SEQ ID NO: 6290 - protein, 258 aa, Staphylococcus epidermidis
HQCLNNLIAHLKEGNRKMNELTVYHFMSDKLNLYSDIGNIMALKQRAKKRNIKINVKEINETEGVTFDDCDIFFIGGGSDREQALATKELSKIKTSLKNAIEDGMPGLTICGGYQFLGHKYITPDGTELEGLGVLDFYTESKKERLTGDIIIESDTFGTIVGFENHGGRTYHPYGTLGRVTYGYGNNDNDRKEGIHYKNLLGSYLHGPILPKNHEITDYLLEKACERKGILFEPKKIDNTEEEAAKQVLIKRAKENKK

SEQ ID NO: 6291 - protein, 118 aa, Staphylococcus epidermidis
IQIVIQIQIVIQIQTVTQIQIVTQIQIVTQIQTVIQTQIVTQIQTVIQTQIVIQIQIVIQIQTVIQIQIVIQTLVQVQVRVHIPEKNLVTLKEIQIDLLKDIRINPKGLNTIKQIKTI

SEQ ID NO: 6292 - protein, 205 aa, Staphylococcus epidermidis
KNKVLTFLRRSMMKLQHITKKYGQNTVLDDIDFDFGESQIVGLIGKNGVGKTTLMKVMNNNIINYQGKVDMPKSENVGYLIEHPKLYGNKTGLFNLKLFAQVLGDGFDKEYANHIIEAFGMKPYIKKKVNKYSMGMKQKLSIAVSLMNKPKYLILDEPTNGMDPDGSIDVLKTIQSLVQQLEMKILISSHKLEDIELICDRAVFP

SEQ ID NO: 6293 - protein, 178 aa, Staphylococcus epidermidis
HLGVEQRYAVIQLKTKYNATFLKSEFDKWEQHIEDMYALHYPRMFIDPYTMQLSYESNHIEDLALSIIEEREKLEKFKHKSNHDLKKFNIILSNYSDSEQRQIKRYQRDDILADESLILRICEDISNIDSKDKNNRNTAIQEEIKADKERRRAEGKARKERIKARMKRARQEKLLQAN

SEQ ID NO: 6294 - protein, 110 aa, Staphylococcus epidermidis
KKAVYLMNKKKMSEMSEQELRHEIQLFKEKMRKAEMNGIMNEYDVYQSKVIIAESYLVDRNKIEPGKIYKLNDGSKQYFKVERLKGVFAWGFRINSSEPEEGLPLALLKF

SEQ ID NO: 6295 - protein, 124 aa, Staphylococcus epidermidis
GYQVFFRYVNPYLNLYQSLNHYLNLNHCLNLNHYLNLNHYLSLNHCLNLSHYLSLNHCLNLSHYLNLSHYLNLSHCLNLNHYLNLNHYLNLSHYLSLNHYLNMCHFLSHYLKRYLYLNHYPNSY

SEQ ID NO: 6296 - protein, 43 aa, Staphylococcus epidermidis
YKLFDPLIYQDRVEFLISMWQKLMVYLFRLQSNLYSISFLLTN

SEQ ID NO: 6297 - protein, 155 aa, Staphylococcus epidermidis
EGLFVFPLGLPGFFPVCEPLPELVPESESLSESESLSESESLSESESLSESESLSESESLSESESLSESESLSESESLSESESLSESESLSESESLSESKSLSESESLSKYVSFSESLFETISVSKSLSEFILIPVRLVSFTRLIILLLAVFLSI

SEQ ID NO: 6298 - protein, 46 aa, Staphylococcus epidermidis
VIILYDTHLFGRCSIMTWWQDGIITLITGGILIVFRIWLEIKWKGK

SEQ ID NO: 6299 - protein, 315 aa, Staphylococcus epidermidis
LKILNKKRLIDMKFTESERLQQLSNEYILGGVNSPSRSYKAVGGGAPVVMKEGHGAYLYDVDGNKYIDYLQAYGPIITGHAHPHITEAIQDQAAKGVLYGTPTELEINFSKKLREAVPSLEKIRFVNSGTEAVMTTIRVARAYTKRNKIIKFAGSYHGHSDLVLVAAGSGPSQLGSPDSAGVPQSVAQEVITVPFNDIESYREAIDYWKDDIAAVLVEPIVGNFGMVMPQPGFLEEVYKISHDNGTLVIYDEVITAFSFHYGAAQDLLGVKPYLTAFGKIVGGGLPIGGYGGRQDIMEHVAPFTSSLIQQGTMGG

SEQ ID NO: 6300 - protein, 58 aa, Staphylococcus epidermidis
IYSLSYSNFNFYLKKSKEFVTYHILIPNIIIKINLLRFQIYIFHHCMYLILFYKFCVQ

SEQ ID NO: 6301 - protein, 59 aa, Staphylococcus epidermidis
PQPLENDIYYRDIQMLHVSLVSLQTMYLYAHFIYYLNNKKVLNLTFYQSLTNYDNLIEY

SEQ ID NO: 6302 - protein, 473 aa, Staphylococcus epidermidis
KKKLAFYILGCMRIFKIMDNKIEKILEDINKLQGYKVTYQYATAINIKDNNMNPWFEKIEEILLNVKGVIRILSPDNPPVNYDYWILPGRYKRHTKEYHEKLEKFLEKFATNANINDGLFDQNNIHGYKYKKYIFTPHIEITHENTLNLFFLTLTIFNNGTFVIEIIEDLESINFGSDLYSTFSCVKDKIYPLINQEKNNRQRQYQFYGNRHCKNIRDVSRQINRIIKINSKDIFEYKVSKNMGFEVYYLANENEFTDDPFYEDVKIQEWLVNAPIFSFEGKSKHFRQDGYSDNYINFLNKASVFVVWMDEQEEDVLEKCSQMALYFNSSANFFFLETMLNELQLYGYQQYNLNGKKEALYFRQWILNFKRSIAIIYRTELLPSLYLYLYLKNNNDFKSPQYIEELNKEELSLIELEQSYKEEERSEKLNKLLLIISLLSIFQVVEIFFSDKNNIFNISMILIMILLEVFRKR

SEQ ID NO: 6303 - protein, 324 aa, Staphylococcus epidermidis
VYEFEGLTMRKRARIIYNPTSGKELFKRVLPDALIKLEKAGYETSAYATEKIGDATFEAERALESEYDLLIAAGGDGTLNEVVNGIAEQPNRPKLGVIPMGTVNDFGRALHLPSDIMGAIDVIIDGHTTKVDIGKMNNRYFINLAAGGKLTQVSYETPSKLKSIVGPFAYYIKGFEMLPQMKAVDVRIEYDDNIFQGEALLFLLGLTNSMAGFEKLVPDAKLDDGYFTLIIVEKANLAELGHIMTLASRGEHTKHPKVIYAKAKSINISSFTDMQLNVDGEYGGKLPANFLNLEQHIEIFTPKDVFNEELLENDTITDITPDKQ

SEQ ID NO: 6304 - protein, 41 aa, Staphylococcus epidermidis
AFPSKTLKKMWKVGCVEMKKQCLLYLYVAPLDIHLGNVNVH

SEQ ID NO: 6305 - protein, 78 aa, Staphylococcus epidermidis
GGISMVHELGTVGMVCPFPLIEAQKKMNQLNQGDELKIDFDCTQATEALPNWAAENGYPVTNYEQLDDASWTITIQKA

SEQ ID NO: 6306 - protein, 99 aa, Staphylococcus epidermidis; identical to SEQ ID NO: 3780

SEQ ID NO: 6307 - protein, 47 aa, Staphylococcus epidermidis
RYCTSPCLLVNFSCHILSLLNKKGRSATHYIIRYLIHYIRLLICYNH

SEQ ID NO: 6308 - protein, 154 aa, Staphylococcus epidermidis
KLITIHNLNEMDKFAQILVKHLSAKDLILLNGDLGAGKTTLTQFIGKALGVKRTINSPTFNIIKSYKGSSIRLHHMDCYRLEGEEDDLGFDEYFEDNAIIVIEWSKFIKDFLPPNHLTINISVKNANERQVSIETHGQHYALVKEAILNELSSN

SEQ ID NO: 6309 - protein, 82 aa, Staphylococcus epidermidis
NGGLLMERTIHFTLVDQVSTLNRITSAFVRLQCNIDELHVKHSDKEGISNMKLKVNIKDDDTFKIVLKKLSQQVNVLSVKSE

SEQ ID NO: 6310 - protein, 97 aa, Staphylococcus epidermidis; identical to SEQ ID NO: 3795

SEQ ID NO: 6311 - protein, 424 aa, Staphylococcus epidermidis
KTVTVRTKVSTKDIDEAYLRLKNIVKETPLQFDHYLSQKYNCNVYLKREDLQWVRSFKLRGAYNAISVLSNEEKNKGITCASAGNHAQGVAYTAKKLNLKAVIFMPVTTPRQKINQVKFFGDSNVEIVLIGDTFDHCLAQALNYTKQHKMNFIDPFNNVYTIAGQGTLAKEILNQAEKEDKTFDYVFAAIGGGGLISGVSTYFKAHSPHTKIIGVEPTGASSMYQSVVINHSIVTLENIDKFVDGASVARVGDITFDIAKDKVDDYVQVDEGAVCSTILDMYSKQAIVAEPAGALSVSALEQYKKQIENKTIVCIVSGGNNDINRMKEIEERSLLFEEMKHYFILNFPQRPGALREFVNDVLGPQDDITKFEYLKKTSQNTGTVIIGIQLKHHDDLIQLKDRVCQFDPSNIYINENKMLYSLLI

SEQ ID NO: 6312 - protein, 46 aa, Staphylococcus epidermidis
INYFINEYRKQLKIENKLSIGNVRTYQQNVSKLWVSSEVVCGYVNK

SEQ ID NO: 6313 - protein, 173 aa, Staphylococcus epidermidis; identical to SEQ ID NO: 5258

SEQ ID NO: 6314 - protein, 104 aa, Staphylococcus epidermidis
VDIYCNGRLKQMTQEINCNFKSHIPRIMTVPGILLIHENKLEFKAYSQNNNPFNIQFELSSIVRYRTSKGLLGNKLFIYYSDQEWYKFSNLSKSDLNKLTKYLY

SEQ ID NO: 6315 - protein, 138 aa, Staphylococcus epidermidis
GVTYKMKKIFILLLSSLLVLAACGKNYEISDITNKFKKEGLSVENLRKMKREDFGMAPMKTENAKIFTVSDDKNARILKFKNEDDLKEMKKYYEELGKSSAAFYSHVYTKDRFLIQMNGDIDDHLFEKYKKAMNEALD

SEQ ID NO: 6316 - protein, 51 aa, Staphylococcus epidermidis
MNYLLIDTSNQPLSVAIMKDNEVIAEKTTDIKKNHSVQLMPEIAEFLQKVK

SEQ ID NO: 6317 - protein, 49 aa, Staphylococcus epidermidis; identical to SEQ ID NO: 3811

SEQ ID NO: 6318 - protein, 622 aa, Staphylococcus epidermidis
TYQQLNKLLSFYYTRKDSNFRKVLTSKCLSPISSWMGLNNVPIFIGTFFYFLNNYMGERYMRSDMIKKGDHQAPARSLLHATGAFKQPTDMNKPFVAICNSYIDIVPGHVHLRELADIAKEAIREAGAIPFEFNTIGVDDGIAMGHIGMRYSLPSREIIADAAETVINAHWFDGVFYIPNCDKITPGMLLAAVRTNVPAIFCSGGPMKAGLSAQGKALTLSSMFEAVGAFKEGTISKEAFLDMEQNACPTCGSCAGMFTANSMNCLMEVLGLALPYNGTALAVSDQRREMIRQAAFRLVENIKNDIKPRDIITQDAIDDAFALDMAMGGSTNTVLHTLAIANEAGIDYDLERINEIAKKTPYLSKIAPSSSYSMHDVHEAGGVPAIINELMKKDGTLHPDRLTVTGKTLRENNEGKNIKNFEVIHPLENPYDKQGGLSVLFGNLAPKGAVIKVGGVDPSIKVFTGKAICFNSHDEAVEAIDNHTVREGHVVVIRYEGPKGGPGMPEMLAPTSSIVGRGLGKDVALITDGRFSGATRGIAVGHISPEAASGGPIGLIRDGDKITIDLINRTLNVDQSEEELYRRKNQLEPFRAKVKTGYLARYTSLVTSANTGGIMQVPENLI

SEQ ID NO: 6319 - protein, 44 aa, Staphylococcus epidermidis
ITTHYAVSYRYLSACSTKYSKPLELISLIFIKKLSAYLKVVTLR

SEQ ID NO: 6320 - protein, 584 aa, Staphylococcus epidermidis
EMIKMSNQKSMVSPHPSEHQTKESQPLITRSGSQLLVEALQQEDVDFIFGYPGGAVLPLYDTFYDGKIKHILARHEQGATHAAEGYARVSGKTGVVVVTSGPGATNAITGITDAYSDSLPLVVFTGQVATPGIGKDAFQEADLLSMTTPITKHNYQVKKIEDIPRIVHEAFHLANTGRKGPVVIDFPKDMGVLKTDVELTKDINIPGYEVNSSPNKEDINKLIYMIKEAKKPLILAGAGINHSKSNHLLTEFVTRHQIPTVTTLLGLGAVPYHHPLFLGMGGMHGSYASNMALTNCDLLINLGSRFDDRLASKPDAFAPNAKVVHVDIDPSEINKVINTDLGIVADCKHVLENLCHEQVLTSSHEEWNDYCINNKSNYPFKYDENDKTFCKPQKAIEYIGKVTNGNAIVTTDVGQHQMWTAQFYPFKNYGQWVTSGGLGTMGFGIPSAIGAQLAEPEKTVVCFVGDGGFQMTNQEMALLPEYGLNVKIVLINNGTLGMVKQWQDKFFNKRFSHSVFNDQPDFMKMAEAYGIKGFLIDSPDKLESSIDEAFAYHGPALIEVRISPIEPVNPMVPSGKSNHEMEGY

SEQ ID NO: 6321 - protein, 189 aa, Staphylococcus epidermidis
LEIKPITIYTGKTVPLFYDNIDTDQIIPKVHLKRVSKSGFGPFAFDEWRYLPDGSDNPDFNPNKPEYHGASILITGDNFGCGSSREHAAWALKDYGFNIIIAGSFSDIFYMNCTKNAMLPICLNQKEREHLAQFDEITVDLPNQTVSTVSQSFHFDIDETWKNKLIHGLDDIAITLQFENLIEKYEKTF

SEQ ID NO: 6322 - protein, 372 aa, Staphylococcus epidermidis
EFAKYGPFYYNTLVFISEKGDKMVWTIISGLVVGILLGFVMQRTRFCLAGGFRDMYVQKSNKMFYALLIAITVQSIGLLILKHLNIIEVPAETFPVIGTILGSFIFGIGIVLAGGCATGTWYRAGEGLIGSWVALIFYALTSAVTKTGVLLPIMNQINKTTQVNTSMTSTTGIPQWILVMLLILITVFLVVKTIRKPKIMVPQLKQKYSGIRHYLFEKRYHPFVAGIAVGFIALLAWPMSESTGRMGGLGITTPSANLVNYLISGDLKFIDWGVFLVLGIFLGSYIAAKGSKEFRWRLPDIKTIRNSAIGGIFMGFGASVAGGCSIGNGLVETATMSWQGWIALASMIIGVWFMSYFIFVQPMKKLQQVTQS

SEQ ID NO: 6323 - protein, 319 aa, Staphylococcus epidermidis
FFMKNISDIAKLAGVSKSTVSRFLNNGSVSPATKEKITKIIEENNYQPNQFAQSLRARRTNLIGAIIPRMNSYAVDETIKGLVHQCNQHRYQLLLNYTGLEIDGEISALKTLSRSKVDGIVLMATHITEAHIEVIEKIDVPVIIVGQKHDRLYSIYHDDYEAGYKIGVLIGEKGCRNVHFFGVSEEDIAVGIQRKLGVIQALKDYHISPKIYETTFKHEQAFKDVSQQLERVHHADAIVGATDTIAFAIHKYCSDHQQRFYNCSIYGFGGDPMTQIVSPVIQTVSYNYFEAGEQALKEINQLLKGEQTALKIKIPIQLN

SEQ ID NO: 6324 - protein, 69 aa, Staphylococcus epidermidis
KLMNKVLGYRKMLGKTQQQMAKELNISEQSYRNREKGKINFKKNEMIKFKIMLLEKGLKDITLDDIFFS

SEQ ID NO: 6325 - protein, 649 aa, Staphylococcus epidermidis
KGENRMILLQLNDISKSFDGEDIFTDVNFEVKTGERIGVVGRNGAGKSTLMKIIAGVENYDSGHISKIKNLTMSYLTQQMTLNSEATVFEEMSKPFEHIKKIENLIKDETDWLARNGQDYKSDEYQSHIEKYETLTNRYEQLDGYQYESKIKTVLHGLNFTESDFNKPINDFSGGQKTRLSLAQMLLKEPDLLLLDEPTNHLDMETTKWLEDYLKYFKGAIVIISHDRYFLDKIVTQVYDVALGNVKHYVGNYEQFIKQRNQYYEKRMQEFEKQQEEIKRLETFVEKNITRASTSGMAKSRRKTLEKMERIDKPMIDARSANIQFGFDRNTGNDVMHIHDLKIGYDSPITLPINLEVFKGDHIAIIGPNGVGKTTLIKTIAEKQNKLGGQIIFGANLQIGYYDQKQAEFKSNKTILDYVWDQYPHMNEKDVRAVLGRFLFVQEDVKKIINDLSGGEKARLQLALLMLQRDNVLILDEPTNHLDIDSKEMLEQALKDFEGTIIFVSHDRYFINQLANKVFDLNINGGQMFLGDYQYYIEKTEEAAAIKAHETVTQNNFENKEINQDANTSTYISQKQQKRQQRKLERQIEHCERQIEELEAQISHIEEQLTQPEVFNDPLKASKFANQKSDIEQKLEQIMLEWEKLQEKL

SEQ ID NO: 6326 - protein, 461 aa, Staphylococcus epidermidis
EEEKIMGQTLFDKVWKKHVLHGKEGEPQLLYIDLHLIHEVTSPQAFEGLRIQNRKLRRPDLTFATLDHNVPTIDIFNIKDEIAHKQITTLQQNAKDFGVHIFDMGSDEQGIVHMVGPETGLTQPGKTIVCGDSHTATHGAFGAIAFGIGTSEVEHVFATQTLWQTKPKNLKININGSLPTGVYAKDIILYLINQYGVDFGTGYALEFTGETIKNLSMEARMTICNMAIEAGAKYGLMQPDETTFDYVKGRPYATDFDSSMAWWKKLYSDDDAYFDKVIELDVTNLEPQVTWGTNPEMGVSFSNPFPEIKNANDQRAYDYMGLHPGQKAEDIKLGYVFLGSCTNARLSDLIEASHIIKGQQVHPNITAIVVPGSRTVKKEAEALGLDKLFKDAGFEWREPGCSMCLGMNPDQVPEGVHCASTSNRNFEGRQGKGARTHLVSPAMAAAAAINGKFIDVRKVVV

SEQ ID NO: 6327 - protein, 110 aa, Staphylococcus epidermidis
LMTDAKLRERSVCMPYVNLQNLPTKANVVTEPNQVVVKPIMAKPNVIAKLFGISYSSVNRILKEWEKDSKGIDDLYYSLSSTMTVISISRFEQYMKKRHKESSPRAWPRS

SEQ ID NO: 6328 - protein, 492 aa, Staphylococcus epidermidis
NIVEWTREERYQRIEDVDETYLEQLKHQVDTSLYRQTFHIQPEMGLLNDPNGLIYYNGHYYISHQWFPLGAVHGLKYWFNYKSKDLLHFEPQGTLLKPDTKYDSHGVYSGSAFEYQNHLYYMYTGNHRDQHWNRISSQMIARMNKDGKIEKFPKPVIHGQPEGYTSHFRDPKVFEKNSQLYAILGAQNENEMGRLLLYRSQDVVDWHFEGEIKTNLTQFGYMWECPDYFRLSNKDVILMCPQGVEAEGDKFRNIYQSGYMIGDLNFNNLFFDHESFQELDNGFDFYAPQTFVDADGQRILIGWMGLPDTEYPTDKEGWAHCLTIPRVLTIENGKLKQRPFKQLEDLRTNKETALGYANKFKRKLHPYEGKQYEMIIDILENDASEIYFELRSSRSESTLITYNKHENKLTLDRTDSGTLPSNVDGTTRSTILDSPLKQLQIFVDTSSIEIFCNDGERVLTSRIFPNEDATGIKASTESGQVYLKFTKYELKG

SEQ ID NO: 6329 - protein, 417 aa, Staphylococcus epidermidis
WVALLPFLFRRDKMWHEKFTNKHGDVQYRYYEKYKDPLTNKWRRVSVVLNKNGKQSQKEAQKLLNKRIEAKINDKTPIDLKTLTFHQACDEWLDRYIKTSGSKQSTIKTKKYKIKHIKRNINSDILVKNMNSDVVQKSVDNAVKDNLSHKVVKDAMSIIRNIMKYIQRKYKLTDISYLDDIVIPKKATTREEVKAKRENYLEMDEVKAIVDNLHEIANSKRADYMKRSFIMTAYIMEFQALNGMRIGELLAIQPNNIDFDKKTLEIDGTIHWRNEGNAVGFKDTTKTESSYRTISLTTRSCDILRKVMLENKKAIQWESMYQDRGFIFTNYRGNPMSLSTINRNMQQSANNVGITKHITSHTMRHSHISLLSQLGISLKAIMQRVGHTDHKTTLQIYSHVTDQMDKDMMNKLEKVGN

SEQ ID NO: 6330 - protein, 54 aa, Staphylococcus epidermidis; identical to SEQ ID NO: 3860

SEQ ID NO: 6331 - protein, 58 aa, Staphylococcus epidermidis
QLIFYFQLFTIFIYEIIYLERKRRTKLHDEQSNLSTNYINFHHPNYTCKCNYLYYRET

SEQ ID NO: 6332 - protein, 181 aa, Staphylococcus epidermidis
RRIRMKRLLGTLFAATLVLSACSQDDTKEDEHKKSENTAERKADDKKDKKTKEDKKSKKEKKSQENEDNKSTQEDNSTDNQETQDPATQGQKQTQQDNQQNYDDQQSYHEPTKDEVYEWDKQNIPGGTDYGLIDPEDVNTESEDNARQNRIDEINEEMEDPNISVSDYNKLVDEYNELNNE

SEQ ID NO: 6333 - protein, 52 aa, Staphylococcus epidermidis
DFFSLKDNIAFKIIKVRHINIPFEGIKKMNATPINGNNGQNINKIFRLVGNI

SEQ ID NO: 6334 - protein, 68 aa, Staphylococcus epidermidis; identical to SEQ ID NO: 3866

SEQ ID NO: 6335 - protein, 354 aa, Staphylococcus epidermidis
VERRYTYMSYKIVALPGDGIGPEILSGTLELLKLISEKYHFEYHLESHHFGGVSIDYYGTPLTNETLQSCKNADAILLGAIGGPKWTDPNNRPEHGLLKLRKSLNLFANIRRTFVTKGASHLSPLKQDIVEGTDLVIVRELTSGIYFGEPSYVKKTEALDSLKYSSQEIERIVRIAFNLANRRRKKLTSVDKENVLSSSKLWRQIVNDVKKDYPEVEVNHMLVDACSMHLITQPTQFDVIVTENLFGDILSDEASVIPGSLGLSPSASFGQTGTRLYEPIHGSAPDIANEDKANPFGMVLSLALCLRESLNQNDAANELESIVYSFIQSNKTTADLGGQYRTSEIFKLLKEKYL

SEQ ID NO: 6336 - protein, 321 aa, Staphylococcus epidermidis
FIMRRLFAIGEALIDFIPNVTHSKLKDVEQFSRQVGGAPCNVAATVSKLGGKSEMITQLGNDAFGDIIVETIEQLGVGTQYIKRTNKANTALAFVSLQDDGQRDFSFYRKPSTDMLYQPENIDDIQIFQDDILHFCSVDLIESDMKNAHEKMIEKFESVGGTIVFDPNVRLPLWEDKLECQRTINAFIPKAHIVKISDEELLFITGKKNEDEAIQSLFRGQVNVVIYTQGAQGATIYTKDDYRIHHEGYQVQAIDTTGAGDAFIGAIIYCILESRHSECKDLFKEKGKDILAFSNRVAALTTTKHGAIESLPTKEDIKDYY

SEQ ID NO: 6337 - protein, 282 aa, Staphylococcus epidermidis
FCVGLRKFFVHYNHFRRKMMDIDKLEVGKRIKNIRLNKSKNLREFGELISKNLKEDKNISDSIVSRWEKGVSIPSAKRLKEIADIGNVSVNYLLYGVKVTYKDIHNNINTVSMKNEIMDNLEKFLKYYLLYSEYNNYSIKTAELLDLLFENAGYDITTLTKDLCALVSDKRFSFYQHGVYLLLNEDFSKLHVQLYLSEFIYNLLVQITLDYPNIYIKNLVLQITETKERIKDISHKKDAYTEFEIETHLADFINHKEYKKLLDNLSQLEKKITNDNSLIDNN

SEQ ID NO: 6338 - protein, 546 aa, Staphylococcus epidermidis
KEKGELNFMTNNQTLVLIILTFIILITLVNVIISIIERRKQIAKINTLWDNKLKLESFIRPNSRFDAQYHAYRDHYNEQSFIDDKTWSDLNMDTLFHKINFNFTAIGEMRLYATLRGMFKVNQTSLINKFKDNKVFRLNVSYILSKIGKNVYPLFPDQMLPTKRNILLMFCPLLPFIGVAFIFLIPSKGILICLTFMILNAILSFKLKKSYDQDLKSIFYTANVIKQSQALSKIESTPAISVDFTHFKASRRFSGLLVRVESQDMASSIIMFIKLVFMIDYFLFHLIQRSYFKYQEEVMACYDYISILDNHYSIAMYQHTLTHYCYPKINHNINGLQMKSIIHPLLDEENAIANTIDISNHILLTGSNASGKSTFMKAVALNLILAQSIQTATAHSFIYQPGYVMTSMANADDVLSGDSYFMSELKSIRRLFNTHQCNKIYCFIDEIFKGTNTTERIAASESVLSYLDNQKAYQVIAATHDVELSTLLENTYNNYHFNESIQENSIFFDYKIKPGKANTRNAIELLRITQFPIDIYQRAQQNIRNL

SEQ ID NO: 6339 - protein, 160 aa, Staphylococcus epidermidis
IIRGGTKLVKPTREQLNIRKMSVEDVPKVFDIERNSFSHSSWSIDAFYHEIENNEFATYFVIEFSDKIIGYVGLWLVVDQAQITTIAISKAFRGYGLGQLLLKYAMNYARFSCDVMSLEVRIDNDVAQHVYRNLGFQNGGKRKNYYGEGEDALVMWVNLK

SEQ ID NO: 6340 - protein, 44 aa, Staphylococcus epidermidis; identical to SEQ ID NO: 3889

SEQ ID NO: 6341 - protein, 437 aa, Staphylococcus epidermidis
PYLILLFKKTLIMMFLKEVVSMNMNDTIFLFLCTLLVWLMTPGLSLFYGGLVQSKNALNTVMQSMVAIVIVTFVWIIIGFSLSFDGGNQWIGGLKFLGLHHVGFETSKTLSPHIPLSLFMLFQMMFCTIAVSILSGSIAEKMRFIPYLIFVSLWVLLIYSPVAHWVWGGGWISKIGAIDYAGGTVVHITSGVSGLVLGIMIGIGKKKEKHTPHNLLITLIGGILVWLGWYGFNVGSAFTFDHIAMISFVNTVIGASAGAFGWLIFEYILKKTTSLLGLLSGALSGLVAITPAAGYVSYMSAMIIAIIGGICCYIVINLIKVKLQYNDALDAFGIHGVGGILGAVLTGVFQSHQINSAVQNGFIYTADFKVVVIQLGAAIATVVFSAIVTFLIARFIKIFTPLATTQEEDKTGLDAIVHGEKAYFYGELNKFNRHIKF

SEQ ID NO: 6342 - protein, 178 aa, Staphylococcus epidermidis
NSRILTESKINKTEITDIVVAKGPGSYTGLRIGVTVAKTLAYALNTNLYGVSSLKALASTVKDSTKLLVPIFDARREAVYAGVYQYQDNELITIIDDTYIPIFELIEKLHQLNQPYVFVGYHTEKIKHLLDSDIVEQLPQASSMKQLIQKPENIHSFTPKYHKLSEAERNWLNQQENN

SEQ ID NO: 6343 - protein, 368 aa, Staphylococcus epidermidis
EFGIPKWWQKKELLWRRRGRISHVGEFEMTNNKLILAIETSCDETSVSVIKNGTELLSNTVLSQIDSHKRFGGVVPEVASRHHVEGITATIDESLVSAKVKMEDIDAIAVTQGPGLIGALLIGINAAKALAFAYDKPIIPVHHIAGHIYANHLEQPLTFPLMSLIVSGGHTELVYMKNHLDFEVIGETRDDAVGEAYDKVARTINLPYPGGPHIDRLAAKGKDVYDFPRVWLEKDSYDFSFSGLKSAVINKLHNLRQKNIEIVAEDVATSFQNSVVEVLTYKAIHACKTYHVNRLIVAGGVASNKGLRTALSEACKKEGIHLTIPSPVLCTDNAAMIGAAGYYLYQAGLRGDLALNGQNNIDIETFSV

SEQ ID NO: 6344 - protein, 249 aa, Staphylococcus epidermidis
VFVVDNYLYYEMTFNICFNSFTDFNDTCIIYAKKGVRYMPDDFKIPRATLKRLPLYYRFVSILKGKGIDRVNSKTISEALQIDSATIRRDFSYFGELGKKGYGYNIDSMLEFFKSELSESDQIKIAIIGIGNLGRALLTYNFSIHDEMTITEAFDIRPDIIGENIGDVVVKHSDDIKMTLESEDIDVVILTTPDNVAQQVADELVKAGVKGILNFTPRRIKTPQDVQVHHIDFGIELQSLLFFMKNYSK

SEQ ID NO: 6345 - protein, 56 aa, Staphylococcus epidermidis
YEKVNIPTNRKRLELMNLGVRVMNLVELQGSTRAENETRGRALISSEESFLAEGIN

SEQ ID NO: 6346 - protein, 530 aa, Staphylococcus epidermidis
CHSLNLKVLKNNNIRGVFLMEEHIQIFDTTLRDGEQTPGVNFTFDERLKIAKQLEKWGVDVLEAGFPASSTGSFKSVEAIAKTLTTTAVCGLARCKKSDIDAVYEATKEAIKPQVHVFIATSPIHLEHKLKMTQDEVLTSIKEHVSYAKQFFEVVQFSPEDATRTEIPFLIECVQTAINAGATIINIPDTVGFSYPTEYGEIFKQLTQAVKSNSKIIFSAHCHDDLGMAVANSLAAIEGGARRIEGTVNGIGERAGNASLEEVALALYVRKDHYGLESQINLKETKKTSDLISRYAGIRVPRNKAIVGQNAFSHESGIHQDGVLKHRETYEIMTPQLVGVNTTELPLGKLSGKHAFAEKLKALGYEIKLEDQVTLFKQFKEIADKKKNVSDRDIHAIIHGSEHEHNAIFQLDNLQLQYVSKGLQSAVVVIKERNGQVKQDSSIGTGSIVAIYNAVDRIFKKDAELIDYRIDSVTEGTDAQAEVHVRIIINHIEVTGIGIDHDILKASCKAYIDAHAKYISEYELKEGIRT

SEQ ID NO: 6347 - protein, 63 aa, Staphylococcus epidermidis
LFSSIILVIFSFVAGLTDPLFKKRETVLFDTPANFAISDIFFIKNHLSRHQSFFFILPYEPTL

SEQ ID NO: 6348 - protein, 339 aa, Staphylococcus epidermidis
LEEFIMTKVYYDETVTQDALQGKKIAVIGYGSQGHAHAQNLKDNGYDVVIGLRPGRSFNKAKEDGFDVYTVSEATQQADVVMVLLPDEIQGEVYNKEIKPYLEKGNALAFAHGFNIHFSVIEPPSDVDVFLVAPKGPGHLVRRTFVEGSAVPALFGVQQDATGQARNIALSYAKGIGATRAGVIETTFKEETETDLFGEQAVLCGGVSKLIQSGFETLVEAGYQPELAYFEVLHEMKLIVDLMYEGGMENVRYSISNTAEFGDYVSGPRIITPNVKENMKKVLEDIQNGNFSRRFVEDNKNGFKEFYQLREDQHGHQIEQVGRELREMMPFIKSKSIEK

SEQ ID NO: 6349 - protein, 227 aa, Staphylococcus epidermidis
MSQSSKRKNDSVVETFKDIIPLTFGEEIGNAASHGAAALLTLFILPYAAVHSFNNGGTLESISVSVYVISIFMMFISSTIYHSMQNNTSHKYILRIIDHSMIYVAISGTYTPVLLSVVGGWLGWLVTILLWGTTLWGILYKSIATKVNHRLSLIVYLVMGWVGIIFLPIIIMRTSWWFIFFIFLGGLSYTIGAWFYAQKNKPYFHMIWHIFIVLASFLHMIGIFYFM

SEQ ID NO: 6350 - protein, 82 aa, Staphylococcus epidermidis
RLKSYRFHSATSLKLFNFIISLQFTTYSANVLSTSKLMLCFYSLATLITCLPKLSPVSRFLKACGTLSKPSSTETCVLILFS

SEQ ID NO: 6351 - protein, 326 aa, Staphylococcus epidermidis
RGESHMIKQNLKMRYTIVLLLLIFSTIFSLCIGSVMINPIHAVTGFFLHNDFILNEYRIPRTLLGLLIGSSLAISGSVIQGVIRNPLASPDVIGITKGASLAAVMIIMIFPSAPLFVLPLGSFIGALTISIILSVLISKFDVKGSKLALIGLAIGAICTAIVQFLLIRNPLDANNALLWLTGSLYGHNIVNFYSLLPWFIITVPIVLLLGYQLDILNLGDHVAIALGARVKILKMILLVLAVMLAGASIAVVGGISFLGLIAPHIARQLVGHKNIHVIIMSGLVGAILLTFGDGLARGIQPPLDIPVGVVIAIIGAPYFLFLLRKM

SEQ ID NO: 6352 - protein, 335 aa, Staphylococcus epidermidis
GVESVRGLKILSVIGLLFVLIATAACGNNSSSNSSKESSKDGVEIKHEEGTTKVPKHPKRVVVLEYSFVDALVALDVKPVGIADDNKKNRIIKPLRDKIGKYTSVGTRKQPNLEEISKLKPDLIIADNNRHKGIYKDLNKIAPTIELKSFDGDYNENIDAFKTISKALGKEEEGKKRLEEHDKKIEEYKKEITMDKNQKVLPAVAAKSGLLAHPSNSYVGQFLSQLGFKEALSDDVTKGLSKYLKGPYLQMNTETLSQVNPERMFIMTNKASSNEPSLKELEKDPVWKKLNAVKNQRVDILDRDLWARSRGLISSEEMAKELVELSKKDSKKDNK

SEQ ID NO: 6353 - protein, 40 aa, Staphylococcus epidermidis
IQNPYSCSKIKHVKSVEFLDETFLILGHSIVLKKLEYDAF

SEQ ID NO: 6354 - protein, 314 aa, Staphylococcus epidermidis
GRCPMILTLTLNPSVDISYPLDQFNLDTVNRVSQTSKTAGGKGLNVTRVLSEFGEDVIASGFLGGALGQYIEEQIETTRIKQAFFKIKGETRNCIAILHEGQQTEILEKGPTIELKESEEFKSHLLKLFKETDVAVMSGSLPKGLNTDYYADIVRLAKEQGILTILDSSGQSLEEVLISNVKPTVIKPNIDELSQLLNYKVTNDIKELKAAVSQPIFNDIEWIIVSLGSEGAFAKHNQKFYKVNIPNIKVVNPVGSGDSTVAGIASGLIHQQTDEELLKKANAFGMLNAMEQQTGHINTDKFDEIFKQIEVIEV

SEQ ID NO: 6355 - protein, 121 aa, Staphylococcus epidermidis
YPSPYCLLVIKTPTVPSPINEARLSTVDLPGKVNKGRMIGLKMGPSNSNRPYSINKGKKIAANKNTATRVGNKLENTNPPVSSDLIISGPIFKNVNQEKKTANTLKTSHPILTLKALLIKP

SEQ ID NO: 6356 - protein, 100 aa, Staphylococcus epidermidis
RLPPTYYRGCWHVVSRGFLIRYRQDVHSYLHICSSLITEFYDPKTFITHAALLRQAFAHCGRFPTAASRRSLDRVSVPVWPITLSGRLRIVALVSRYPTN

SEQ ID NO: 6357 - protein, 40 aa, Staphylococcus epidermidis
FVTFRYCLLELTSTYCHSVFNVHLVKSIFFIVLYCFKKSQ

SEQ ID NO: 6358 - protein, 359 aa, Staphylococcus epidermidis
GGFTLLTVNQVKEIVGALKDPIIDVPLRESEGIVDVSIKDNINHVSVKVAMAQLGGQPQLDLQMAIVKALKENGANTVGIRFEELPSEVVERYIGKGSEKPKTIEELLSQNNPVEFISIASGKGGVGKSTVAVNLAVALAREGKKVGLVDADIYGFSVPDMMGIDERPGIDGKEIIPVERHGVKVISMAFFVEENAPVIWRGPMLGKMLTNFFTEVQWGELDYLLLDLPPGTGDVALDVHSMLPSSKEIIVTTPHPTAAFVAARAGAMAKHTEHTILGVIENMSYFESKETGKKEYVFGKGGGKKLSDELETQLFAELPLEQPTWNPNDFSPSIYQSDDRLGELYTLIARKVIVSTQKQ

SEQ ID NO: 6359 - protein, 221 aa, Staphylococcus epidermidis
GGNTVGQKINPIGLRVGVIRDWEAKWYAEKDFASLLHEDLKIRKFIDNELKEASVSHVDIERAANRINIAIHTGKPGMVIGKGGSEIEKLRNKLNTLTDKKVHINVIEIKKIDIDARLVAENIARQLENRASFRRVQKQAITRAMKNGAKGIKTQVSGRLGGADIARAEQYSEGTVPLHTLRADIDYAHAEADTTYGKLGVKVWIYRGEVLPTKNTSEGGK

SEQ ID NO: 6360 - protein, 83 aa, Staphylococcus epidermidis
GRDTMADNNNQNGQDATQQFINILKSFKWRIIGFLAFLIIAILFLTLGFWKTILIIVLCLIGIGIGYIKDRTQDFLNFLNRWS

SEQ ID NO: 6361 - protein, 187 aa, Staphylococcus epidermidis
LSWFLVFFYNVNTFHNDTVFFWFSSYYFTFFTFVFTCDNFYVVTFFDMHVGTSLNYVNLFDWYYSTSGASDTIFMKFPSRNSRATGPKIRVPRGPLSSRMITHAFSSNLIYEPSSRRTPDFVRTTTAFTTSPFLTTPPGVAFLTVHTIISPMFAVLRPDPPNTLIVRTSRAPELSATFKRVSCWIIR

SEQ ID NO: 6362 - protein, 50 aa, Staphylococcus epidermidis; identical to SEQ ID NO: 6138

SEQ ID NO: 6363 - protein, 171 aa, Staphylococcus epidermidis
RRDTFMARREEETKEFEERVVTINRVAKVVKGGRRFRFTALVVVGDKNGRVGFGTGKAQEVPEAIKKAVEAAKKDLVVVPRVEGTTPHTITGQYGSGSVFMKPAAPGTGVIAGGPVRAVLELAGITDILSKSLGSNTPINMVRATINGLQNLKNAEDVAKLRGKSVEELYN

SEQ ID NO: 6364 - protein, 163 aa, Staphylococcus epidermidis
FIRTAIMNEAFIFRRTIIMRQTFMANESNIERKWYVIDAEGQTLGRLSSEVAAILRGKNKVTYTPHVDTGDYVIIINASKIEFTGNKEQDKMYYRHSNHPGGLKSISAGELKRTNPERLLETSIKGMLPSTRLGEKQGKKLFVYGGAEHPHAAQQPENYELRG

SEQ ID NO: 6365 - protein, 340 aa, Staphylococcus epidermidis
RGGTMKAIGFKSSFQLDEGNCFEEFNFDIPHPSGHELLVKVQSISVNPVDTKQRTMPVDKAPRVLGFDAVGVIEKIGDQVSMFQEGDVVFYSGSPNQNGSNEEYQLIEEYLVAKAPTNLKSEQAASLPLTGLTAYETLFDVFGISKEPSENKGKSLLIINGAGGVGSIATQIAKFYGLKVITTASREDTIKWSVNMGADVVLNHKKDLSQQFKDNHIEGVDYIFCTFDTDMYYEMMVNLVKPRGHIATIVAFNSQQDLNLLKSKSVTFTHEFMFSRPLHHTDDVIKHHEYLKDITEKVEQGYYQPTTTKVIDGLDVDSLYEAHQILESHSMIGKLVINLK

SEQ ID NO: 6366 - protein, 41 aa, Staphylococcus epidermidis
AISTNIRNIYTPENFKINNIVAIGIKSKTVNVSLYCQCNNL

SEQ ID NO: 6367 - protein, 116 aa, Staphylococcus epidermidis; identical to SEQ ID NO: 6148

SEQ ID NO: 6368 - protein, 64 aa, Staphylococcus epidermidis
FNYLIAMIDNAIKNCNCIMLYQAVQSLNNYTIMASKIIRNLYIILSIKFVSVIKIWLNMELSFE

SEQ ID NO: 6369 - protein, 40 aa, Staphylococcus epidermidis
ITRAIMSTPKLGAIAATIDPIRNDPIAPKYSGLVFTLSIK

SEQ ID NO: 6370 - protein, 123 aa, Staphylococcus epidermidis
INMARIAGVDIPREKRIVISLTYVYGIGTSTANKIVEEANVSADTRVKDLTDDELGRIREVVDGYKVEGDLRREQNLNIKRLMEISSYRGIRHRRGLPVRGQKTKNNARTRKGPVKTVANKKK

SEQ ID NO: 6371 - protein, 279 aa, Staphylococcus epidermidis
ATMALKKYKPITNGRRNMTTLDFAEITKTTPEKSLLQPLPKRAGRNNQGKLTVRHHGGGHKRQYRVIDFKRNKDGITAKVDSIQYDPNRSANIALLVYADGEKRYIIAPKGLQIGQTVESGAEADIKVGNALPLQNIPVGTVIHNIELKPGKGGQLARSAGASSQVLGKEGKYVLIRLRSGEVRMILSTCRATIGQVGNLQHELVNVGKAGRSRWKGVRPTVRGSVMNPNDHPHGGGEGRAPIGRPSPMSPWGKPTLGKKTRRGKKSSDKLIVRGRKKK

SEQ ID NO: 6372 - protein, 654 aa, Staphylococcus epidermidis
IMNFNQFINKQNIIMTEDEHNVYDFLKHHNPNWSSNYIDHLLDGRDKVSQRLITSLHRENLVKSRDHSRILNRHQFAGYGVNVIAILEIYFPTSNIYLYAPITGMHAFDRIDVEGPFYFKNLSKEDDFERVLHPNQILDWILIEDENLNNEASVQFRNDLNNSAANMTFALSFQHYTMRNERAPLYNLIKNANDSYLRSEQSVIEGHPLHPGAKLRKGMNAEENFMYSSEFGNVIHLRAVFIHKSISRIQSSNVDYNVAVKQMFPDLIKTLEKEFGEDFNLQNYHLMMVHPWQIKHILQSDYRDELNEKLILISNHSVPYYAGLSFRTLVPKQPDLSPHIKLSTNVHITGEIRTLSEQTTYNGPLVTQILREIMSKDEDFSHYQSTYIDENAGIHFYNRNDNEAIQTDRSEQLGTLFRNNLYQFISNETVPVIPSSLVATYPYNTEAPICTLIKTYQNTYQYKNYEEAAKQWIKDYSKALLGLVIPLYSKYGISLEAHLQNSVATFNKDGSLNMIYIRDFEGLRIDNEQLNNAGFTTRHFHEKSRILTNSKTSVFNKMFYSTVQNHLGELVITIAKYSNSKVLEQEIWQIISQTVEDIFNHMTHISKQHLNNIKRTIFASEIDYKCVTTMRLEDQAHEYTYIKVHNPLHRKNDL

SEQ ID NO: 6373 - protein, 492 aa, Staphylococcus epidermidis
IWNYHLNKKEYMFMASYELSKTKRNLIVSVMLISAFVAILNQTLLNTALPHIMRELNINENTSQWLITGFMLVNGVMIPLTAYLMDKVKTRPLYLGAMGSFLIGSIVAAIAPNFGVLMIARVIQAVGAGILMPLMQFTLFTLFSKEHRGFAMGLAGLVIQFAPAIGPTFTGLIIDNASWRVPFIVIVGIALVTFIFGFVSISSYNTTKETKLDKKSVIYSTLGFGLMLYAFSSAGNLGFSNPIVLCSLLISLIIIGIFVKRQITISNPLLNLKIFNNKIFCFSTITSMIIMLSMVGPALLIPLYVQNALGLSALLSGLVIMPGAIINGIMSVFTGKFYDKYGPRPLIFTGFILLISCTFLLCFLKVDTSYTYLIVIYAIRMFAVSLLMMPINTTGINALKTEDISHGTAIMNFGRVMAGSLGTALMVTFMSIGAQWVVSSSEHASKEMIQRQSVAVGVDVSFALVTVFVIIAFVLALFIKEPNHLTHNSRKV

SEQ ID NO: 6374 - protein, 123 aa, Staphylococcus epidermidis
LMGYRKLGRTSDQRKAMLRDLATSLIVSERIETTEARAKEVRSVVEKLITLGKKGDLASRRNAAKTLRNVEILNEDDSTQTALQKLFGEIAERYSERQGGYTRILKVGPRRGDGAESVIIELV

SEQ ID NO: 6375 - protein, 404 aa, Staphylococcus epidermidis
NYVYIRSVIMLDKNQLEKYNQEHLYEYEKLMSSNEKNALDEKVDQLNLAEIQDLYQDLYVNRKTIDDVSSVSEVKYEVKSRLNEEERHTYEQKGYEAIRNGEFAVLLMAGGQGTRLGYKGPKGSFEIEGTSLFELQARQLIRLKEETGHTINWYIMTSDINHKDTIEYFKQHKYFNYDANHIHFFKQDNIVALSEEGKLVLNRDGHIMETPNGNGGVFKSLKKAGYLDKMQQDHVKYIFLNNIDNVLVKVLDPLFAGFTVTQSKDITSKTIQPKDSESVGRLVNVDCKDTVLEYSELDTDIANQFNNANIGIHAFKLGFITSAVDRELPYHLAIKQLKQLDENFGVVERPTLKFELFYFDIFRYGTSFVTLQVPREEEFSPLKNKEGKDSVHTATEDLKRMGLI

SEQ ID NO: 6376 - protein, 49 aa, Staphylococcus epidermidis
NSHLDYLCRYAVQAPVIYLKAFLGSVKSTTRGYNFLSPSQLILMSAGFA

SEQ ID NO: 6377 - protein, 41 aa, Staphylococcus epidermidis
NSIHSVLLGKILLTYLVFNVQINGGPKWTRTTDLTLIRRAL

SEQ ID NO: 6378 - protein, 192 aa, Staphylococcus epidermidis
EASQNVVLQKKTEEVDGYNAIQVGFEDKQAYKKGSKSNKYANKPAEGHAKKADTAPKRFIREFRNVNVDEYEVGQEVSVDTFETGDIIDVTGVSKGKGFQGAIKRHGQGRGPMAHGSHFHRAPGSVGMASDASKVFKGQKMPGRMGGNTVTVQNLEVVQVDTENSVILVKGNVPGPKKGLVEITTSIKKGNK

SEQ ID NO: 6379 - protein, 123 aa, Staphylococcus epidermidis
RMIQQETRLKVADNSGAREVLTIKVLGGSGRKTANIGDIIVCTVKNATPGGVVKKGDVVKAVVVRTKSGVRREDGSYIKFDENACVIIRDDKGPRGTRIFGPVARELREGNFMKIVSLAPEVL

SEQ ID NO: 6380 - protein, 109 aa, Staphylococcus epidermidis
GGAHMHIKKGDNVKVIAGKDKGKEGKVVATEPKKDRVVVEGVNVVKKHQKPTQLNPEGGILETEAAIHVSNVQLLDPKTNEPTRVGYKTVDGKKVRIAKKSGEEIKANN

SEQ ID NO: 6381 - protein, 54 aa, Staphylococcus epidermidis
VSKHNNAVIMNDEVIVIRNRSPLSYLSAMDPAQTLNSKIGIRRQKLTKPKYTAL

SEQ ID NO: 6382 - protein, 47 aa, Staphylococcus epidermidis; identical to SEQ ID NO: 6175

SEQ ID NO: 6383 - protein, 43 aa, Staphylococcus epidermidis
ITWQICRRIIQLRRENKLWLNYKLPSLVVLLVVLKHNVKLLKL

SEQ ID NO: 6384 - protein, 142 aa, Staphylococcus epidermidis
PKLKPAKTTAKAISNGSFKPNIIIRLLTNKTKNEQIYNVFLVKCASILPKLKLSVIQATDNGNITNPLCKGDKLSFSCKYTGIYKLYPISVIAISKSVIKTRTIDMLNSFVGRNGCSILFSILNSSHKTAKAKIIENMLKII

SEQ ID NO: 6385 - protein, 60 aa, Staphylococcus epidermidis
VMAKLQITLTRSVIGRPETQRKTVEALGLKKTNSSVVVEDNPAIRGQINKVKHLLTIEEK

SEQ ID NO: 6386 - protein, 73 aa, Staphylococcus epidermidis
SMAKQDVIELEGTVLDTLPNAMFKVELENGHEILAHVSGKIRMNYIRILPGDKVTVKMSPYDLSRGRITYRYK

SEQ ID NO: 6387 - protein, 66 aa, Staphylococcus epidermidis
KEANKVAKTSMVAKQQKKQKFAVREYTRCERCGRPHSVYRKFKLCRICFRELAYKGQIPGVRKASW

SEQ ID NO: 6388 - protein, 194 aa, Staphylococcus epidermidis
LMYNLKLTFAKEVTCEVKRLKNFILGLLIVAIVGFLLFMYIDDSRIQSYQDYFLQFNWFQPLLIGLAGLLILIGLILVLSIFKPTHRKPGLYKNFDDGHIYVSRKAVEKTIYDTIAKYDQVRQPNVVSKLYNKKNKSFIDIKADFFVPNHVQVKSLTESIRADIKSNVEHFTEIPVRKLEVNVRDQKTSGPRVL

SEQ ID NO: 6389 - protein, 174 aa, Staphylococcus epidermidis
FKNKGECIMAVDNNKAKQAYDNQTGVNEQERKEQQQAQNNQPQFENKLTFSDEVVEKIAGIAAREVKGILDMKGGFTDSFTNAFSNGNNVTTGVSVEVGEKQAAVDLKVILEYGESAPKIFRKVTDLVKEQVKYITGLEVVEVNMQVDDVMTKKEWQQKNEKDNKENNEREGLK

SEQ ID NO: 6390 - protein, 256 aa, Staphylococcus epidermidis
EVNKSMNKYDRLDEITKLVNKRGSVRTNEIVEDLNVSDMTVRRDLAELEEKGVLTKIHGGARSNSAFQYKEMSHQEKHTRFIEEKRFIAKNAVDLIEDGDTIFLGPGTTVQKLAEEINHYSLTIITNCLPVFNILIKKQTLHFRVYLLGGEMRDLTEAFVGEMTNQLLSQLRFSKMFFSSNGVKDGLAMTSSIEEAYTQQIALSHSLEKYLLIDSSKIGKDDFSSFCELRELNAVLTDNNDLEKKEKIESYVEVIS

SEQ ID NO: 6391 - protein, 75 aa, Staphylococcus epidermidis
HSDKFNSTSYYVNFFKSIHIYSIHFYLFISICNLKYITLYICIILNNYVKNTIRYLLTFSKSILTLFHLSSSIRI

SEQ ID NO: 6392 - protein, 168 aa, Staphylococcus epidermidis
FRCKDLKALFQKHMCLITLIQKRRLIMTIIIGSDVDGKRLKELIKDYLEDNDYDVLDVTEGKDLDFVDSTVSVAKEVQKSDDNLGIAIDAYGAGSFIVATKIKGMIAAEVSDERSAYMTRSHNNARMITMGAEIVGDTLAKNVAKEFVNGHYDGGRHQIRVDMLNKMC

SEQ ID NO: 6393 - protein, 74 aa, Staphylococcus epidermidis; identical to SEQ ID NO: 6186

SEQ ID NO: 6394 - protein, 290 aa, Staphylococcus epidermidis
YTVNLNYCRMFSDIKILGVVDVNGSNPIIEFKDVSFQYQSDAAFTLNRVSFSIPAGQWTSIVGHNGSGKSTIAKLMVGIEEPSEGQILFQNLPVDSQNKREVRKHIGIVFQNPDNQFVGSIVKFDVAFGLENQLVPYKEMVSKVNQVLTEVDMINKADDEPHSLSGGQKQRVAIAGVLALNPDVLILDEATTMLDPHGKSSLLNLVNEVKVNNHVTIISITHDLDEAMHADQIIVLNKGTVFKQGTPQDIFKCEDALISVGLDLPFPLKMNRLLGFDSTYVTYEGLIKKL

SEQ ID NO: 6395 - protein, 49 aa, Staphylococcus epidermidis
IITKTNTVVEKIVNNRIVNFDFIISPLHVYLLIILLLVINYLIYGITLK

SEQ ID NO: 6396 - protein, 51 aa, Staphylococcus epidermidis
NCLKRAGINSIQELADKSEADMMKVRNLGRKSLEEVKYKLEDLGLGLRKED

SEQ ID NO: 6397 - protein, 181 aa, Staphylococcus epidermidis
NMLKYFYKGEQNMTGKTHASCGFLVGAITTQYFHTDIFTSISVIVLSVISSILPDICHTQSKIGRRFRLTSFFVRILFGHRTFTHSLLFIIGISFLLYFIQTPMYYMVAIVIGMFSHVILDILTPRGVKLLYPLPFNIVSPIHFKTGGLVDVSLATALSVGAIYTLFQPYLNTMMHYWLIK

SEQ ID NO: 6398 - protein, 41 aa, Staphylococcus epidermidis
GGIKMKVRPSVKPICEKCKVIKRKGKVMVICDNPKHKQRQG

SEQ ID NO: 6399 - protein, 66 aa, Staphylococcus epidermidis
IPTNQKNANAPNMSVTPIQPSAAVNSGSNTFNTAFATFVWTIALESKSKAYKIKITADKGKISLNT

SEQ ID NO: 6400 - protein, 326 aa, Staphylococcus epidermidis
FMTKSQQKVSSIEKLSNQEGIISALAFDQRGALKRMMAEHQSETPTVEQIEQLKVLVSEELTKYASSILLDPEYGLPASDARNNDCGLLLAYEKTGYDVNAKGRLPDCLVEWSAKRLKEQGANAVKFLLYYDVDDTEEINIQKKAYIERIGSECVAEDIPFFLEVLTYDDNIPDNKSAEFAKVKPRKVNEAMKLFSEDRFNVDVLKVEVPVNMNFVEGFSEGEVVYTKEEAAQHFRDQDAATHLPYIYLSAGVSAELFQDTLKFAHDSGAQFNGVLCGRATWSGAVKVYIEEGEQAAREWLRTVGFKNIDDLNTVLKTTATSWKNK

SEQ ID NO: 6401 - protein, 160 aa, Staphylococcus epidermidis
GRTKVMKFLKNKSYHLLVTLIVLTIFVISGAIFLTFLGFGLYGLSRILIYLHLGDFSYNKGFYDNLIYYGSYIVLGYFTLFSIEHLMDYFKKNLPKNPYFQGINFHLISYIVTTIMFYFIVHIHYVHVNIHFWVIMIIIGFLFVCKEVFYPESKNLNNKK

SEQ ID NO: 6402 - protein, 43 aa, Staphylococcus epidermidis; identical to SEQ ID NO: 3838

SEQ ID NO: 6403 - protein, 591 aa, Staphylococcus epidermidis
IIQKRELTPMNKLIAWIEKGKPFFEKISRNIYLRAIRDGFIAAIPIILFSSIFILITYVPNVFGFTWSKTMEGILMKPYNYTMGIVGLLVAGTTAKSLTDSYNRKLDKANQINFISTMMAAICGFLFLAADPVKDGGFSSAFMGTKGLLTAFISAFITVIVYNFFVKRNITIKMPKEVPPNISQVFKDIFPLSAVILILYALDLLSRAIVHTNVANAVLKVFEPLFTAADGWIGVTLIFGAFAFFWFVGIHGPSIVEPAIAAITYANLETNLHLIQAGEHADKVITPGTQMFVATMGGTGATLVVPFMFMWLTKSKRNKAIGRASVVPTFFGVNEPILFGAPLVLNPVFFIPFIFAPIVNIWIFKFFVDVLNMNSFSIFLPWTTPGPLGIVMGTGFAFWSFVLAILLIVVDVIIYYPFLKVYDEQVLEEELGNKEANNELKEKVSANFDTKKADAILATAGASEADTDDTSSVDETTSTSSTDTISEQTNVLVLCAGGGTSGLLANALNKAAEEYEVPVKAAAGGYGAHMDIMKDYQLIILAPQVASNFEDIKQDTDRLGIKLAKTEGAQYIKLTRDGEAALEFVKQQFNN

SEQ ID NO: 6404 - protein, 134 aa, Staphylococcus epidermidis
RRQNLMARKQVSRKRRVKKNIENGVAHIRSTFNNTIVTITDEFGNALSWSSAGALGFKGSKKSTPFAAQMASETASKTAMEHGLKTVEVTVKGPGPGRESAIRALQSAGLEVTAIKDVTPVPHNGCRPPKRRLV

SEQ ID NO: 6405 - protein, 459 aa, Staphylococcus epidermidis
IYMNGFKKVDIVRGRIKFITMSLLGIILFLVPIPVVQDGKQQTTLPIAFLAGLLKDWLGGIMPILIVTIITVSGILTILCSTIYKNKLNPQGLMSSAFNVKIGWLVLRVLAVFFSWLTFLNIGPEMIKSEDTGGLVFSSLLPTLVAVFLFAAIFLPLLMEYGLLELLGPIFRPIMRPLFTLPGRSTVDNLASFIGDGTVGVLITSRQYGEGYYSRREATVISTTFSVVSITFAIVIAETIRMQDQFFYFYLTVVISCLIAAMIMPRIWPLKNIPDEYAKEVSEEARNEQLPEGKTALKYGFDLATEVGIKSPGFKEFLISGFKTVVDMWFVILPVVMSIGTIATIIANYTPVFEIIGKPFVPVLELLQIPEAHEASQTILIGFADMFLPSILIEGVQNDVTRFVIGALSISQLVYLSEVGGVILGSKIPVSISKLFMIFLIRTIITLPIIALLAHLFIG

SEQ ID NO: 6406 - protein, 248 aa, Staphylococcus epidermidis
KQMKKPDIQQLKDIVNNSNQIVFFTGAGVSVASGIPDFRSMGGLYDEISKDGQSPEYLLSIDHLHDNKESFINFYHERLLIADKKPNIVHQWIAQLENQQKSLGVITQNIDGLHEDAGSHNIDELHGTLNRFYCINCYEEYSKSYVMTHHLKYCEKCGNVIRPDIVLYGEMLNQKTVFKALDKIQHADTLIVLGSSLVVQPAAGFVSEFKGDNLVIINRDATPYDHTASLVIHDDMTNVIEEILNSNS

SEQ ID NO: 6407 - protein, 354 aa, Staphylococcus epidermidis
CMANVRVNLSKIKYNAKVLQSLLERRHIHFTPVIKCVAGDKRIVSSIKSLGITHFAESRLDNIEQLKDLDITFTLLRPTVEADLEKMISRVEMSIQTELTTIKKLNTLAKSLDIKHQIMLMVDWKDGREGVLTYDVVRYVQEVLRLSHIQLVGLAFNFMCFKSEAPNEKDVRMINKFIHNVENETHFKFRIISGGNSSMLPQTLYNHLDKINDLRIGEALLRGIDTTTNHSINSLYQNAIVLEAEIIEIKPRLYQKNNQSYLQAIVDIGYLDTFIEGIKPLGNDIRILGASSDHLMIDLNNQDHYQIGDKLQFSLNYEALSQSMYMKNLTKLYSSDSKIESLVQNFDMPIYSQC

SEQ ID NO: 6408 - protein, 78 aa, Staphylococcus epidermidis
NVKNWVVKQMKAKEIRDLTTSEIEEQIKSSKEELFNLRFQLATGQLEETARIRTVRKTIARLKTVAREREIEQSKANQ

SEQ ID NO: 6409 - protein, 348 aa, Staphylococcus epidermidis
VRWKTMTMVNKDSQSAIEQKKKKRTTLTFIVGVCLLFISVYLNLAIGSSKIQFNDILSYVTGHTNTKATFLIHNVRMPRMLAGLIIGGALAIAGLLMQAITKNPLASPQIFGVNAGASFVIVLITVLIPSLGSYSTILAIIGAFLGGFTVYTLSGSTKSITPIKLALAGMAIHLFFSSMTQGIIILNEDSNDTVMFWLVGSLAGIKWQQIIFILPFLLLAIFVTIFMGRQLTILELGDDIARGLGQRTEIVRMIVGILVVVLAGVSVSIAGPIGFVGLIVPHIVKRYINKNYVLMIPLTFIFGATLLLISDVLCRLITYPFESPVGIVTSFVGAFYFLFITVRGVNRI

SEQ ID NO: 6410 - protein, 150 aa, Staphylococcus epidermidis
GGAEMKLHELKAAEGSRRVRNRVGRGAATGNGKTSGRGQKGQKARSGGKVRPGFEGGQLPLFRRLPKRGFTNINRKEYAIVNLDQLNKFEDGTEVTPALLVESGVVKNEKSGIKVLGNGSLDKKLTVKAHKFSASAAEAIDAKGGAHEVI

SEQ ID NO: 6411 - protein, 51 aa, Staphylococcus epidermidis
LRIECPTTPTSKLVGLGFSRFARRYSGNRFFFLFLRVLRCFSSPGLPSDML

SEQ ID NO: 6412 - protein, 128 aa, Staphylococcus epidermidis
HSKERSIEMISKIDKNKVRLKRRARVRTKLSGTAEKPRLNVYRSNKHIYAQIIDDVKGVTLAQASSQDKDIANTSASKVDLATTVGQAIAKKANDKGIKEIVFDRGGYLYHGRVKALADAARENGLEF

SEQ ID NO: 6413 - protein, 94 aa, Staphylococcus epidermidis
LKEEVTKVSERNDRKVYVGRVVSDKMDKTITVLVETYKTHKLYGKRVKYSKKYKTHDENNSAKLGDIVKIQETRPLSATKRFRLVEIVEESVII

SEQ ID NO: 6414 - protein, 123 aa, Staphylococcus epidermidis
VEEEILMEAKAVARTIRIAPRKVRLVLDLIRGKNAGEAIAILKLTNKASSPVIEKVLMSALANAEHNYDMNTDELVVKEAYANEGPTLKRFRPRAQGRASAINKRTSHITIVVSDGKEEAKEA

SEQ ID NO: 6415 - protein, 615 aa, Staphylococcus epidermidis
LHLLLWELALSVFHSFFISYNVFRIWRRAIMNHKEWLLADKNIQYRTINAMIKEHIVSEGMRIKEGTCKVEIFLNNHLLSLKVARKSALKRYVFTGDIVLKNKKLSQSIESLEELLQILTEIFHINISKRLYDELIHSRDSLYETYKHFYNRQTLIHQSMKFSKLPDSINFIAWLQHLQDSGITDDLSYSESLVIEGHPTHPLTKTKLPLSTNELKLYAPEFEKVIPLNIMLIEKNHVVTTAINDDQNFILNQVIPEYRDRLKCYLEPLRLNLNDYRVMLIHPWQYDHTIGEQFEEWIAKKILLPTPFTVESKATLSFRTMDLIHTPYHVKLPVNVQATSAVRTVSSVTTVDGPKLSHALQGLLQEFPELQVAMEPYGAYAHTASDLSKQLALIIRQKPTIYDYGCTVVTASLVNPNPIDNQAVVDSYLKWIENEITLDHIKHFIAIYTQTLVTPLIAYIQNYGIALEAHMQNTIVNLGPNYKMKFIVRDLGGSRIDLNTLKQKVPQIDVTNESLIADTIEEVIAKFQHAVIQNQLAELIHHFNQYDEVIEEELFEIVREEIEMAIDNDKPHAEKLKKILFGSTITVKALLSMRMENKVKKYLNTKLDNPIKKEV

SEQ ID NO: 6416 - protein, 450 aa, Staphylococcus epidermidis
KGSFFMNLKSIITVMALILIMFMAAIETSIISLALPTIKNSLNAGNLVSLVFTVYFIALVIANPIVGELMSRFKIIYIAVVGVLLFALGSLMSGLSQTFTFLIISRTVQGFGAGVMMSLSQIVPKLAFEIPLRYKIMGIVGSVWGISSIIGPLLGGAILEFASWHWLFYINIPIAIVAIILVLMTFHFPDETQVQQSRFDIKGLIIFYIFIALLMFGLLNQHHIIFNIFSIILALAVLWLLFKIENSIEQPFLPTKEFNISIVLVFITDLLIAITLMGYNLYIPVYLQEKLSLSPLQSGFVIFPLSVAWITLNFNLGKIEAHFTRKTLYICSFFVLLVSSLMIMFGLKLPLLIAFAVVFAGLSFGYIYTKDSVIVQEETSPKNMKKMMSFYALTKNLGSSVGSTIMGYMYALNVGLFGSNLHNVLGLVLIIAVCLIVMWMTLYKSNTIQS

SEQ ID NO: 6417 - protein, 74 aa, Staphylococcus epidermidis
AHGFKFSFTPLPGYFSPFPHGTGSLSVTREYLALGDGPPRFRRNFTCSVVLRIHSRENMFSTTGLLPSLIHLSR

SEQ ID NO: 6418 - protein, 45 aa, Staphylococcus epidermidis
PCLCLCFGLSQITITLPLRLMTLHFSHIGFTDGLTFIFIPPYIME

SEQ ID NO: 6419 - protein, 112 aa, Staphylococcus epidermidis
KLIWVCGVKLHAHNKKGGAQMARSIKKGPFVDDHLMKKVEAQDGSEKKQVIKTWSRRSTIFPNFIGHTFAVYDGRKHVPVYVTEDMVGHKLGEFAPTRTFKGHAADDKKTRR

SEQ ID NO: 6420 - protein, 51 aa, Staphylococcus epidermidis
LFSWMGYSELDNICMWQTLSLHSFALYISSKCVFIKVRQLSYNLCLKIRLN

SEQ ID NO: 6421 - protein, 440 aa, Staphylococcus epidermidis
CKRWSTRGDLMFQTFVRFFTTKEVRNKIFFTLAMLVIFKIGTYIPAPGVNPEAFNHPQGSQGATELLNTFGGGALKRFSIFAMGIMPYITASIVMQLLQMDIVPKFTEWAKQGEMGRRKINNVTRYFAIILAFIQSIGMAFQFNNYLKGQLIIEKSVMSYLLIAVVLTAGTAFLIWLGDQITQFGVGNGISLIIFAGILSTLPSSLEQFAQSVFVGQDDTSLAWLKILGLIVALILLTVGAIFVLEAKRKIPIQYAKKQSAQRLGSQATYLPLKVNSAGVIPVIFAMAFFLLPRTLTLFFPKAEWAQNIADTANPSSNIGMIIYVVLIIAFAYFYAFVQVNPEKMADNLKKQGSYVPGIRPGEQTKKYITKVLYRLTFVGSIFLAAIAILPIIATKFMGLPQSIQIGGTSLLIVIGVAIETMKTLEAQVTQKEYKGFGGR

SEQ ID NO: 6422 - protein, 40 aa, Staphylococcus epidermidis
IVLLLYNVIHITIKHTAIIKTNPNTLCKLEPNKPTFSAYI

SEQ ID NO: 6423 - protein, 96 aa, Staphylococcus epidermidis
GGARIMEARDVLKRPVITEKSSEAMAEDKYTFDVDTRANKTQVKIAVEEIFDVKVDSVNIINYKPKKKRMGRYQGYTNKRRKAIVKLKEGSIDLFN

SEQ ID NO: 6424 - protein, 121 aa, Staphylococcus epidermidis
KQQLHHGKTNNVREDIQMNRDEVQLLGFEIVAYAGDARSKLLEALNAAKDSEFDKAEQLVEEANECIANAHKAQTNLLAQEAKGEDIAYSITMIHGQDHLMTTLLLKDLMKHLIELYKKGS

SEQ ID NO: 6425 - protein, 222 aa, Staphylococcus epidermidis
IICRRAFMNIILMGLPGAGKGTQASEIVKKFPIPHISTGDMFRKAIKDETDLGKEAKSYMDRGELVPDEVTVGIVKERISEDDAKKGFLLDGFPRTIDQAESLNQIMSELDREIDAVINIEVPEEELMNRLTGRRICEKCGTTYHLVFNPPKVDGICDIDGGKLYQREDDNPETVSNRLSVNVKQSKPILEYYNNKGVLKNIDGSKDIDEVTNDVIDILDHL

SEQ ID NO: 6426 - protein, 59 aa, Staphylococcus epidermidis; identical to SEQ ID NO: 6238

SEQ ID NO: 6427 - protein, 275 aa, Staphylococcus epidermidis
SCIRSGIMKNKLIIGRYLPMQSIIHQLDPRAKLIFVFFFIILIFFCHSLGTYAWLFLFIILFIKLARIPFWFLIKGLTPIFFFLVFTFSMHVLFTNGGIVLFQWKFITIESSGVMEGIYISLRLIFIVMIATIMTLSTSPIDLTDAFEKLFAPLKVIKVPVHQLSMMMSIALRFIPTLMDELEKIILAQKSRGSEISSGSLITRIRAFIPIMIPLFISAFQRAEELAIAMEVRGYDINIKRTSYRLLHWQYKDTLTVLLLIPIATILFILKFSGV

SEQ ID NO: 6428 - protein, 140 aa, Staphylococcus epidermidis
ESERRQQSMTMTDPIADMLTRVRNANMVRHEKLELPASNIKKEIAEILKSEGFIKNVEYVEDDKQGVIRLFLKYGQNNERVITGLKRISKPGLRVYAKANEVPKVLNGLGIALVSTSEGVITDKEARKRNVGGEIIAYVW

SEQ ID NO: 6429 - protein, 288 aa, Staphylococcus epidermidis
KIMSIQFNQVSYIYQQGTPYEFEAIKNVSLTLEQGKYYAIIGQTGSGKSTLIQHLNALLKPTTGSVNINGLEVTNKTKDKHLRHIRKEVGVVFQFPESQLFEDSVEKEIEFGPKNFNMNLKNVKDKAFQLLLELGFSRNVMSSSPFQMSGGQMRKIAIVSILAMDPQVIILDEPTAGLDPNSKHQVMSLIKKIQIEENKTIILVSHDMDDVARYSDEVVVMNKGTIVEKSNPRNLFNQKTQLLKWHIELPKVVKLQKDIEKKYNMLFPKLATNEEEFVKLYKEWHHEE

SEQ ID NO: 6430 - protein, 44 aa, Staphylococcus epidermidis; identical to SEQ ID NO: 6247

SEQ ID NO: 6431 - protein, 185 aa, Staphylococcus epidermidis
IIRRCHNMSRVGKKIIDIPSDVTVTFDGSHVTVKGPKGELERTLNERMTFKQEENTVEVVRPSDSKEDRTDHGTTRALLNNMVLGVSQGYEKTLELVGVGYRAQMQGKDLVLNVGYSHPVEIKAEEGITFAVEKNTTVKVSGVSKEQVGAIASNIRSVRPPEPYKGKGIRYQGEYVRRKEGKTGK

SEQ ID NO: 6432 - protein, 348 aa, Staphylococcus epidermidis
MKRRCVFMRLSLLDYVPLFEGRTPNDALKHSIKLAQHAEKLGYLRYWVAEHHQVYSVVSSAPEIIMMSILEHTQHIRVGSGGVMLPHYSPYKVAEQFKIMEARHPQRIDMAIGRSPSFKNVNAALNENKNEKLPFNTQITDLLKYFNNDTTQDHRFKSLLATPMVTSFPQLYILGMSNRSAKLAAQRGLPFVIARMGQSETDLHEAISTYRKYFKAYHGEINNAKPYVILATFVVTASNLSRVKQLLHTLQLWLMRINYLNQPKSYPSIETAQNKHYSQRELEKLEKMKSKIIYGMPNDVAEQLTLLHQQFKVDEIIILPHVFGEDARMELIELIANELIPSCSRDEF

SEQ ID NO: 6433 - protein, 76 aa, Staphylococcus epidermidis
TYNGISKAGPTIDNIMIIEVIVEKQNILLLNIFKFNNGLEIVICRLTKMPMMIKLIKSEQRTIGLEKPRLPALLKA

SEQ ID NO: 6434 - protein, 215 aa, Staphylococcus epidermidis
KAKGGNCIMANYDVLKVDGSKSGSVELNDAVFAIEPNNSVLFEAINLQRASLRQGTHAVKNRSAVRGGGRKPWRQKGTGRARQGTIRAPQWRGGGVVFGPTPRSYAYKMPKKMRRLALRSALSFKVQENSFTIVDTFGFEAPKTKEFKNVLTTLEQPKKVLVVTESEDVNVELSARNIPGVQVTTAQGLNVLDLTSADSVIITEAAAKKVEEVLA

SEQ ID NO: 6435 - protein, 185 aa, Staphylococcus epidermidis
LKGGSTLNRLKEKFNTEVTENLVKKFNYSSVMEVPKIEKIVVNMGVGDAVQNSKVLDNAVEELELITGQKPLVTKAKKSVATFRLREGMPIGAKVTLRGERMYEFLDKLIAVSLPRVRDFQGVSKTAFDGRGNYTLGVKEQLIFPEIDYDKVTKVRGMDIVIVTTANTDEEARELLTNFGMPFRK

SEQ ID NO: 6436 - protein, 55 aa, Staphylococcus epidermidis
YFYITKHSTIIQIDCISDMYNLIICNMNYKKSYSVINYSLNKKARTPSNVEFTLK

SEQ ID NO: 6437 - protein, 119 aa, Staphylococcus epidermidis
MINIILKKIDLEVIRMFVVTNRITVKKGYAKQMAPNFTKGGPIESLKGFEGIEVWQIDKDDYSEDMYVNSWWETEEDFKNWVNSDVFKQAHKNTGKSEDSPVIKSEIVKSNVLSSLNRR

SEQ ID NO: 6438 - protein, 268 aa, Staphylococcus epidermidis
ILRILVEIAYQGNQFLGFQIQQQGRTVQQQFEKILKRMHKHHVRIHPSSRTDRGVHAYQQFFHFDTELNIDNKQWQYAMNRALPDDIYVKNVRNVDEYFHCRYDCVGKRYRYKVYQGNHRNPFKSGTETFVYETLDYDKMNKAAQEFIGTHDFTGFCSQKTEVESKVRTLYQSEIVATKEGFDYVVTGSGFLYNMVRVLVAFLIEVGKGKHEPNDVPKLLEDKNRNNVPLTAPPDGLYLEKIYLSPEELIQEYGKDIKIHYKKSLEKH

SEQ ID NO: 6439 - protein, 40 aa, Staphylococcus epidermidis
NRFIILEVYHLLSYEFKIYIVAFNINFYFLYDYFDFQKYY

SEQ ID NO: 6440 - protein, 347 aa, Staphylococcus epidermidis
HNSINYYYKDDDDMNNEQIVFNKVPDGMPQDDTFKYEDIDVIEPSENELQLKTLYISVDPYMRGRMTNADSYIDPFKQGEPFNGHTVSKVLKSKDSNFDEGDIVVGMLPWRKINTVNSEYVNKVPTSDVPLHLYLSVLGMPGQTAYHGLLDIGQPKEGETVVISAASGAVGSVVGQIAKLKGCRVVGIAGGDKKVNYLKNELRFDAGIDYKKDNFPEALKEAVPNGIDVYFENVGGYIGDEVFKHLNTHARIPVCGAISSYNHPEKDIGPRIQQTLIKNQAMMRGFIVAEFADGFKEASKQLAQWVQENKIKTQVSVEDGFDKVPQAFRNLLTGDNFGKQVIKVASE

SEQ ID NO: 6441 - protein, 411 aa, Staphylococcus epidermidis
SILMIMIIIINEKDRWNLMAKYFFSSSFLLFLGNWIGQVGLNWFVLTTYHNAVYLGLVNFCRLIPILLLSVWAGSIADKYDKGLLLRITITSSFIITALLCLLTYSLNSIPIFIILLYATFRGILSAVETPVRQAVLPDLSSKISTTQAVSFHSFIINICRSIGPAIAGGLIAVYHTPTTFLAQAVCYFIAAVLCIPIHFEVILSQKEGKALPLKVVLNYFKSNLEGSQIFITSIIIMATGFSYTTVLPVLTNHIFPGQSQVFGIAMTFCAIGGIVATIVLPSILKHLSTVKMYYLSSILFGIALLGIIIHHLVVMFICITLIGLFSQWARTTNRVYFQHSVKDCDRGKVLSIIMMDRGMIPLGSLIMSFFADMFGILTTFTIMGISTISISLIFYIIQRISNMEESNNES

SEQ ID NO: 6442 - protein, 179 aa, Staphylococcus epidermidis
NVLIGGIKMKIAIGCDHIVTDTKMEVSQHLKSQGHEVIDVGTYDFTRTHYPIYGKKVGEKVASGEADLGVCICGTGVGISNAANKVPGVRTALVRDMTSALYSKEELNANVVSFGGKVAGELFIFDIVDAFIEAEYKPTEENKKLIAKINHLEAHNNDQADPHFFDEFLEKWNKGEYHD

SEQ ID NO: 6443 - protein, 292 aa, Staphylococcus epidermidis
RGLMMKSKFTILLFTIFSTTVLVLVIIYNKTQSQSYISTHYSNNKIKTTATLFLHGYGGSERSETFMVKQALNKNVTNEVITARVSSEGKVYFDKKLSEDAANPIVKVEFKDNKTGNFKENAYWIKEVLSQLKSQFGIQQFNFVGHSMGNISFAFYMKNYGDDRHLPQLKKEVNIAGVYNGILNMNENVNEIIVDKQGKPSRMNAAYRQLLSLYKIYCGKEIEVLNIYGDLEDGSHSDGRVSNSSSQSLQYLLRGSTKSYQEMKFKGAKAQHSQLHENKDVANEIIQFLWET

SEQ ID NO: 6444 - protein, 149 aa, Staphylococcus epidermidis
RRKIIMLLPKRVKYRRQHRPKTTGRSKGGNYVTFGEYGLQATTTSWITSRQIESARIAMTRYMKRGGKVWIKIFPHTPYTKKPLEVRMGAGKGAVEGWIAVVKPGRILFEVAGVPEEVAREALRLASHKLPVKSKFVKREELGGETNES

SEQ ID NO: 6445 - protein, 255 aa, Staphylococcus epidermidis
MIEIEKPRIETIEVSEDAKFGKFVVEPLERGYGTTLGNSLRRILLSSLPGAAVKYIEIEGVLHEFSAVDNVVEDVSTIIMNIKKLALKIYSEEDKTLEIDVKDEGEVTASDITHDSDVEILNPELKIATVSKGGHLKVRLVANKGRGYALAEQNNTSDLPIGVIPVDSLYSPVERVNYTVENTRVGQSSDFDKLTLDVWTNGSITPQESVSLAAKIMTEHLNIFVSLTDEAQNAEIMIEKEEDQKEKVIEISMEE

SEQ ID NO: 6446 - protein, 42 aa, Staphylococcus epidermidis
VVEILLDKSGKTACLTGVSTALSMPLNVAYKRMMKIGILLRL

SEQ ID NO: 6447 - protein, 135 aa, Staphylococcus epidermidis
KEEITLAQVEYKGTGRRKNSVARVRLVPGEGNITVNERDVRDYLPFESLILDLNQPFDVTETKGNYDVLVNVHGGGFTGQAQAIRHGIARALLEADPEYRGSLKRAGLLTRDPRMKERKKPGLKKARRSPQFSKR

SEQ ID NO: 6448 - protein, 42 aa, Staphylococcus epidermidis
NYMIINGIVLYHPTISPGNLLCYKIYKQSRTTVNEINEILRF

SEQ ID NO: 6449 - protein, 55 aa, Staphylococcus epidermidis
NNTIPPLVNNTCIEKVKTKKKKIGVNPLIKNQKGMRANLINNIIKRNNHAYVPSE

SEQ ID NO: 6450 - protein, 475 aa, Staphylococcus epidermidis
KGVLYMTKKLPDDFIFGGATAAYQAEGATQTDGKGRVAWDTYLEENYWYTAEPASDFYNRYPVDLELSERFGVNGIRISIAWSRIFPKGYGEVNQKGVEYYHNLFKECHKRHVEPFVTLHHFDTPEVLHKDGDFLNRKTIDYFVDYAEFCFKEFPEVKYWTTFNEIGPIGDGQYLVGKFPPGIKYDFEKVFQSHHNMMVAHARAVKLFKDENYKGEIGVVHALPTKYPYDPSNPEDVRAAELEDIIHNKFILDATYLGKYSRETMEGVQHILSVNGGQLEISDEDYKILDEAKDLNDFLGINYYMSDWMRGFEGESEITHNATGDKGGSKYQLKGVGQREFDVDVPRTDWDWMIYPQGLYDQIMRVVKDYPNYHKIYITENGLGYKDVFDEKEKTVHDDARIDYIKQHLSVIADAIADGANVKGYFLWSLMDVFSWSNGYEKRYGLFYVDFETQERFPKKSAYWYKELAESKEIK

SEQ ID NO: 6451 - protein, 92 aa, Staphylococcus epidermidis
LKEVFSMAMTVKKNDNEVRIQWRVADIKIPNNEIKNVTQDQDIHAVPEENGKEISRIGSTFGKTNRVLIDTDQHLYIIYTQNDQKVYNELTK

SEQ ID NO: 6452 - protein, 62 aa, Staphylococcus epidermidis
AVLFVYDLYFYFLMGHQNDIVTSIRACTLICNVSGSITKKYDIETIKFTTSYVIKIRNKVRL

SEQ ID NO: 6453 - protein, 47 aa, Staphylococcus epidermidis
WIIFRKDLFKPRRIDTRIWKRYKNTLQKIVGKTLIVIDKSTVKLYDY

SEQ ID NO: 6454 - protein, 54 aa, Staphylococcus epidermidis
TLFSYDLAYIYCSCFFLTYDRHFLFYVIATFSHYKLERKISIIFRNIIILQINT

SEQ ID NO: 6455 - protein, 113 aa, Staphylococcus epidermidis
SVRSCEINSICRSSLEHPTKRVLAPCCGKCRAFYFQNDVVIAKTSMTTIQLQPKQVINMMTQLQDASIIFKQTDCLHNAAISDVKDFLNITTISYVITLLINYTVIIFNDIYR

SEQ ID NO: 6456 - protein, 70 aa, Staphylococcus epidermidis
CKRFFEHHHDIVRHNTLDKLYGYYIQRHIPVRDKILIFSGRISLEILIKAAKIDVGIIFSKSSLLHFNTT

SEQ ID NO: 6457 - protein, 40 aa, Staphylococcus epidermidis
TRISRIFKFWFAKQLMKLRQPINLYSYSSHMIFIVLIYYS

SEQ ID NO: 6458 - protein, 41 aa, Staphylococcus epidermidis
NLPSEDNRARVHVEQNDSDTLVIRPNCASLSLCRKYLATSP

SEQ ID NO: 6459 - protein, 47 aa, Staphylococcus epidermidis
FLIPANNIIHVAKINGHVKVGKPSGASNVLKPKCMNAVSTIPKIIAR

SEQ ID NO: 6460 - protein, 41 aa, Staphylococcus epidermidis
SNVPITKALILEISIDGTVEILNIKHKIMIISGIHTQKFKL

SEQ ID NO: 6461 - protein, 93 aa, Staphylococcus epidermidis
LVMLLNIIEGVTHINPKVLKALAITSNVLLVIGIICLIMLKLMLAIAFFVVSLTISLVIFNVMFRHRTGMKIAINVSFFIVMIAIVIAYFVLS

SEQ ID NO: 6462 - protein, 59 aa, Staphylococcus epidermidis
LHYPKTGLVKVLSKNLQFALITHSPKNKIKCPNYTRNHSIVIKKISKKQHLKSVEIFSK

SEQ ID NO: 6463 - protein, 165 aa, Staphylococcus epidermidis
LHPPELISIQIIKIAPIYSCVRIDWIFYLIVMFVRGHCLEVTNLRKWFYYFNRRNKRMQWLKVILAGFIEIIWVTGLDQAHSLFTWIFTLFFIALSFFLVIDASKHLPVGTVYAFFVGIGAVGTVLVDMIFFNQPFTFTKIFLIMTLILGIIGLKLTTDATKEGR

SEQ ID NO: 6464 - protein, 136 aa, Staphylococcus epidermidis
AIEFYHTNTTSKNQLRRHIIMSNKVQRFIESERELSQLKHWLKTTYRISIEEFVVLYKVYADTKISGKELRDTLHFEMLWDTSKIDVIIRKIYKKELISKLRSETDERQVYYFFDAKQKKLLDKMTGEIETISIAN

SEQ ID NO: 6465 - protein, 92 aa, Staphylococcus epidermidis
PSHTFYLPSFVASVVSFNPIIPKIRVIIKNILVKVNGWLKKIISTNTVPTAPIPTKNAYTVPTGKCFEASMTRKKLKAIKKRVNIHVNNECA

SEQ ID NO: 6466 - protein, 40 aa, Staphylococcus epidermidis
IIWLYSTVVINKILSVIYNSKVNGKISFYNAVLVNILIIT

SEQ ID NO: 6467 - protein, 45 aa, Staphylococcus epidermidis
IIITFKQWIHSTNLTKPGDKTTINILVGFLRDDDINRSMIYVKSA

SEQ ID NO: 6468 - protein, 145 aa, Staphylococcus epidermidis
QSITQSFKEAISMIPGEIIVKNTEIEVNKHHPETVIEVKNTGDRPIQVGSHFHFFEANKALEFDREKAYGKHLDIPAGAAVRFEPGDEKKVQLVEYSGRRKIYGFRGLVDGDIDEERVFRPNDSNQNAAVKNDAGEDNANKKGGK

SEQ ID NO: 6469 - protein, 49 aa, Staphylococcus epidermidis
YCYTISFNPIYLCNMNRNDTHSIFKVFDFEQHKYCYMNVKLLKIHFDNN

SEQ ID NO: 6470 - protein, 58 aa, Staphylococcus epidermidis
TNLTRCLMYKDYNMTQHTLLMETSVLIPTNDISRHVNDIAETIPDTEFDEFRYHRGLI

SEQ ID NO: 6471 - protein, 62 aa, Staphylococcus epidermidis
TKLTRCLMYRDYNKTQLTLPMETSVLIPTNDITRYVHNIVETILETEFRHHRDSTSYHPKMM

SEQ ID NO: 6472 - protein, 41 aa, Staphylococcus epidermidis
DCVTILAKNYKSITLHTNINFSVRVWLVVKQERIKIYFVTH

SEQ ID NO: 6473 - protein, 221 aa, Staphylococcus epidermidis
YSPTRRYNCAHSTGQWGLIKMKAIILAGGESSRFGKAKAFAKIDNQYFYQKIIETLKSTNMFNRIIISTNSQLASQFEYEYVIIDDEHHQNKGPLTGIYSVMKQYMDEELFFIVSVDTPMITSKAVNGLYHFMVSNLIESRLDIVAFKEGEICIPTIGFYTLSTFPFIEKALNSNHLSLKHVIKQLSTDWLDVTEIDSPHYWYKNINFQHDLDSLKKQINE

SEQ ID NO: 6474 - protein, 180 aa, Staphylococcus epidermidis
ALPTVPRPSFCSLFLTPFLKNVAPKEGTRVIETSSEANKLKVMASANGLNISPTEPDTNTSGKNTTIVTRVDDIIGLNTSLVALIIKFSPLSFSFGSDNLLNIFSTTTIESSITRPIATVNAPKVRIFNDTLLNFNAMSAINIDIGIDTIEIAVVLIFLKNRRITIIATIVPRAAFSTIV

SEQ ID NO: 6475 - protein, 41 aa, Staphylococcus epidermidis
LQNAFIHLFLNQNIYNSEIDVIKNINPNNISLIKSSYFFKF

SEQ ID NO: 6476 - protein, 51 aa, Staphylococcus epidermidis
RDTASLNVCLTSFLKRFVSNIRKSIAKMTSMLIMNNVVIRSRVFFNISTNS

SEQ ID NO: 6477 - protein, 87 aa, Staphylococcus epidermidis
RGFYMRKFILLLFIILNLVAIIITINHPLTISYFSLRVIFVAFIFIISIFFIFLRTTNYELILSILSTVFAFIHIGLIIHSAYLYLY

SEQ ID NO: 6478 - protein, 41 aa, Staphylococcus epidermidis
CINYLVKYKGVNKHAQTSTSEYSFKQTDSCSNFDCIGYERL

SEQ ID NO: 6479 - protein, 41 aa, Staphylococcus epidermidis
RYIYSDVLTNIAQLVFLLEELDVENLSELLSRLNSGYILQI

SEQ ID NO: 6480 - protein, 50 aa, Staphylococcus epidermidis
LCHLKNSVKRIRRVLSCIYFATKQIHDMYLKDINKLETPYDTIATIHIVS

SEQ ID NO: 6481 - protein, 122 aa, Staphylococcus epidermidis
RSAHMNKALVIRAIKFSLIFMTAFLILNLLTMKEASISSIIVRTVIAAIVFFVIYIIVFTILSSSERKIIYGTTLPIALFICLIFGAIFFTPRIGIIAGLIIGVFAGVIWEFLNRKNGGRSS

SEQ ID NO: 6482 - protein, 69 aa, Staphylococcus epidermidis
CGYHKIKSLLIKRLIDSKPNKKIMRNYSWEYFNAQIKKSFQNQNKTIYSQSKIDVEPDFGFSLVCPFEG

SEQ ID NO: 6483 - protein, 119 aa, Staphylococcus epidermidis
LFNHMGGFMNYLEISLHIEQQLVKLLSLSENAKYYALIHHNKFESFIDDFNLTVNQEMKWAMSHQLLLNSNDTLLSYCQLIRRLNDSPLLTLNQGHIIYYINTQQTLIHRQLLKHKQAL

SEQ ID NO: 6484 - protein, 296 aa, Staphylococcus epidermidis
QMNHLTTETRNIQTMHLDEMNLSDALKTMNQEDQLVPKAIEPVIPNLTKVIESAIQRFNNGGRIIYIGAGTSGRLGVLDAAECVPTFNVSPNDIIGIIAGGQKAMTVAIEGAEDDAEQGAQDLKNIHLQSKDIVVGISASGRTPYVKGALVYANKMNAETVALSCNVHSDISKNSNHVLEINVGPEVLTGSTRLKSGTAQKLVLNMISTMTMIGVGKVYDNLMVDLRPTNQKLIHRSIRIIQDVCDLNHQEAIELYEKSDHNIKIAIVMHLCSTTQQDARLRLKQNNGVIKQAINT

SEQ ID NO: 6485 - protein, 213 aa, Staphylococcus epidermidis
RWGQVMENNELQRGLNARQMQMIALGGTIGVGLFMGATSTIKWTGPSVILAYLIAGIFLFLIMRAMGEMIYINPTTGSFATFASDYIHPAAGYMTAWSNVFQWVVVGMSEVIAVGEYMNYWFPSLPNWIPGVIAVLFLMAANLVSVKAFGEFEFWFALIKVVTIVLMIIAGLRLILFGIGNGGNPIGISNLWSHGGFMPNGFIGFFFALSIVI

SEQ ID NO: 6486 - protein, 288 aa, Staphylococcus epidermidis
ARRLTERVNLMAEQRWTGQLDLTVFNNGQSSKARNIFFEKALKVLRPIYLEQSPVPTFYIVNVGGGYLDGDRYRVNVNLEDNAQVTLTSQGATKIYKTPNDHVEQYQTFNLSNQSYMEFVADPIIAYENAKFFQHNTFNLKEDSAMFYTDILTPGYSSNGQDFTYNYMHLINEIYIDNQLVVFDNMMLSPDKSRLDGIGYMENYTHLGSAYFIHPDVNQSFIEDIYTAVADFQKQYDCRIGITQLPTHGLAVRILTKRTQIIEEILTRVQSYINQTIYHRQINFLRKY

SEQ ID NO: 6487 - protein, 128 aa, Staphylococcus epidermidis
TLLQQDVHQRSGFIMGKIKDINDLVNATFQVKKFFRDTKKQYNLNYEEIYILNHILKSESNEISSKEIATCSEFKPYYLTKALQKLKDLNLLSKKRSVHDERTVIVFVSDEQREKIKKLILELENYIK

SEQ ID NO: 6488 - protein, 55 aa, Staphylococcus epidermidis
KSKHVNNFLNQFAVHLINITIFGGVKYYEKNQNNLDIGSWTWYSISRSHNTCRCG

SEQ ID NO: 6489 - protein, 178 aa, Staphylococcus epidermidis
INMHKHQHQNIHLNRPIHVAILTVSDTRDYDSDKGGQLIQSLINQHENHVDINHYRIVKDDIEAITHQLKLWLTSSNQLDVIITTGGTGISQRDVTIEAVRPLLTKELEGFGELFRYLSYTEDVGTRALLTRAIAGTCDSTLIFALPGSTGAIKLAIEKLIKPELSHLVFELNKDIRY

SEQ ID NO: 6490 - protein, 46 aa, Staphylococcus epidermidis
TLSHNCKNIVSILSIYSIITEIRLSKIQSRFRDGVKLWKIMSCKGD

SEQ ID NO: 6491 - protein, 49 aa, Staphylococcus epidermidis
TPPNIIKTTIKKIANLLPNENCNNFLIIHFFLSYKKSERSQFIYRSVQI

SEQ ID NO: 6492 - protein, 324 aa, Staphylococcus epidermidis
VIHKKTLGVSTMTKVYFNHDGGVDDLVSLFLLLQMENIELVGVSTIGADCYLEPSLSASLKIINRFSDVEINVAPSYERGKNPFPKEWRMHAFFMDALPVLNESCIPKRCKASEDEAYIDIIRKVKSCDEKVTLLFTGPLTDLAKAIKYDNSILKNIEKLVWMGGTFLDKGNVEEPEHDGTAEWNAFWDPEAVKVVLDSDMIVDIVALESTNQVPLTMEVRQMWADKRQYLGVDFLGTSYAAVPPLTHFVTNSTYFLWDVLTTAYVGSPNLVESTKLKIDVVSQGPSQGRTFQSENGREVQVITDVNKQAFFKYITDLAKKIET

SEQ ID NO: 6493 - protein, 368 aa, Staphylococcus epidermidis
YKHKNLVKRGKKMKIAIVGSGNGAVTAAVDMVDKGHDVRLYCRNESISKFDVALEKGGFDFYNEGEEKFIEFTDISDDMEYVLDGADIVQVIIPSSFIEYYAKVMSKFVTNDHLIFFNIAASMGSIRFMNVLEDRHIDVHPHFAEANTLTYGTRVDFNNAKVDLSLNVRRVFFSTFDRSELNESYEKVSKIYDYLVKEESLLKTNLENGNPEVHPGPTLLNVGRIDYSEEFSLYKEGITKHTVRLLHAIEIERLNLGRKLGFELSTAKESRIQRGYLERKDEDEPLNRLFNTSPVFSQIPGPNHVENRYLTEDIAYGLVLWSSLGRVIDVPTPNIDAVIMIASTILERDFFEEGLTIEELGLDKLGLE

SEQ ID NO: 6494 - protein, 263 aa, Staphylococcus epidermidis
LINNNEVDEAMFMSKITFKDIYIDGNKITEDTRKVIYLLPSQPLKYASNTWIYKTMPTMNQWLKDIEVQKKMHLNQSSYHLSFSFPANEKIDEVLLEKIRELGFQIGVLELYVIEAKALKELSRKRDVDIQLVSSNNINDYLHVYDVFARPFGDSYANMVKQHIYSSYNLDDIERLVAYVNQQPVGIVDTIMTDKTIEIDGFGVLEEFQHQGIGSEIQAYVGHMANERPVILVADGEDTAKDMYLRQGYVYQGFKYHILKENI

SEQ ID NO: 6495 - protein, 405 aa, Staphylococcus epidermidis
SNDKGGAVMNQSTIIKDPIFTKSFNINFAINFFVYLCMYLLIVVIASYSKSEYHASDSVAGLVVGLFIVGSLIGRFVTGKYVNRFGPKKILIFGLICLVVTQLLYFIPGSVWFLMMVRLLNGLATAVATTATGTIAAYITPPTRKSEGISLFSLSLVLGTAIGPFFGMLLMNSFSINILFTICVILGVISGLLSLLIKINFTTVKENTITHKRFNLAHFVAKEAIPVAFVMLLIGVTYAAILTYLQAFAVERDLVTSASYFFIFYAIASLITRPIAGRLMDDKNENVVVYPAFIFLVLSFVLLMLSFNGWVLLIAGIALGIGYGNLSSCMQAIAIKVSPSNKYGLATSTYFIGLDIGIGFGPSLLGLFTHMISYSQLYGIMGILGFATLVIYIFVHGRKVYSTSY

SEQ ID NO: 6496 - protein, 190 aa, Staphylococcus epidermidis
NLCKEDEQVTTKHLVYTALMTAIICILGLVPSVPLPFMPVPIVLQNIGIFLAGIILGRKLGTTSVIVFLLLVATGLPVLSGGRGGIGVFAGPSAGFLFLYPVVAYFIGIIRDAYLHKINFLVIFIATLVIGVLGLDILGTLIMGFIIHIPISKAFILSFTFMPGDIIKAIIASLIGAAILNHSRFKTLIQ

SEQ ID NO: 6497 - protein, 551 aa, Staphylococcus epidermidis
IKSNKDKHILVIIIKGSGRYSKMNAIKRFGSAMIVPVLMFAFFGIVLGFATLFKNPTIMGGLADQQTFWFKFWSVIESGGWVIFTHMEIVFVVGLPLSLAKKAPGHAALAALMGYLMFNTFINAILTQWPHTFGANLKKGVENTTGLKSIAGIETLDTNILGAIIISGIITWIHNRYYSKRLPEMLGVFQGLTFVVTISFFVMLPVAAITCVVWPTIQHGIASIQYFIVASGYIGVWLYHFLERVLIPTGLHHFIYAPIEVGPVVVNHGLKAEWLQHLNQFAESNKPLKEQFPYGFMLQGNGKVFGCLGIALAMYATTPKENRKKVAALLIPATLTAVVAGITEPLEFTFLFIAPFLFVLHALLAATMDTLMYGFGVVGNMGGGVLDFIATNWIPLGKAHWMTYVFQVVIGLIFVAIYYFLFKYLILKFDIPLPGRKKGEEEVKLFSKQDYKDKKGDSTRNHSPNSEYEEKAMYYLEGLGGKENIKDVTNCTTRLRLTVKDESKVQESAYFTHNQMSHGLVKSGKSVQVVVGMSVPQVREAFENIVNDDLS

SEQ ID NO: 6498 - protein, 244 aa, Staphylococcus epidermidis
NPIKLNKFLKNINFLYKEFRAMPDLTSFWISFRVALISTMIVTIFGILISKWLYNKNRYWVNLLESFIILPIVLPPTVLGFILLIIFSTRSPVGEFFTNILHLPVVFTLTGAVIASVIVSFPLMYQHTVNGFRSIDSKMLNTARTMGASETKIFFKLVLPLSKRSILAGIMMSFARAIGEFGATLMVAGYIPDKTNTLPLEIYFLVEQGKENEAWLWVLVLVAFAVTVIATINLVNRDTFREVD

SEQ ID NO: 6499 - protein, 40 aa, Staphylococcus epidermidis
KSSKNYKKDNSYIISIEIVFIYLSWNFLSQPFFNNLIVSV

SEQ ID NO: 6500 - protein, 344 aa, Staphylococcus epidermidis
GGPKMKALIQDKLGRPIRDLRISVTDRCNFRCDYCMPKEIFGDDYTFLPKNELLTFEELTRISKIYAQLGVKKIRITGGEPLLRRNLYKLVEQLNLIDGIEDIGLTTNGLLLKKHGKNLYQAGLRRINVSLDAIEDNVFQEINNRNIKASTILEQIDYAISIGFEVKVNVVIQKGVNDNQIIPMIDYFKNKNIEVRFIEFMDVGNDNGWNFNKVVTKEEMLNMIEQHFEISPVTPKYYGEVAKYFRHKDNDAQFGLITSVSESFCSTCTRARLSSDGKFYGCLFASSEGFDVKALIRSGATDDDLKAQFKRLWSIRNDQYSDNRTMQTIENNRKKKINMNYIGG

SEQ ID NO: 6501 - protein, 56 aa, Staphylococcus epidermidis
IIKNTYRIIFSHMSSSRCPSVYLKLNFSPIAKLNLTRQHLFFSVYYTTLEKLVVTN

SEQ ID NO: 6502 - protein, 1051 aa, Staphylococcus epidermidis
MIKKLLQFSLGNKFAIFLMVVLIILGGVYSSAKLKLELLPDVENPVISVQTTMSGATPQSTQDEISSKIDNQVRSLAYVNSVQTESIPNASIVTVEYDNGTDMDKAEEQLKKEIDKIKFKDGVGEPELTRNSMDAFPIVAYSFTSNNQKLKDVTKKLNQQLVPKLQTIDGVQNAQLNGQTNREVSLKFKQKNLDEKGLTANDVENYIKTATRETPLGLFQFNKSNKSIVVDGQFKSVDAFKNLKIPLSISGQAAQNDSDSDSDSLMPSDNTRSTNSSTHMAQKGQMPSVPLKDLADISVGDERTSISKTNGKDAVNLQIMKSQDANTVQVAREVQKKVDEFVRNESGMKSIKTMDTAKPIEDSLYTMVEKAALGTIVAIIVILLFLRNIRTTAISIVSIPMSILIALIALKLSNVSLNILTLGALTVAIGRVIDDSIVVVENIFRRLSDPNEKLKGENLIISATREVFKPIMSSTLVTIVVFLPLVFVSGSVGEMFRPFALAITFSLLASLLVSITLVPSLGATFFKNGVKNREQKEGLGTVGRAYRSALNWSLNHKWIVLIVSIFILVGSVVIGARNLGTSYISTGDNKFLALTYTPKPGETQKSVTQHAEKVQNYLDKKDKVETVQYSIGGPTPQDPTGSTNSMAIMIKYQSDTPNFDEEPDKVLKHIETFKQPGEWKNQDLGTGAGNNSVEVTVKGPNTSAMKDTVNRVEKMMTDIKGITNVKSDLSQTYDQYEIKVDQNKAADNGISAAQLAMNLNENLPEKTISTVNEKGKSIDVKVKQNKQTDWSSQKIKNIKLNKPTGGTIKLSEIASLKKSYTPSKLTQEDGDYATTVTGKVTDKDVGGKSQQVMAKVKDLEKPSHIKINVGGATDDIDKAISQLAMAMIAAIIIVYLILVITFRGGLAPFTILFSLPFTVIGVVLALIITGETISVPSLIGMLMLIGIVVTNAIVLIDRVINNEKQGMPMKQALIEAGGTRIRPILMTAIATIGALVPLLFGHDSSILISKGMAATVIGGLISSTLLTLFVVPVIYEILFTLKNKITKKFNM

SEQ ID NO: 6503 - protein, 417 aa, Staphylococcus epidermidis
TMEKMNITNQQHDAFVKSHPNGDLLQLSKWADTKKLTGWYSRRIAVGENGQIKGVGQLLFKKIPKLPYTLCYVSRGFVADYNNKEVLEALLSYAKEVAKDEKSYAIKIDPDVEVDKGAEALKNLRELGFKHKGFKEGLSKDYIQPRMTMITPIDKTDDELVQSFERRNRSKVRLALKRGTKVERSNREGLKIFANLMKITGERDGFLTRDISYFENIYDALHEDGDAELFLVKLEPKPVLDTVNQDLEAQLAEKEKLQSKKQDKKTLNKLNDIDNKIKKTNELKSDLTELEKSEPEGIYLSGALLMFAGNKSYYLYGASSNDYRDFLPNHHMQFEMMKYAREHGATTYDFGGTDNDPDKDSEHYGLWAFKRVWGTYLSEKIGEFDYVLNQPLYHLVEKVKPRLTKAKIKISRKLKGK

SEQ ID NO: 6504 - protein, 231 aa, Staphylococcus epidermidis
LSLNKLERQNRIIQTIQSSDKITASQLAKQFNVSKRTILRDIDELEDQGVKVYARHGKLGGYQIKDAHAKITLSLTEQQLSALFLTLNESQSNSTLPYQNEIRAIIKQCLNLPQTRLRKMLKKMDYYIKFEDSNHVTLPQLFSDILIYCTERNVMLVDLNENNQIQAENVIFIGLICKNAVWHAVVFEIGRGYTRELSILDIQDISYSFEKTIQTQDISIENYRQFLAPSE

SEQ ID NO: 6505 - protein, 263 aa, Staphylococcus epidermidis
AIMKIKHIFIIILTLCVVLAGCTNEKGQNKEQNEKQSTKGDKQELQVSAAASLTEVSKALGNEFKKDHPNVEIKFNYGGSGALRQQIEAGAPSDVMMSANTKDIDLLKKKNKAHDTYNYAKNQLVLIGDKNKSYTSVKDLNQNDKLALGQIKTVPAGKYAKQYLDDQHLYGDVKDKIIFAKDVKQVLNYVEKGNAQEGFVYKTDLYQQKKKANKVKVIEEIKLSKPITYKAGATSDKKLAKEWINFLKSNKAKQILKEYQFSV

SEQ ID NO: 6506 - protein, 50 aa, Staphylococcus epidermidis
MVMNLSLLSINWCIQQHKHKKSYEDIELSLYLHSSLFIKMTAFLIFNFII

SEQ ID NO: 6507 - protein, 50 aa, Staphylococcus epidermidis
MTKKTIAAMTVRTIIDDIEASFIVNKLRIKNAVINIKENLIARITSALFI

SEQ ID NO: 6508 - protein, 163 aa, Staphylococcus epidermidis
RRIDTMILQIVGMKNSGKTTLMNHAISFLKERGYSVATIKHHGHIGEEIELQSSDVDHMKHFAAGADQSIVQGHHLQQTVTRKKKQSLREIIENSVTIDYSIILVEGFKEANYDKIIVYKNNDELRSLQGLSHVIGKIETNHPRANNQLEHLLNKLIKDKGMN

SEQ ID NO: 6509 - protein, 262 aa, Staphylococcus epidermidis
ELVEMLKNTRLRMTTLFIISILVILAILFLIFDTNLFKNDVKHTFKEAVSLQTSEGNIHTKEVNGKFIYASKQDIEKAMQIKHSDNDLKYMDISEKVPMSEKEVNHILKGKGILENKGSTFIKAQDKYEVNILYLISHALVETGNGQSDLSKGIKEGNYHYYNFFGIGAFDEDAVKTGKSFAKQKKWTTPEKAIMGGAWFVRYHYFKNNQLSLYQMRWNPQNPGQHQYASDIQWANNIADLMEKYYDKYGIKKDHIRKKYYK

SEQ ID NO: 6510 - protein, 47 aa, Staphylococcus epidermidis
YNYDKLFSHIDSFFLVYTNEYFDIVSHLFRSIVFRDIIFIKCKNYYY

SEQ ID NO: 6511 - protein, 208 aa, Staphylococcus epidermidis
EAYEMSNPIKIGIGGPVGAGKTQLIEKVVKRLAKEMSIGVITNDIYTKEDEKILVNTGVLPEDRIIGVETGGCPHTAIREDASMNFAAIDELLERNDDIELIFIESGGDNLAATFSPELVDFSIYIIDVAQGEKIPRKGGQGMIKSDFFIINKTDLAPYVGASLDQMAKDTEVFRGNRPFAFTNLKTDEGLEKVIEWIEHDVLLKGLT

SEQ ID NO: 6512 - protein, 150 aa, Staphylococcus epidermidis
YDNEVLNILTNEFFNSFIGIYRPYIKLTQPILDQHQIHTGQWLVLRDIANYQPTTLVKISHRRSIEKPTTRKLIKVLLDNGWVMTKTGVDKREKLLSLTDKGQILFETINKKVTVIQQDIIKKTGLTDEQVFDITNAMSQIHEAMIKEEQ

SEQ ID NO: 6513 - protein, 276 aa, Staphylococcus epidermidis
NEGEIMTELYLKKLDEYICQWIRGLDDIIPRLVEKMETSTKKDRFDLVTNVDKQIQNHFQNFLQEHYPTHQLLAEEKDNSDITPYEGHLWIMDPIDGTSNLVKQQEDYCIIIGYFIDGEPKLSYIYDYPHQRLYRAIAGIGAYENNQLMTMPKRIGLREAIISFKPQVLKEETVQSLFQSAFDFRSIGSCGLDSIRVIKGQFGAHINTNPKPWDISAQFLFARELGLIMTQINGEPLDFSKAGPFIISNPGCYDDMIRILNEGGGYSKSSHHIERG

SEQ ID NO: 6514 - protein, 270 aa, Staphylococcus epidermidis
LKLDFVKMSNNMWRGIKLNLKLDHIIHYIHQLESFKFPGEILELQNGGRHHHLGTFNQIAPIKNSYIELLDVENESKLNNVAKTEEGRVSFATKIVQDHFKQGFKGICFRTKDIDQVKSSLENRGVDVIGPIDMERENKKGHQLSWRLLYIANPDYRVKPPFFIEWDNSKKQNLSQIHNFNLSSFKIKEVIITSTQRETTVSLWKEWYNLKIVNETATSTDLKLETDEVIYKIEDGKDSGFHTLIMTDINATAPYSIFIRGAKYRFEPPN

SEQ ID NO: 6515 - protein, 55 aa, Staphylococcus epidermidis
IKKDSITFTPPMTHFILNLIIHSLTLDFIFSKFTNGTSYAFPSDIEKLTINIYIT

SEQ ID NO: 6516 - protein, 64 aa, Staphylococcus epidermidis
PFEEENDTMDLNSKLSELKYDYTRLQNDLEKRESLHQDIDPLLKQLENIEQEISYIRSKLNQQS

SEQ ID NO: 6517 - protein, 249 aa, Staphylococcus epidermidis
LRKDYHQMQQQKIKRFLAHFVLDHVTIEYLKYGHQLTIEQLKLLIFILHFTENHKEDLSLNMIIFYKNYQKNQLLKSITHLYEFNWISKKRHPYDQRRLVITLTQNQCSKITQLIDELEHFLEVKSTLINEINHSTLLSYYLKCHSQFRVIEQSCTSQHLTLEELYLLGLLIVSDNKTTFKSIKVHALKGIIAMGPIIKTLQSKGYLIKSRSRDDERYIVLTLRKEKINVIQSEIEECYNKLEQGIQHV

SEQ ID NO: 6518 - protein, 70 aa, Staphylococcus epidermidis
RMNWRYSKMGYIILFFIAGPVIIGVGNLILGPIFNKRTPLHVQFRSFIIGSLVYLILATICYFLFLQGKL

SEQ ID NO: 6519 - protein, 261 aa, Staphylococcus epidermidis
ITFWKSKFKNGDPFTIALFGVDSDEKRKQQGGGERSDTIMVLSINPKEKKTELVSIPRDTKAEIAGRGTEEKINHAYAYGGPNMAVKTIEKLMNVPIDHYATIDMDGLHDMIDTLGGVDVVSNSTFTMGANHFVKGEKTHVDGDAAMDFIRSRKEDGAGGDFGRQERQQLILEAMADKLTSASSITHFNTLMNQIQKNVKTDLKLGDLNTIRTKYKDANDQVNRHQLEGEGGIQNDGLYYFIPSDASKNENTQLLRDNLNL

SEQ ID NO: 6520 - protein, 57 aa, Staphylococcus epidermidis
LLIRNKITIIFQLQSKVLVILKKKSGTIYLNEQRIKYKHSYHFHTYIVNDWRSPYVD

SEQ ID NO: 6521 - protein, 335 aa, Staphylococcus epidermidis
LFALSYFTILFIKEGVMVMTKVYIAGAIPEVGLNLLKEHFEVDMYDGEGLIDKETLKKGVEHADALVSLLSTSVDKDIIDSANNLKIIANYGAGFNNIDVEYARQQNIDVTNTPHASTNATADLTIGLILSVARRIVEGDHLSRTTGFDGWAPLFFRGREVSGKTIGIIGLGEIGGAVAKRARAFDMDVLYTGPHRKEEKERDIGAKYVDLDTLLKNADFITINAAYNPSLHHMIDTEQFNKMKSTAYLINAGRGPIVNEQSLVEALDNKVIEGAALDVYEFEPEITDALKSFKNVVLTPHIGNATFEARDMMAKIVANDTIKKLNGDEPQFIVN

SEQ ID NO: 6522 - protein, 182 aa, Staphylococcus epidermidis
YNYSCIKSFFLQMEVKPIMDKHTNYNELESKNVSDQTSSDNLSNDNIVHQQSTIQNEESQDNRLMAMLIYLLSLFTGIIGPLIIWLIKRKESRLVDVSGKTYLNYFISYTIYSTVGVICMFMIVPLMNISESLAIFSLILLLVVVFILLALLIMSFVCTIIACVKYMSGKTYTIPLTIPFIK

SEQ ID NO: 6523 - protein, 53 aa, Staphylococcus epidermidis
SPPSNIIIRNPIMFAIIETIPAFLEPIKIPIRINKPPIMLGIKNICPNPSKTD

SEQ ID NO: 6524 - protein, 110 aa, Staphylococcus epidermidis
KGWLFMKLYLILLPVLYLIVSYISIFKMHSVITRILRIVMGILLLFVVALTTLQFPKENWWVFVVLLLLVGNVEVTGFKELKDDKKGVSILNILSLLLFVIFIILIFILY

SEQ ID NO: 6525 - protein, 114 aa, Staphylococcus epidermidis
CNERREIKSMAWLFLMIAGSFEILGVVLLNELSRTKNKIYVIFLGLAFILSFSTLKFAMVSIPMGTAYAIWTGIGTAGGTLIGMIFYGESTRLSRILCILLIIISVVGLRLISY

SEQ ID NO: 6526 - protein, 573 aa, Staphylococcus epidermidis
ISMSFKMTQSQYTSLYGPTVGDSVRLGDTNLFAQVEKDYANYGDEATFGGGKSIRDGMAQNPNVTRDDKNVADLVLTNALIIDYDKIVKADIGIKNGYIFKIGKAGNPDIMDNVDIIIGATTDIIAAEGKIVTAGGIDTHVHFINPEQAEVALESGITTHIGGGTGASEGAKATTVTPGPWHIHRMLEAAEEMPINVGFTGKGQAVNHTALIEQIHAGAIGLKVHEDWGATPSALSHALDVADEFDIQVALHADTLNEAGFMEDTMAAVKDRVLHMYHTEGAGGGHAPDLIKSAAYSNILPSSTNPTLPYTHNTVDEHLDMVMITHHLNASIPEDIAFADSRIRKETIAAEDVLQDMGVFSMVSSDSQAMGRVGEVVTRTWQVAHRMKEQRGPLDGDFEYHDNNRIKRYIAKYTINPAITHGISDYVGSVEAGKLADLVMWEPEFFGAKPDLVVKGGMINSAVNGDANGSIPTSEPLKYRKMYGQFGGNITHTAMTFVSNTAYENGIYRQLNLKRMVRPVRNIRNLTKADMKNNNATPKIDVDPQTYEVFVDGNKITSEAATELPLTQRYFLF

SEQ ID NO: 6527 - protein, 51 aa, Staphylococcus epidermidis
SFIFSFLIKNLNALNLSIEAFRSECSSYLPLSLRDILILAFVKRGFTFSTK

SEQ ID NO: 6528 - protein, 257 aa, Staphylococcus epidermidis
LLVSGKDTMMKKDKKRQSYRFKDIVWRDFSLIAIGFLCIFIFSFIGLTIAAIAFQSINELQLTMIGTLGQFMSYILVILAFYFLHINSFVDRVKSGFDYLKKHWLFIIIVMCASFIISNVYDKLIELLPKYLQYSETQNELELNELFKSGIFIPFAFVLIVIVGPIVEELVFRHLLIGELGKKFNFIVMGVISALSFTYIHVSDAKSPFEFGAYLILAIALVYVYLKSNRNLASSISLHMLNNFISFIWTIIVVFSK

SEQ ID NO: 6529 - protein, 68 aa, Staphylococcus epidermidis
KKWRSLILTIIIGLIVIILLIISLLPNYKAMVLAKQQGQKPTRYTIMVGIDLLLIILIIVTLVLKLIM

SEQ ID NO: 6530 - protein, 51 aa, Staphylococcus epidermidis
ITIGMRFHKCVMLLISDVHLFHGLKYLLYFTVILIIHLNENDVDDVTFKPF

SEQ ID NO: 6531 - protein, 43 aa, Staphylococcus epidermidis
FIYGANIQVITLAIMALIPTFQFTANSPIKMNNPVYGLLIKTT

SEQ ID NO: 6532 - protein, 51 aa, Staphylococcus epidermidis
SAFGHVAFVESVNNDGSITVSEMNCDGGPFAISTRTISASEASSYNYIHLN

SEQ ID NO: 6533 - protein, 42 aa, Staphylococcus epidermidis
LLLGNIFLNHLLNTTIIVQMNDMKLFNICKLIDEAKFLFDFK

SEQ ID NO: 6534 - protein, 46 aa, Staphylococcus epidermidis
LNSGLINFSIASLIAPVEPGSAKIKVLSQVPAIARVNNALVPTSSV

SEQ ID NO: 6535 - protein, 249 aa, Staphylococcus epidermidis
SYQGVELIGISAGETKNPQTNIVKAVNGVIWRILIFYIGAIFVIVSVYPWNQLGSIGSPFVATFAKVGITFAAGLINFVVLTAALSGCNSGIFSASRMIYTLAKKGQMPKVFTKVMKNGVPFYTVFAVSMGILIGALLNVILPLIIDGADSIFVYVYSASILPGMIPWFMILFSHLRFRRLHPEKVHNHPFKMPGGAIANYLTIMFLLLVLVGMLLNKETVVSVVIGIVFLTAVTLYYLIRYHKKERQI

SEQ ID NO: 6536 - protein, 84 aa, Staphylococcus epidermidis
SKKGESKMKILYFAELKELLNQSTETIHLDTTLTVQEFESYLLKHHSELKSKKFQIAVNEEFVRQDDIVQPGDTIALIPPVSGG

SEQ ID NO: 6537 - protein, 218 aa, Staphylococcus epidermidis
ILKGDDNMYKAVVFDFDGTVIDTEKHLFDLINTHLKIHQVAPISLEFYKQFIGGEATELHTYLEDAIGFKNKEKIYDQYYQTSVELPVNPTIIQLMQYLKKRHIPMAITTSSYKKNIYPIFKQLGLDTYIDVVVGRENVDSVQPNPEIFLKAVQELNYNPTNCLAIEDSVNGATAAMLAGLDVVVNTNIITKNQDFSTVQCVGQDMEFEDIKNFLFKE

SEQ ID NO: 6538 - protein, 125 aa, Staphylococcus epidermidis
YIRGKLTMTDAITAPVKVNTTGKCKILVKNSPTGLLVENIINSIKPRTVGGNTIGKMIKLSNRFTQYLFLLYSHLEIKMPKIVTIIVLIKATRKEIQKDVKSGIALNSLYRKLIFFKNLFSFIGF

SEQ ID NO: 6539 - protein, 264 aa, Staphylococcus epidermidis
FSGGYLTMKKIATATIATAGIATFAFAHHDAQAAEQNNDGYNPNDPYSYSYTYTIDAEGNYHYTWKGNWSPDRVNTSYNYNNYNNYNYYGYNNYSNYNNYNNYSNYNNYQSNNTQSQRTTQPTGGLGASYSTSSSNVHVTTTSAPSSNGVSLSNARSASGNLYTSGQCTYYVFDRVGGKIGSTWGNANNWANAAARSGYTVNNSPAKGAILQTSQGAYGHVAYVEGVNSNGSIRVSEMNYGHGAGVVTSRTISASQAASYNYIH

SEQ ID NO: 6540 - protein, 387 aa, Staphylococcus epidermidis
VIGGVNVMESFLIHTDIQKKWIRKFKKIESEFKARAAENDIQSRFPYENIEWLIKEGYTKLTLPVEYGGEGATIEDMVILQSYLGTIDGATALSIGWHLSVIGQLYEQHMWTPSMLDSFAKEVVHGALINRAVSEAETGSPTRGGRPSTHAVKAENGYVINGVKTFTSMSKALTHYIVGAYVEETKSMGFFLIPQSTKGVSIADNWDMVGMRATESHDLILDDVYVPNENFVESKRESRPNGWLLHIPSCYLGIAQAARDYAVDFAKNYRPNSITGTIDSLPTVQQNLGKMESLLLSARHFLWSTARGYQSYTEDAQIWNETSASKVVVMNQSIEIVDLAMRIVGAKSLEMSRPLQRYYRDIRAGLHNPPMEDMAYTNIAKSITNKL

SEQ ID NO: 6541 - protein, 49 aa, Staphylococcus epidermidis
ILIISIFFYIYIDFSKYCSIISSNQRKISKIQILFIHIALLIIIKMNFQ

SEQ ID NO: 6542 - protein, 151 aa, Staphylococcus epidermidis
VMIIEEIQGNIANLSQDEKQKHVEKVYLENSDLVKRIQRVKTDHGNEIGIRLKQPIDLQYGDILYQDDTNMIIVDVNSEDLLVIKPRNLKEMGDIAHQLGNRHLPAQFTETEMLIQYDYLVEDLLKELGIPYSHEDRKVNQAFRHIGHSHD

SEQ ID NO: 6543 - protein, 46 aa, Staphylococcus epidermidis
TTSIFQCLLYNSRKISSNKLDFNYINFLLYLYRFLKILLNHIIKST

SEQ ID NO: 6544 - protein, 305 aa, Staphylococcus epidermidis
MEAIKLKLIKVILSSISQVVLINNPYTGLFILIGLFAVNWKVGISAMIASVMTWILAPYMNYTKEEIESGLAGFNPVLTAIALTLFLDSNWSGILITFVATILTLPIGAAIREVLKPHKIAFLTSPYVIMTWITLLIPNQLKTLHTQIDIIPEHIEKVSLNNDHTSVHFFQSVLDGFGQIFLMPSIIGGLLILIGIFIGSKKAGIVSIIANIIGFLIIILLGGDYSSINEGIFGYNVVLSAIALGVTFETAIHSYLAMILGIVLTAFIHLGLSTLLAPLGLPTLTWPFIFATWIMLFAGIKNQTV

SEQ ID NO: 6545 - protein, 660 aa, Staphylococcus epidermidis
GRHMRENYSIRVFNNLAINTENALSVKVFYCLKGKCEVTINVQKHILEKDDIAFVVMNDTYSLLSNTETMCCIIDIPIHRYLSQKDTQFLISGTKIDESSRDRIKYWILKILELHCLSYNDVSEIQRLIQFLLIELSYLKKPKLDVNKDFYLSEDIHQYLVDHHDSKINKHELAEAVNLSNQALTSMFKQTPFQTFNQYLNQLRLKFCLIDILTTHKPIEEIAIDHGFHHYSRFIQLFKNTYGYTPKLIRRDYIATSIFKNTAEEIDLDRHFLMNIHELQDLDSKIISKKYIKMSDKGKKYRSYDIYIEDNRSTILDQEQIVHIKRNLSLSQKSMRYVIELNYTSMIENKELCRYEMLKILRFCSGLNLIPTFKIITDRHDTFTSKEKMALKLTFQMLFIMLREFNQLEIEFIVEDMMLKQVVQLKKMISSYFEYYKLNYRIKNEKIGNVNYQNLEKQVTQIFIPIDQLHLYIKEISFEKVILETSYLTDLKSEIVEYSWIQHIHTLIKMSGEVRGVLIQPSYDYAATYTYHSNLKPYHILSYVIRMFNQLRGTIVYKDDAIIMTKYKYEYQAIAIFLKNRIKENVNHQQLIFSDIQSLNHAEYEYIEMMPLLMNENNELDSHIPYPHQYWLAKLKSKESQQAIVDLPKMSIAHLTFLCS

SEQ ID NO: 6546 - protein, 52 aa, Staphylococcus epidermidis
FWIFTRMSVRGMNKAKRQLRFVLMTLNIIKVTTQRAENNQKIIKKTISILFQ

SEQ ID NO: 6547 - protein, 68 aa, Staphylococcus epidermidis
SLYIRHLVKLVYWYLLNYTKGPYFLKYFNIKLHISTKYFGETLEGTGQAEDYRLKLSDKKASQQYEVL

SEQ ID NO: 6548 - protein, 42 aa, Staphylococcus epidermidis
SLYIRHLVNLVYWYLLNYTNGLIFLVFQCKIAYKNKVFWRDS

SEQ ID NO: 6549 - protein, 267 aa, Staphylococcus epidermidis
GGNIVFEELENKVVLITGAATGIGKSIAENFGKAKAKVVINYRSDRHHSEIEEIKQTVAKFGGQTLAVQGDVSIEEDIKRMIETTINHFGTLDIIINNAGFENSIPTHEMSIDDWQKVIDINLTGAFVGSRETINQFLKENKKGTIINISSVHDTIPWPNYVHYAASKGGLKLMMETMSMEYAQYGIRINNISPGAIVTEHTKEKFSDPTTREETIKMIPAREIGNAQDVANAVLFLSSDLASYIHGTTLYVDGGMMNYPAFMGGKG

SEQ ID NO: 6550 - protein, 290 aa, Staphylococcus epidermidis
LPNILYKIDNQYPYFTKNEKKIAQFILNYPHKVVNMTSQEIANQLETSSTSIIRLSKKVTPGGFNELKTRLSKFLPKEVTQYNVELVDNESTISLKNKLHSRSKAALSNANETINAAIIDEICDLIKNSETIFIYGYGASFVVATDLYQKLSRIGLNIQLVHETHIFTTMLATRNSNDCVIFISNNGTQSEMQSIAKVIADYHIPIATISSTSDNPVAKQSNIVLTYGQTDENEMRMGATTSLFAQMFTIDILYYRYIALNYQSSLDFITQSKIALDNYRKHLSNIDFKH

SEQ ID NO: 6551 - protein, 232 aa, Staphylococcus epidermidis
DIRMIDHQHLRLFQFCDSQFPTGAFSHSFGLETYIQRETVHDTETFIKWLHLFINEQLTYSDGLAMRIVYHALINNDKDKILDINQKLFVQNLPKETRIGAKQMGTRMVKLALDLYDSEWIQWYYNQMKNHKIKLHPAVCFTMLGHFLGVDVESIIDYYLYQNISSLTQNAVRAIPLGQTAGQQVVTEMIAHIEKTRNHILELDEIDFGMTAPGLELNQMEHENVHVRIFIS

SEQ ID NO: 6552 - protein, 195 aa, Staphylococcus epidermidis
NISIHIIFIHILLTIGGPHMLIDKFETYIINVAGLKSRSTRKKLIHLCKEITFCESFQYSIIKQNNVFALEVSLPKLQLPYLISFLSFHNYAIYQILLPNRVNELLDSEQLYQSIKRFDLAIDGLQDAFIKDKVIDIMNMFANHHNVNYTLNNNCASVTCPPEIFTKLLQTIATRNIDILSASYRAKMLHKARIS

SEQ ID NO: 6553 - protein, 45 aa, Staphylococcus epidermidis
CNIILKNLAKMFKTKIREYLTQPSLICKKPRTFRSRFLTQALHYM

SEQ ID NO: 6554 - protein, 61 aa, Staphylococcus epidermidis
VSIIILPKSFFYILNFLVILFFKVNKISYITGTTKSVSSVEEINPPITVAAIPFEINIELS

SEQ ID NO: 6555 - protein, 58 aa, Staphylococcus epidermidis
LKIMNIYLIFLLLMLTLNFHSIVKEIFKNSKGVYAYEYSFKPKKPETSFIVPSFLSYS

SEQ ID NO: 6556 - protein, 206 aa, Staphylococcus epidermidis
MLTIKVNGVLYQTKININIEDQHPKIYAIQGPSGIGKTTILNIIAGLKSINYSYIKVGKRVLTDSQHHLNVKVQQRRIGYLFQDYQLFPNMNVYNNITFMTKPSEHINELIHTLKIEHLLEKYPVTLSGGEAQRVALARALSTKPDLILLDEPFSSLDDKTKKEGIKLILKIFEAWQIPIIFVTHSNYEAQQMAHEIITIEDCIQI

SEQ ID NO: 6557 - protein, 229 aa, Staphylococcus epidermidis
  MOD_RES (167)..(173): Variable amino acid
VATISSARICPKLSSKLTLIFFTSTCCFIIRLIASLTDIGVLFSIDIHSSPKNINFHDILTPNRREKMTHFTHINKQGNAKMVDVSNKEITKRVAEAHSSIIVNEKIYRQITQNTNSKGNVLNTAQIAGIMAAKNTSTIIPMCHPLPLTGIDISFKWDSNNDDSYRXXXXXXXSTTGKTGVEMEALTAASVTALTIYDMTKAIDKGMIIGETYLESKSGGKSGDFHRKN

SEQ ID NO: 6558 - protein, 132 aa, Staphylococcus epidermidis
LDKIIKVLYLYTSLNSFNIKFARQINMKEGIVLHFTQREQDKLMIVVAAEVARRRKARGLKLNHPEALALISDELLEGARDGKTVAELMSYGKTILNEEDVMDGVANMITELEIEATFPDGTKLITVHHPIV

SEQ ID NO: 6559 - protein, 375 aa, Staphylococcus epidermidis
NMKIAIVGAGIGGLTAAALLEEQGHQVKVFEKNTSINELSAGIGIGDNVLKKLGHHDLAKGIKNAGQNLTAMNIYDEQGTPLMSAKLKSHSLNVALSRQTLIEIIQSYVEESSIHTGFKVTKIEQTSCKVTLHFTKQESESFDLCIGADGLHSVVRESVGARTKIRYNGYTCFRGMVEDVQFNDQHVANEYWGVKGRVGIVPLINQRAYWFITVHAKEGDPKYQSFGKPHLQAYFNHFPNEVRNVLERQSETGILLHDIYDLKPLKTFVYGRTILMGDAAHATTPNMGQGASQAMEDAIVLVNCLEKYDFNKAIERYDKLRVKHTTKVIRRSKKIGKMAQKHHKLTVKLRNTAMKLIPNALASAQTKFLYKSKEK

SEQ ID NO: 6560 - protein, 307 aa, Staphylococcus epidermidis
KEGINVTEQFVIIILLIALGYFLKRMNYLKATDSQVLSTLVLNVTLPSLVIVNLNSAKLDVSFSILPIMMIIYGIVAKIIVIWFFRKYDNHMRGSVGMMTGSMNIGLFAYPLVEAIWPSKGMIYFGMVDIGGAIIMFGITYFVGSYFSEGSDQFNFKFLGKKLVQSVPLVTYMIMFGLNMSHIHIWQPAIDFFSVLSKANMPLSMILLGVMLNFSIEREYLPVTIKYLCLHYGLGMLAGTLVHFLLPVSDDMIKTTLLITWLLPVGVAIIPYSIQFKYKTLPFVGMVTNLTIIISIIILYIYQAVFV

SEQ ID NO: 6561 - protein, 44 aa, Staphylococcus epidermidis
KNLIIYVIKDNQDYELNLYCLCASNQDLMDQKVNKFKCFITMIL

SEQ ID NO: 6562 - protein, 282 aa, Staphylococcus epidermidis
PLLIEITLNLAIYNDKRSFIERDAEDVLPKVIAAQKVLKEIRKDVEIDAYIEHVNYNFLEQHGMHVDIILDATDNFDTRQLINDFAYKHQIPWIYGGVVQSTYVQATFIPGETPCFNCLMPQLPSINLTCDTVGVIQPAVTMTTSLQLVDALKLLTGNKVNKHFTYGDIWTGDHYTFGFSRMQNEDCKTCGNAPTYPHLNQHQQDYATLCGRDTVQYKNADISQEILLSFLERNHIQYRTNLYMTMFRFREHRIVAFSGGRFLIHGTTEPKKAIQLMHQLFG

SEQ ID NO: 6563 - protein, 362 aa, Staphylococcus epidermidis
LAMIRYQEGVFKMLGFSVYLGQNLDRDYILNMADLGYDVVFTSLQIPEEDKKNQMAYLGDLCQLLSAYQITYIIDVTPSLLNQTIYSYLNQLPHGDFYIRIDNQLNIDLIKDIISHGFKCCLNASTLTDSMLAHIYCTDFNNQLLYCHNYYPRPDTGLSISFIEEKNQLIRKYDAHAKICAFIPGTQKRGPLFKGLPTVEKHRFEHPLIAAQDLQLTGISDIIISDTLLSHIYAEQLSNMWLYRHFILHLDQLDSSFTSQVLKIHTSRLDSPEHVIRSQYSRTDNQQTVPMIGSAHRDQGDITIDNHLNGRYEGEIQVIKAPMPGHSHINCIGHVCDKDVPLLSLIQPGDTFKFVYTKENNK

SEQ ID NO: 6564 - protein, 256 aa, Staphylococcus epidermidis
GVKMILDERVNSNFDQLNDNDIQIAHYVNTHIDVCKNMKIQDLASQTHASNATIHRFTRKLGFDGYSDFKSFLKFEDSKNHQLPSDSMEQFKQEIENTFNYLERIDYRLLTHKMHHATTIYLYGTGRAQMNVAEEAQRILLTMHKNIILLHDVHELKMVLNKTIPEDLFFIISLSGETHQLKEVTQLLQLRQKYFISVTTMKDNTLAQQADYNVYVSSNTFYLNDGTDYSSFISYHIFFETLLRKYNEYKENHELT

SEQ ID NO: 6565 - protein, 287 aa, Staphylococcus epidermidis
VQIVDFLIALLPALFWGSVVIINVFVGGGPYNQIRGTTLGTLFIGFSLLATGHAAFDNLTVIIVGLVSGALWAFGQGNQLKSVHLIGVSKTMPISTGMQLVGTTLFSAIFLGEWSTIVQVVMGLIAMILLVVGISLTSLKAKSEGKSDNPEFKKAMGILLLSTIGYVGYVVLGDIFGVSGTDALFFQSIGMAIGGLILSMNHNTSIKSTALNLIPGVIWGIGNLFMFYSQPKVGVATSFSLSQLLVIVSTLGGIFILGEKKDRRQMIGIWSGIIVIVIASIILGNLK

SEQ ID NO: 6566 - protein, 42 aa, Staphylococcus epidermidis
YFNVKLHIKTKYFGEILEGTGQAEDYRLKLSPKKASQQYEVL

SEQ ID NO: 6567 - protein, 56 aa, Staphylococcus epidermidis
SKTVATINLKIITMYQLRLTQFSNFNIFTLFMHYLYSLIFNSCKQHNPCSKNKWPC

SEQ ID NO: 6568 - protein, 113 aa, Staphylococcus epidermidis
LKGVERMILDNVNPDDLFPTEKKGPSVLGMIEYNVQGQTKFEGAFIATNERLIMNVDMNGQFYYRNIRYDEINQIHFDGSDIIFEFNIGTVPMREIKTEDVQAFVDYIKQQIQ

SEQ ID NO: 6569 - protein, 112 aa, Staphylococcus epidermidis
GFLVSPAEMPINSTPWYDQITIDKAKKNPMNPFGINPPCDHKLEIPIGFPPLPIPNKINRNPAIIINTIVTTLIKANQNSNSPNAFTETRLAAIKKRTAITPGIQLGRLGNQ

SEQ ID NO: 6570 - protein, 80 aa, Staphylococcus epidermidis
IGVVGMQRSDKRKMSLPMKILLWVVGILFLLAIIAVIYVSAKIFITGDKIHNPLNRNHSELRSGKVNLKMVIHLLLHFLA

SEQ ID NO: 6571 - protein, 428 aa, Staphylococcus epidermidis
KLIFFGDECMSIEKRTPISVKEAIKRIMKQQVEVKNINVNLDESLGHILAEDIVATYDIPRFNKSPYDGFAIRSEDSQGASGENRIEFEVIDHIGAGSVSEKTIDKNQAIRIMTGAQIPSGADAVVMFEQTIESETTFTIRKSFKHLENISLQGEEIKAGDIVLHKGMRINSGVIAVLATYGYTKVRVARKPTVAVIATGSELLEVEDELEPGKIRNSNGPMIKALAKQFGIQVGMYKVQHDNLEKSMEVVKKALSEHDLVITTGGVSVGDFDYLPEIYKSIQAQILFNKVAQRPGSVTTVAFADGKYLFGLSGNPSACYTGFELYVKPAVNKLMGTKACYPQIIKATLMEDFNKANPFTRLIRAKATLTKAGMTVIPSGFNKSGAVVAIAHANAMIMLPGGTRGFKAGNIVDVILTESNSFEEELIL

SEQ ID NO: 6572 - protein, 723 aa, Staphylococcus epidermidis
HDVFYKCERKIKMKSLILAEKPSVGRDIANALNLQQKSNGYIEGKQYIVTWALGHLVTNATPEQYNPSYKEWNLEDLPIIPKKMKTVVISKTNRQFKIVKSLILDKNVKEIIIATDAGREGELVARLILDRVGNKKPIKRLWISSVTKKAIQEGFKRLKNGNAYQNLYEAALARSEADWIVGINATRALTTKYDAQLSLGRVQTPTIQLVKSRQDEINYFKPEKYYTLSINVDGYDLKLNQQKRYKDKKELELIEHEIKHQEGKILEVKGKNKKSYAQPLFNLTDLQQEAYKRYKMGPKETLNTLQHLYERHKLVTYPRTDSNYLTDDMVDTIQERLRAILATDYKSHVRDLISKSFSSKMHIFNNQKVSDHHAIIPTEVRPSIEQLSQREFKIYMLIAERFLENLMNPYLYEVLTIHAQLKDYHFVLKEKIPKQLGYKALKDQLSSHTLTHSFKEGQLFKVHRIEIHEHETKAPEYFNEGSLLKAMENPQNHIDLNDKKYAKTLKHTGGIGTVATRADIIEKLFNMNALESRDGKIKVTSKGKQILELSPSELTSPILTAQWEEKLMLIEKGKYNSQKFIQEMKNFTFKVVNKIKSSEQKYKHDNLTTTECPTCGKFMIKVKTKNGQMLVCQDPKCKTKKNIQRKTNARCPNCKKKMTLFGKGKEAVYRCVCGHTETQSQMDKRMRDKTNGKVSRKEMKKYINKKEEIDNNPFKDALKNLKL

SEQ ID NO: 6573 - protein, 43 aa, Staphylococcus epidermidis
QIVFINRVRIEFNDMMTHFPMLIHDSLYIRYIFLVVFQRKCDS

SEQ ID NO: 6574 - protein, 138 aa, Staphylococcus epidermidis
ILQFLEALNIMKKIKTISTLVAGLGIAFLGHTTHADAAENNNQQQSTYNYSTTEVSFSNSGNLYTSGQCTWYVYDKTGGKIGSTWGNANSWATAAQAAGFTVNNTPEEGAIMQSSEVLSDMLLSLKVLIMMVLLLYQK

SEQ ID NO: 6575 - protein, 150 aa, Staphylococcus epidermidis
MKQFEIVTQPIETEQYRDFTINERQGAVVVFTGHVREWTKGIRTQHLEYEAYIPMAEKKLAQIGKEIEEKWPGTITTIVHRIGPLQISDIAVLIAVSSPHRKAAYAANEYAIERIKEIVPIWKKEIWDDGSEWQGHQKGTYNEAKKGKAR

SEQ ID NO: 6576 - protein, 484 aa, Staphylococcus epidermidis
QLKFKKRGFVSNHTEGSKSMTQKYRYPTFLESISTILVMVVVVVIGFVFFNIPIQILLLISSAYAAFIAHRVGLKWKDLEEGITHRLSTAMPAIFIILAVGIIVGSWMYSGTVPALIYYGLKFLNPSYLLVSAFIISAMTSIATGTAWGSASTAGIALISIANQLGVPAGMAAGAIIAGAVFGDKMSPLSDTTNLAALVTKVNIFAHIKSMMWTTIPASIIGLAIWFIVGLQFKGDANTQQIQNLLKELTTIYNLNFWVWIPLIIIILCLIFRISTVPSMLISSISALVIGTFDHQFNMKDGFKASFDGFNHTMLHQSHISDNAKTLIEQGGMMSMTQIIVTIFCGYAFAGIVEKAGCLDVILETIAKGVKSVGTLILITVVCSIMLVFAAGVASIVIIMVGVLMKDMFEKMNVSKSVLSRTLEDSSTMVLPLIPWGTSGIYYAHQLNVSVDQFFIWAIPCYLCAFIAIIYGFTGIGIKKISRK

SEQ ID NO: 6577 - protein, 51 aa, Staphylococcus epidermidis
PCSSNNAAAVKPPIPAPTIAIFMFYTSNLSFFIILAYTHMLKSKPFYFNCQ

SEQ ID NO: 6578 - protein, 43 aa, Staphylococcus epidermidis
ELYSLNLPYFTSIQLEKDLIITAIGFIGENHFNIYSHPKRITN

SEQ ID NO: 6579 - protein, 86 aa, Staphylococcus epidermidis
FVYSKYKERFRDLMQERYSRQVLFKEIGLKGQSLLEKKHVLIVSMGALGTHLAEGLVRAGINKLTIVDRDYIEFSNLQRQTLFYRA

SEQ ID NO: 6580 - protein, 478 aa, Staphylococcus epidermidis
GGDSMSKEERLAKDITHALGGSQNISNIIHCMTRVRIKVHNDAKVNYDELKSINGVLGVVEDERIQVVVGPGIVNKVAKLMADQSGATLAEETTENQSYKSQAEKRAYEHKKQFQSQRKQSKWNKVLKSIANIFIPLIPAFIGAGLIGGIAAILSNLLTAGSISGQWIQQIVTVLNVIKDGMLFYLAIFTGINSAKVFGATPGLGGVIGGTTLLTGITDENPIKNIFTGEHLAAGQGGIIGVIFAVWLLSMVEKRLHKIIPNSIDIIVTPTITLLLIGLLTIFIIMPLAGFVSDGLVYVINWIIGVGGIFSGFIIGAFFLPLVMLGLHHIFTPIHIELINQTGSTYLLPIAAMAGAGQVGAAIALWVRCGKNKELRNTLKGALPVGFLGIGEPLIYGVTLPLGRPFFTACIGGGVGGAVIGGIGHIGATAVGPSGISLLPLIANNMYLGYIVGLLAAYTGGFIFTYFFGTTKEMRNPE

SEQ ID NO: 6581 - protein, 51 aa, Staphylococcus epidermidis
YVFSLQTYSFFLILHYISVLSLILLKEHLLEYFKCLQNIILITYTIMYNVI

SEQ ID NO: 6582 - protein, 47 aa, Staphylococcus epidermidis
SIYSKIIFKSYVFYKLAFEYSTTISKYISLLKGGHEHEHRINYHRSR

SEQ ID NO: 6583 - protein, 406 aa, Staphylococcus epidermidis
LLPSFQMEAIDTCPNKYSTIRRVLIMNKKTQMIHGGHTTDNYTGAVTTPIYQTSTYLQDDIGDLRQGYEYSRTANPTRASLESVIANLEHGKHGFAFGSGMAAISAVIMLLDKGDHLVLNSDVYGGTYRALTKVFTRFGIDVDFVDTTKIENIEQYIKPETKMLYVETPSNPLLRVTDIKASAKIAKKYDLISVVDNTFMTPYYQNPLDFGIDIVLHSATKYIGGHSDVVAGLVATADDDLAERLGFISNSTGGVLGPQDSYLLIRGIKTLGLRMEQINRNVEGIVQMLQKHPKVQQVFHPSIKEHMNYTIHQNQATGHTGVVSFEVKDTEAAKQVIHATNYFTLAESLGAVESLISVPALMTHASIPSDVRAKEGITDGLIRLSIGIEDTEDLVNDLEQALNTLR

SEQ ID NO: 6584 - protein, 84 aa, Staphylococcus epidermidis
IYQSPVAIYNKMTAINNDNHANINDQAEILAASLGTFHNLLTLMSRVNTNNVAPQNMVINLKSPLNHANEANAVINVKNGKYLR

SEQ ID NO: 6585 - protein, 81 aa, Staphylococcus epidermidis
TARSSKSHKVVLSSDCSLQLDYMKLESLVIVDQHATVNTFPGLVHTARHTTRVCNTRSRWSNHLELAVEGGTNDWGEVVTR

SEQ ID NO: 6586 - protein, 312 aa, Staphylococcus epidermidis
YSLLSSEPKIMIAYDLIGQTPLVLLESFSDENVKIYAKLEQFNPGGSIKDRLGKYLIEKAIDEGRLKEGDTIVEATAGNTGIGLAIASNRHKVKCIIFAPEGFAEEKISIMKALGADVRRTPKAEGMTGAQQEALAYATRYGYLYMNQFETKDNPGAYTQTLAKQLTDELSHIDYFVAGVGSGGTFTGVAQHLKTYDVKNYIVEPEGSVLNGGVSHPHATEGIGSEKWPSFLEKELVDGIFTVADKDAFNNVKLVANKEGLLVGSSSGAALQGALELKKSIQNGVIVTIFPDGSDRYMSKQIFNYKESFNNE

SEQ ID NO: 6587 - protein, 274 aa, Staphylococcus epidermidis
CMDPYKVLIEVMKTESFTRAAENLYTSQPSVSRDIKRLELKYNVKIFEFKSPYLKLTRDGEKLLQYALQRESIEQELWQNLTSESEIISGTLTIGSSYTYGEYLLSEQLTSLMQQYPKLHIHLRVNNSDSVINDIKHNRVDIGIVEKEIQDNAIKCKEIMEDEMVYIYKKSIQPRMDICFVREKGSGTRFYQEVGLSELKLNPYLIEINNIKIIKQMVEAGNGFAIISKSALHPEDYEKLMITTLNVKRHYYLAQHVDKYIGENIRAVIEMIMK

SEQ ID NO: 6588 - protein, 42 aa, Staphylococcus epidermidis
NLSLKNVNINVPKNRQLKIIIIQVKGVLKKFLDCILKPQFST

SEQ ID NO: 6589 - protein, 100 aa, Staphylococcus epidermidis; identical to SEQ ID NO: 6131

SEQ ID NO: 6590 - protein, 184 aa, Staphylococcus epidermidis
GAALIMTKQDLSLSVFTNENYKNLHYTSSSFRNSMYDELEVNKSRFKNCNFNEGIFKNIEAICNCKFTTCGFNNCIFEDVHFYKNQFKDSTFVNTPFDQSVFNSTLFQNAMFDSNLIRSVKWTDIIFKNVSFKNVEIEGTTFKDVKFKNCEFKNVIITNSTMSQKLMNELQKQDVTLENIDTSI

SEQ ID NO: 6591 - protein, 40 aa, Staphylococcus epidermidis
IKKPVNEFMKTHLLSILIGIMSQALYPTISQVLIIKISIT

SEQ ID NO: 6592 - protein, 410 aa, Staphylococcus epidermidis
LLFTKERVLEMAKIPVTVLSGYLGSGKTTLLNHILKNREGRRIAVIVNDMSEVNIDKDLVAQGGGLSRTDEKLVELSNGCICCTLRDDLLREVERLVHKGGIDQIVIESTGISEPVPVAQTFSYIDEELGIDLTSICRLDTMVTVVDANRFVNDIRSEDLLADRDESVDDEDERTIADLLIDQVEFCDVMIINKIDLISDEALEKLENVLRALQPEAKIIKTVNAKVELSDVLNTQLFDFEKASESAGWIKELTAGGHATHTPETEEYGITSFAYTRRLPFHAKRFHQWLEQMPENIVRTKGIVWLAQYNDVACLLSQAGSSCNIHPVTYWVATMSESQQQAILEARQDVVEDWDIEYGDRQTQFVIIGTDLDQEKISRELDACLIHSSEIDEDWRLLDSPYQWTYDRRM

SEQ ID NO: 6593 - protein, 49 aa, Staphylococcus epidermidis
KLCTYNEYAAYSRNIFMMYNLVAQICAVSFTVQIWTVIYTNLFTSHTVF

SEQ ID NO: 6594 - protein, 44 aa, Staphylococcus epidermidis
INRTLYLNKLPISFCSKVRTLSPLSIKVIQPKIAKARLSYYLFE

SEQ ID NO: 6595 - protein, 42 aa, Staphylococcus epidermidis
SFYTFYSYCQKYCFLKVTRCFQYTISKHLATEFKFKEFSRRR

SEQ ID NO: 6596 - protein, 86 aa, Staphylococcus epidermidis
GGDTLFTKKILIYIALLITLIRFFIPLHPDFDTLLVWLFILYIIPIILCIIGFKSDKLIATMIMIPNLMGIGYRIFIFFNDFLHLK

SEQ ID NO: 6597 - protein, 564 aa, Staphylococcus epidermidis
TKLTRCLMYKDYNMTQLTLPMETSVLIPTNDISRHVNDIVETIPETEFDEFRHHRGATSYHPKMMLKVVLYAYTQSVFSGRKIEKLLNDSIRMMWLSQNQKPSYKTINRFRVNPKVDALLESLFIQFHSQCLKQNLIDDQAIFIDGTKVEANANRYTFVWKKSIQNHESRMNENSKALYHELVINKIIPEIKKDHDNDLTKEEIDLIGSHLDKEIEDLNQHIDNEKCTKIRKQIRLKRTKIKKYKKQINDYSQRKHKYEVQKSILKDRNSYSKTDHDATFMRMKEDHMKNGQLKPGYNLQIATNSQFVLFYDVYQNPTDTRTMIPFLNTIQETYGHLPEYIVADAGYGSEANYMAIIDNFNRTPLITYGMFIKDKTKKYKSDIFNTQNWDYDEINDEFICPNNKRLGFKRYAYRHDKYGFKRDFKLYECDDCSECPLKQQCMNFNSKTNKKIMKNYNWEYFKAQINKKLSEPKTKTIYSQRKIDVEPVFGFMKAILGFTRMSVRGIDKAKRELGFVLMALNIRKVTAQRAENNQKNNKKDNFYIISIEIVFFYLSWDFMSHTHF

SEQ ID NO: 6598 - protein, 50 aa, Staphylococcus epidermidis
QYITIKLSPLMIGLRIINGLNYSFIKMLPNLYNIGKLDYFNKSKLCISCL

SEQ ID NO: 6599 - protein, 62 aa, Staphylococcus epidermidis
VIQTIKLSYKYIGMLLNKLEKIHNNLLIKIGFLNKFCYISFIMWFILCFTRSNRFMVCKENN

SEQ ID NO: 6600 - protein, 262 aa, Staphylococcus epidermidis
SMSAITILGFLLLLIMVIFGGKKGLISFFTLFLNFIILVISILLIIYGVSIYLVTFIFCFIIAAINLFVLNSYNVKTQAAFLGTLVTILILILMIYFSVEMGHLQGFATEQQDETYVYSMNIGINMVQFMVFTIVLAVIAAVIDLAITISSPMYELNETNPNLNQHQLFQSGMRVGREILATSANTIYLAFFGGQLTLFFWFFKLKYSFGHIINSKIFTQEFIAILLGGIAVAISIPITAWITAFMIKHFSQKKTLTNQQNK

SEQ ID NO: 6601 - protein, 63 aa, Staphylococcus epidermidis
ELHAYILTKIFSPTLNRKYSVHFMYSHNREIIYDFDQFSNRLVLALIIVYSVMSLCPVLTFAF

SEQ ID NO: 6602 - protein, 63 aa, Staphylococcus epidermidis
CQCAKGSCSNNGSNIFFLHLKSSSTLGFVYSRFNNTKILYSLIMYSMFALDDILITNIILNKK

SEQ ID NO: 6603 - protein, 452 aa, Staphylococcus epidermidis
HFSALKGVGNLSGHSQWKTSTGFILASAGSAIGLGAMWKFPYMAGIYGGGAFLLMFLIFTIFVGLPLLIMEFTVGKMGRTYTTQIYKKLTGKKWLNIIGWNGNLAVFILFGFYSVIGGWIIIYIGYVIAQIMVFKSSTLTNIQFETIISNPWLTVLGQGIFILITMVIVMLGVEKGLEKASKIMMPLLFIFLIIVVAQSLTLEGALEGVRYILQPRVEDMSIQGVLFALGQSFFTLSLGTTGMITYASYAPKNMTIKSSALSIVVMNILISVLAGLAIFPALKTFGYQPQEGPGLLFKVLPLVFSEMTFGTFFYFIFLLLFLFAALTSSISLLELNVSNFTKNDNSKRQKVAIIGSILVFIISIPATLSFSSLSHLRFGAGTIFDNMDFIVSNILMPLGALGTTLVVGQLLDKKLLKESFGKDKFNLFLPWYYLIKFIMPIVIILVFIVQLF

SEQ ID NO: 6604 - protein, 199 aa, Staphylococcus epidermidis
NMHYPEPISKLIDSFMKLPGIGPKTAQRLAFHTLDMKEDDVVKFAKALVDVKRELTYCSVCGHITENDPCYICEDKQRDRSVICVVEDDKDVIAMEKMREYKGLYHVLHGSISPMDGIGPEDINIPALVERLKNDEVKELILAMNPNLEGESTAMYISRLVKPIGIKVTRLAQGLSVGGDLEYADEVTLSKAIAGRTEM

SEQ ID NO: 6605 - protein, 876 aa, Staphylococcus epidermidis
NPIYRKSSIIFKTILVKEDRIMLQSDINELVNQAKRVITPLSPISTFAARNPWEGLEDASFDQVARWLKSVRDIDIYPNASTIHRAISNKEIDLKVFEERLDENRAHYNNRSLSDSDINTYIQRAKNLKTIEEGYFNTKDNEKLEKWVQTNFKDYKKKEDVIAQSASVFTKEGTRLIDILNAHMIKWSKLYVDDFQSSWTMPKREKGFYHAWQRLVKHDPLFTKKQRLTLTHLPNQATEAIEYAFQELGVKEEHRQSYIESHLLSLPGWAGIMYHRSQTQSNDAYLLTDYVAIRLSIEMVLLNDHHTTLLKKSIYLQKKLEQIRYLLFNIQMNVEQWLNLSSKKQQAYIELGTRFSPFYFKKLWLDAWEETHERRLVDEIYRVPTEDTDQAKAKVQLAFCIDVRSEPFRRHLESEGPFETIGIAGFFGLPIQKEVLDEQFAHPSLPVMVEPAYRIKEYADQHEMKIYNQQQHTLTSMFYNFKLMKNNVLPSLLLPELSGPFLSIATIANTIFPKKAKRIVHRFSQKWLRKPTGKLTIQREQDAYSKLPIGFTLEEQIQFSKKALQLMDLTDDFAPLIVLCGHGSESHNNPYHASLECGACGGASSGFNAKLLAVMCNQENVRRGLLMEGIDIPRHTVFIAAEHQTSVDELEYIYVPPLTTEAQNAFDELKHVMPKVCYKTNLERLASLPNINNTDHNPNAEAHRHASDWSEVRPEWGLARNAEFIIGKRQITQNSNLEGRAFLHNYDWTKDEDGEILNTIISGPALVAQWINLQYYASTVAPHYYGSGSKTTQTVTSGVGVMQGNASDLMYGLPWQSVMMNDKEAYHAPIRLLIVIQAPDAYIQRLLKHHNHFRQKVDHQWIRLASIDENNSWKDW

SEQ ID NO: 6606 - protein, 101 aa, Staphylococcus epidermidis
GYLFVYNRTQCGFVKCVRKWTYYLLSLISSNLGILIYTQPQCGFSNRLNNSIYLLSSNVSVLINNTNADALSQCIRKRKYSFSKIKLNTAEMSALVDISQR

SEQ ID NO: 6607 - protein, 1529 aa, Staphylococcus epidermidis
SNLYIEQINKLHYSNYYQTKLSENSNKGVCIMYNEKLKKGLYDYREEHDACGIGFYANMDNKRSHDIIEKSLEMLRRLDHRGGVGADGITGDGAGIMTEIPYQLFEQLTEFKVPGEGYYAVGLFFSKEKVRDSIHEEMFNQYFESEGFKVIGYRDVPVDTRAIAQHVADTMPYIQQVFVDITGVKEVEKRLFLARKQIEKYSETQSIDLYFTSLSHRTIVYKGWLRSDQIKGLYLDLQNEAYQSKLGLVHSRFSTNTFPSWKRAHPNRMLMHNGEINTIKGNVNWMRARQNKLVETLFEDEKDKVHFIVDEDGSDSSIVDNALEFLSLAMEPEKAAMLLIPEPWLYNESNDKKVRSFYEFYSYLMEPWDGPTMISFCNGDKIGALTDRNGLRPGRYTITKDNFIVFSSEVGVIDVPEENVAFKGQLNPGKLLLVDFLQNKVVENNELKTNIANELPYEQWLKDYKNKNDLDNIYYQSSDWDDQTLFRLQKQFAYTKEDINKYMTDLVINKKDPIGAMGYDAPIAVLNDKPESLFNYFKQLFAQVTNPPIDAYREKIVTSELSYLGSEGNLLCPDESVLERIQLKKPVLNEAQLSSIDHSYFNVTYLSTLYTGDLESSLNELGNRAIQAVHEGAKILVLDDTSLTHENSYAMPILLALSHVHQLLIREGLRMETSLIAQSGETREVHHVACLLGYGANAVVPYLAQRTIEQLTRQGQLSGTVAENVATYTNVLSEGVIKVMAKMGISTVQSYQGAQIFEAVGLSNSVIEKYFTGTQSKLSGISIEQIDKENKARQSDDSDYLESGSVFQWRQQGQHHAFNPRTIFLLQHACRENDYELFKKFSKTVNLKRTDHIRHLLEFKTRQSIDISRVEPASEIVKRFNTGAMSYGSISAEAHETLAQAMNQIGGKSNSGEGGEDSSRYEIQKDGSNKISAIKQVASGRFGVTSDYLQHAKEIQIKVAQGAKPGEGGQLPGSKVYPWIAETRGSTPGIGLISPPPHHDIYSIEDLAQLIHDLKNANRRADIAVKLVSKTGVGTIASGVAKAFADKIVISGYDGGTGASPKTSIQHAGLPWEIGLAETHQTLKLNDLRSRVKLETDGKLLTGKDVAYACALGAEEFGFATAPLVVLGCIMMRVCHNDTCPVGVATQNKDLRALFRGKAQHVVNFMYFIAEELREILASLGLETVEELVGRTDLLQRSTQLKPNSKAASLQIERLIEQFDGVNTKEISQNHHLDEGFDLNYLYPDARYSIENGHSFTGNYVVNNEQRDVGVITGSAIAKQYGEEGLPEDTILAYTEGHAGQSLAAYAPRGLTIHHTGDANDYVGKGLSGGTVIVNAPNSQRENEIIAGNVNFYGASRGKAFINGKAGERFCIRNSGADVVVEGIGDHGLEYMTGGHVIILGDVGKNFGQGMSGGVSYIFPSDVEKFKKVNALETLEFSSIRFDEEKSLIKDMLEAHFKHTRSNKARQLLDQFDNIEKLAIKVIPKDYKLMMQKIDLKKRQMEREDEATLAAFYDDRETIEQELQPAVIY

SEQ ID NO: 6608 - protein, 52 aa, Staphylococcus epidermidis
HPDLNNLLLHRDFIFTNHRGSPLSITSINRNLQIGAKNVGIEKHITSHTNVS

SEQ ID NO: 6609 - protein, 180 aa, Staphylococcus epidermidis
NGGYMHIYLSTLTEVDYETSLNSIENNYNLNPESSWQDRARVKNLRKLESYNYELEVIAKNELNEVIGHVVLAEVKLSSKNKKAIALAIGALSVDKSIRNQGLGQALLKAVEERAKEQGYCAIFVNNHPQYFEKSDYEAAHLYNIHIEEKRNHQSLLVKFLKPVQNEWSGMTVYYPEVLD

SEQ ID NO: 6610 - protein, 503 aa, Staphylococcus epidermidis
DGGYAMLSSELILFMFFITLVIAILSGLIFLNHRVPIQYIKFHIYLLVLPIITGLSGLIFFGERANVGPFVVDHLTWLMMTFILTLGFIIQKFSMRYLIGDMHYRKYFPFFTLITAFASLAWLSGDLRLMTMFWGATLFVLTRLIKVNKLWKVPREAARISAWSFILAWLSLLIAVILLYIATGDWYIYSNMSDDNAINYGMRLCINLLIVLAVIIPAAQFPFQGWLIESVAAPTPVSAIMHAGIVNAGGVILTRFSPVFNDEIAISLLLIIASISVLSGSGITLVHVDYKRQLVRSTISQMGFMLVQCALGAYSAAIVHLILHGVFKATLFLQSGSVVKRFNIPTSPSVKKSYGWLVFGRLLAILIAIIFWLNSDRHAYDVLSALILAWSLMVSWNQLVAFSHGLIGRVIGVCMIIVVAIVYIITHHYFFTTLSNVDIHIVSPPLISIILSIAIIVFGSMLSIWVSRRRESKAFAKLYLWLIKVGEAKTQSIESHPSYLKRF

SEQ ID NO: 6611 - protein, 70 aa, Staphylococcus epidermidis
RDNLYGYLYFLRSNKNKLHTPSFPTSEVQKQPLKPMPKGFHYSMLLFPLDDMYFSHVFSTIDIRCHIRVL

SEQ ID NO: 6612 - protein, 41 aa, Staphylococcus epidermidis
NSIHSVLLGKILLTYLVFNVQMNVNKHSKLNTICHVIPSSS

SEQ ID NO: 6613 - protein, 54 aa, Staphylococcus epidermidis
EKCLQRQLIIEKDLKLDISYSSKSITFKTFPSFNYGIFGDHFTPFTATVRSTVF

SEQ ID NO: 6614 - protein, 180 aa, Staphylococcus epidermidis
RRIHMKKLLCTLFAAALVLSACGQDDTKEDENKKSEITTEKKSDDKKDKKTNEDKKSGEQKKSQEKKNNKSMQESATNEQVQSQQQTQQANQQAQQSDNHEPTKEEIYEWDKQNIPGGTDFGLIDPEDVNEASESQNEEPDEWIKGQEEWNNATQSEKEELRKQNAQKYGYEYDPKDYEE

SEQ ID NO: 6615 - protein, 162 aa, Staphylococcus epidermidis
LIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 6616 - protein, 51 aa, Staphylococcus epidermidis
IVKHCNKLQLTLPMETFIRIPQINPPRHINEMIETIHNRDFDEFSSLKRTI

SEQ ID NO: 6617 - protein, 47 aa, Staphylococcus epidermidis; identical to SEQ ID NO: 6175

SEQ ID NO: 6618 - protein, 576 aa, Staphylococcus epidermidis
VIVNGGATVDYQALYRMYRPQSFDDVVGQTHVTKTLRNAISKGKQSHAYIFSGPRGTGKTSIAKVFAKAINCLNSDDGEPCNECAICKGITQGTNNDVIEIDAASNNGVDEIRNIRDKVKYAPSESKYKVYIIDEVHMLTTGAFNALLKTLEEPPAHAIFILATTEPHKIPPTIISRAQRFDFKAISSDQIIDRLKYVANSQSLDYDDAALEFIAKASEGGMRDALSIMDQAIAFGDERLTLQDALNVTGSVDEAALNELFNDIVKSDVKAAFNRYHHFISEGKEVNRLINDMIYFVRDTIMNKTSNESVHFESLIHFDLDMLYRMIDIINDTLVSIRFSVNQSVHFEVLLVKLAEMIKTQPQTVQNVATASVANEPDNEMLLQRLEQLENELKTLKEQGIKTNKVSQQPKKPTRTIQRSKNTFSMQQIAKVLDKANKDDIKLLKNHWQEVIDHAKSNDKKSLVSLLLNSEPVAASEDHVLVKFDEEIHCEIVNKDDEKRNNIESVVCNIVNKTVKVVGVPADQWLRVRAEYLQNRNTNETHQSEKQSTQQSQQIDIAQKAKDLFGEETVHLVDED

SEQ ID NO: 6619 - protein, 93 aa, Staphylococcus epidermidis
FMTKQANASRLSRLFNVAGFIVDGYNGIRYNAKNKQLVYLSLGLSALGTIIDFYISIKSASKLRKLSALGSFAINGVRLFTSFKKVRDEYDYH

SEQ ID NO: 6620 - protein, 46 aa, Staphylococcus epidermidis
LILLYFKLKLLDKLYKLLITYDKHFYENYKNFNNYSEFVLYNRVCV

SEQ ID NO: 6621 - protein, 49 aa, Staphylococcus epidermidis
NLNNFTSDYTSKFHNLDLYYLYKNLLKSKVKNHAPLYRTHIINVTEVDS

SEQ ID NO: 6622 - protein, 43 aa, Staphylococcus epidermidis
KTYNQFEIQTLFKISIFIFIIDYVYMRIRNESVMIGVNKLTHR

SEQ ID NO: 6623 - protein, 347 aa, Staphylococcus epidermidis
RYNNNVLRFHIEVKVHMKSITQASFMKGIMFTFTIAIISYILAKFPILHTIGALAIAIIFAMIYRQVIGYPEHIRPGITFASKRLLKFAIILYGLKLNMGDILGKGWKLLLIDIIVIIFSISLTLLLNQIIKGNKDISILLGIGTGVCGAAAIAATAPILKSKEKDIAISVGIIALVGTIFALIYTAIEAIFNIPTITYGAWTGISLHEIAQVVLAAGIGGSEAMTFALLGKLGRVFLLIPLSIVLILYMRYKSHSSQVQQKIDIPYFLIGFIIMACINTFVPIPSLLMNIINVITTLCMLMAMVALGLNIVLKEVISKALKPFIVICITSICLSGVTLLVTSIMFK

SEQ ID NO: 6624 - protein, 45 aa, Staphylococcus epidermidis
RSLNQLKINRHKKTTIVKDGGYVECRLFFEFFNDVYDSFNDFDDS

SEQ ID NO: 6625 - protein, 48 aa, Staphylococcus epidermidis
RRLNFYACKERPNYSNIVLTVLRGEVTVPCTRNPLYARLNSFVEDVFL

SEQ ID NO: 6626 - protein, 52 aa, Staphylococcus epidermidis
LYLKQLQVERKCNNIYYFKVWDISLYSRLYLHLNRRRLNTLIYESSQHREFH

SEQ ID NO: 6627 - protein, 143 aa, Staphylococcus epidermidis
KVVKKGVTYKMKKFFIFLLSSLLVLAACGKNYEISDITSKFKKEGLSVENLRKMDREDFGMAPMKTENAKIFTVSEDKNARILKFKNEDDLKEMKKYYEELGKSSATFYSHVYTKDKFLIQMNGDIDDHVFEKYKKAMNEALN

SEQ ID NO: 6628 - protein, 43 aa, Staphylococcus epidermidis; identical to SEQ ID NO: 3838

SEQ ID NO: 6629 - protein, 51 aa, Staphylococcus epidermidis
KIQKIVYILHNHHLLRWWFFYVYLFSAGLNSFKHPTFTSLHYWITFQNKLL

SEQ ID NO: 6630 - protein, 60 aa, Staphylococcus epidermidis
YYQNFTSIEIELRNMMLIFKPYLLIIDKFLNPRIHCRRYIFTVIDIEPFHVSNFMIGFNF

SEQ ID NO: 6631 - protein, 52 aa, Staphylococcus epidermidis; identical to SEQ ID NO: 5769

SEQ ID NO: 6632 - protein, 248 aa, Staphylococcus epidermidis
IGVNVKMKVKSPQSIYLKGHRQQAVLLLHSFTGTVRDVKHLAQQLNEEGFTCYVPSYPGHGLPLKEFTQHNINDWWEQVTAAYQFLRNEGYSRINVTGVSLGGLFTLRLAEHFDLERIAVMSAPHKKRESEIAWRLERYGHRMNEILSLSEEERRHQMETILSYDKEIEVFQGVIDEIMAYLANITVPVNIMYGEEDDPLYAQSAQYIYDNVNSQDKELLKFEKSGHLMTYGDHAYRVEQSIIQFFSK

SEQ ID NO: 6633 - protein, 50 aa, Staphylococcus epidermidis
DVIDKTKTNGQFHFLVELTVLLYKECYVVDSKYLTPLNERMFNYDLKLFS

SEQ ID NO: 6634 - protein, 86 aa, Staphylococcus epidermidis
VSVDPKISEWGEPSMNYVMLFTCEFIAWSESKPRRTETSNYPEEEEKKSISLNSGQTKTGRRPNPPSLLCWGLVGHFFTEFPKEPL

SEQ ID NO: 6635 - protein, 110 aa, Staphylococcus epidermidis
GGNEIMRGGGNMQQMMKQMQKMQKKMAQEQEKLKEERVAGTAGGGMVTVTVTGHKEVVDVEIKEEAVDPEDIEMLQDLVLAATNEAMNKADELTQQRLGKHTQGLNIPGM

SEQ ID NO: 6636 - protein, 109 aa, Staphylococcus epidermidis
GLRFKISYIPLAIVIETSITAPSVPISTEARKTSLGGRVRKVIVSYFIPFPPVNLMMTSVIPTHKNVPISVLTIVIKVRLCQPVTSSKVKEVEMIIAQVIKKNKLIAPY

SEQ ID NO: 6637 - protein, 507 aa, Staphylococcus epidermidis
NKGELIMIYTVTTTLPLSHGGRTQALLRRIKLLDEEFKIPSKILTTNYHGNYPSIYKKYRQENKVTENIQFENMYEWLSNFKLFKVPKTLITRNPKYIKTPRKIKGLIDKQGKKSGLIHYYNNECHVRSRKYYGQSNVLEYEDFISPTSGLKYERHQYNLYGQLHRKEYYYDDSSLKHSDELFDTEGSMYCKRYFKTKPNSKINGVEIYRNKKLYKTFKNDKLLAQFYFQNRFKNQDIVFNDARFLDKPLLKQTHQTKNILVLHSSHLSGDQIKKSYRFALNQSKNVYKYIVLTHQQKHDIQQHFHISDDQFQLVPHFIELDTEVEQDSSNNQNRFIYIGRFSTEKQIDHIIRAYHKFLQSGYQTELHLFGRDEDNQIPLMNTLISELKLSDKVKIFKYTNQPLQKFKNSKASLLTSQYEGFGLTLMESIEMGCPVLSYNVRYGPSEIIQNGINGYLIEKNDIDSLSKHMINIIEHPLQKVKNKDTLKYNAAVNNYKQLMQSLDLLK

SEQ ID NO: 6638 - protein, 132 aa, Staphylococcus epidermidis
KKEEIMKNVSPFIYVKDVDKSLCYYKDVFNAQTEILMGKDGRTYHAQLIIGDETFVHFSDTFHKHPVSKNPHLIIECDSLEELERVYKRLIDDGGHAKVKLNKTFFNAYHAEVKDRLNGIIWVFNYFLDEHI

SEQ ID NO: 6639 - protein, 44 aa, Staphylococcus epidermidis
RAILMCHSHISLLSQLDTLLSTIMNRVGHTDHKTILQIYRHVTE

SEQ ID NO: 6640 - protein, 128 aa, Staphylococcus epidermidis
MIKCVCLVEEKNHQLLLVQVRHRDKYYFPGGKIDEGESLVEALQRELKEELRLELAKDELEFIGTIVGEAYPQPNMLTELNGFKVNRAIDWSKVETDHEITDMKWFDINDSENIAPAVNTWIKEFIND

SEQ ID NO: 6641 - protein, 86 aa, Staphylococcus epidermidis
IKECRNMKRTFLLTYTTVSGKTYTEFKTFENGPDYDTCVSRIIDEFDELAYLYIKKDVVHYINVDHIESLDIEEVTEGQHITYDFE

SEQ ID NO: 6642 - protein, 130 aa, Staphylococcus epidermidis
SRNRSRPVMKKTKGIYESEISKAITQWEKDFLGRGSLSVKTDILRDMVIVSLQGILTPAEYRVCKTNEGLLNIKRTRSELVESGEEDLSRIIKDLTGLNVKSFHSDLSTITGERVMIFKLEDRFDKALHE

SEQ ID NO: 6643 - protein, 46 aa, Staphylococcus epidermidis
TLYRLILVLTTVKITLSKTIQITPEEKPNFFCMKFNYKRVIQKNGC

SEQ ID NO: 6644 - protein, 117 aa, Staphylococcus epidermidis
FHMSYENACDVICVHEDKVNNALSFLEDDKSKKLLNILEKICDEKKLKIILSLIKEDELCVCDISLILKMSVASTSHHLRLLYKNEVLDFYKEGKMAYYFIKDDEIREFFSKNQEGF

SEQ ID NO: 6645 - protein, 44 aa, Staphylococcus epidermidis; identical to SEQ ID NO: 6247

SEQ ID NO: 6646 - protein, 44 aa, Staphylococcus epidermidis
TVSGTMAAVVPIDVPTSNLVKGTMAINKIMNGIDLKILMIGFNT

SEQ ID NO: 6647 - protein, 330 aa, Staphylococcus epidermidis
SRGGFQVQKKYITAIIGTTALSALASTHAQAATTHTVKSGESVWSISHKYGISIAKLKSLNGLTSNLIFPNQVLKVSGSSSRATSTNSGTVYTVKAGDSLSSIAAKYGTTYQKIMQLNGLNNYLIFPGQKLKVSGKATSSSRAKASGSSGRTAIYTVKYGDSLSAIASKYGTTYQKIMQLNGLTNFFIYPGQKLKVPGGSSSSSSSNNTRSNGGYYSPTFNHQNLYTWGQCTWHVFNRRAEIGKGISTYWWNANNWDNASAADGYTIDYRPTVGSIAQTDAGYYGHVAFVERVNSDGSILVSEMNWSAAPGNMTYRTIPAYQVRNYKFIH

SEQ ID NO: 6648 - protein, 349 aa, Staphylococcus epidermidis
VLWGVFDMDLLIGTLFLILVLVIFTLFTYKAPSGMRAMGALANAAIASFLVEAFNKYVGGQVFGIKFLEELGDAAGGLGGVAAAGLTALAIGVSPVYALVIGAACGGMDLLPGFFAGYIVGYMMKYTEKYVPDGIDLIGSIILLAPIARLIATGLTPVVNNTLIKIGDIIQSSTDANPLIMGIVLGGIITVVGTAPLSSMALTALLGLTGAPMAIGAMAAFSSAFMNSALFHRLKLGDRKSTISVGIEPLSQADIVSANPIPIYVTNFFGGAIAGIIIAWSGMINNATGTATPIAGFLVMFGFNSLTKVIIYGVVMAIIGTIAGIVGSIVFKKYPIITKKQMLERDTTT

SEQ ID NO: 6649 - protein, 288 aa, Staphylococcus epidermidis
IFRGNSFMKKILSFLIVAILVLSACGGNNGKKVTIGVASNDTKAWEKVKELAKKDDIDLEIKHFSDYNVPNKALSDGDIDLNAFQHFAFLDQYKKAHKDTNIEALSTTVLAPLGIYSDKVKNIKDVKKGAQVAIPNDVSNQARALKLLESAGLIKLKKNFGLNGTTKDIESNPKDLKIKAVDAQQTARALSDVDISVINNGVATKAGKDAKKDPIYLEKASSDAVKPYINVVAVNSKDKDNKTYKKIIELYHSKEAQKALKEDTKDGEKPVDLSKKEIEEIENELAKK

SEQ ID NO: 6650 - protein, 208 aa, Staphylococcus epidermidis
GVIMIQTIVTAAILYIATAVDLLVILLIFFAKAKTKKEYRDIYIGQYVGSVTLIVVSLFFAFVLNYVPEKWILGLLGLIPIYLGIKVAIYDDCEGEKRAKKELNEKGLSKLVGTVAIVTIASCGADNIGLFVPYFVTLSVTNLFITLFVFLILIFFLVFTAQKLANIPGVGEIVEKFSRWIMAVIYIALGLFIIIENDTIQTILGFIF

SEQ ID NO: 6651 - protein, 41 aa, Staphylococcus epidermidis
VKIMITEIITSIFNSILKQEEIYLNNNIEQLSEFRKDIILK

SEQ ID NO: 6652 - protein, 40 aa, Staphylococcus epidermidis
YYVIINKLLHDLTKLHLIENMTINHTYFNLQNKYGIRRES

SEQ ID NO: 6653 - protein, 224 aa, Staphylococcus epidermidis
GGYINMFGSSLDSSQLLQALYETLYMVTVSLVIGALIGIPLGILLVVTRKNGIWSNTILHQVLNPIINILRSIPFIILLIAIVPFTKLLVGTSIGTTAAIVPLTVYVAPYIARLVENSLLEVDDGIIEAAKAMGASPLQIIRYFLLPEALGSLILAITTAIIGLIGSTAMAGAVGGGGIGDLALVYGYQRFDTIVIVITVIVLIIIVQIIQTLGNFIARVIRRN

SEQ ID NO: 6654 - protein, 233 aa, Staphylococcus epidermidis
VNHIKEIGVDMNFKYMNIAKGIIPILISMIILLSFISTHVLAQNQWLRMVDLSVQEWFSNQFGDPNRVFGHGFINNIMTFCATFGDVKTILIVATIIAVLLMFYKKVPQAIWLIITMTSGALINYLIKQTIERSRPENHLIVDTGWSFPSGHSNINTLFFLMIMIIIIPLIRQRAFKFIITILSIVFWISVLISRLYFHAHYFSDVVGGVSLAIIWVSLFILVSPLLNFWGEK

SEQ ID NO: 6655 - protein, 44 aa, Staphylococcus epidermidis
FKNINPLSIAMTSVIKNINKINSELNIAYPPSQKISKTIIKSLQ

SEQ ID NO: 6656 - protein, 490 aa, Staphylococcus epidermidis
GIIMGEFKGFMKYDKQSLSELSLVDRLSNHEAFQQRFTKEDASIQGARCMDCGTPFCQTGQSYGRETIGCPIGNYIPEWNDLVYHQDFKAAYERLRETNNFPEFTGRVCPAPCEQSCVMKINRESVAIKGIERTIIDEAYENEWVHPAYPEDHKDQRVAIVGSGPAGLTAAEELNFKGYKVTVYEKAHEPGGLLMYGIPNMKLDKDVIRRRVSLMKDAGVLFKTGVEIGVDVSRETLEENYDAIILCTGAQNARDLPLEGRMGSGIHFAMDYLTEQTQYLNGEIESLSITAKDKNVIIIGAGDTGADCVATALRENCKSIVQFNKYTKQPEEITFESNTSWPLAMPVFKMDYAHKEYEAKFGQEPRAYGVQTMRYDVDELGNVKGLYTQILKETPDGMVMEDGPERFWPADLVLLSIGFVGTETTVPHAFDIHTERNKIVANDTNYQTNHAKIFAAGDARRGQSLVVWAIKEGREVAHSVDQYLSKEVLV

SEQ ID NO: 6657 - protein, 46 aa, Staphylococcus epidermidis
RQIIMPLMIWATHVLQWTIQRVAKPRGQANPIKLFSVRIVVCNSTI

SEQ ID NO: 6658 - protein, 83 aa, Staphylococcus epidermidis
HIVIQFSMFIFLPTRINYTLHGCLSQQLFEINFSRLFNDSLSCFAQQINTIQTYSRFNNSKNYTIKNNSNYSGGKTELFLYEI

SEQ ID NO: 6659 - protein, 87 aa, Staphylococcus epidermidis
TYNMSPYLNIIDVTKRVTPDRQIEVIQITMNGLSAFEITSFKTIFNPRATIAINIHNVVITFIIFISNEGIGTNVLIQAIIINPIRK

SEQ ID NO: 6660 - protein, 56 aa, Staphylococcus epidermidis
TRGMRNSPNKHGETKYRYYEKYKDSLTNNWRRVSMVFRNDKQLQKVAQKRLNKMSV

SEQ ID NO: 6661 - protein, 47 aa, Staphylococcus epidermidis
SFLIKLMEFVLSNRMQSLFLVQMTTMSITELNPLSLFMLALILTYQI

SEQ ID NO: 6662 - protein, 161 aa, Staphylococcus epidermidis
NVLIDGKFINLYQSNIEKVNDNRHSNETSIHNDDYKKILNKVLKSDIIIFSTPLYWYSMSASLKLFIDRWTESLRDTQIDNFKEIMSQKKYLILIIGGDSPRIKAQPLVHQFKLIFEFMNITHFRFLIGEGNKPFDVLNDSQFMEELANTNLALKKGDIYD

SEQ ID NO: 6663 - protein, 43 aa, Staphylococcus epidermidis
GVVFVLLKLEKTVCEVCFYLNAKNRDNHIDYLATRIYHLNNKT

SEQ ID NO: 6664 - protein, 373 aa, Staphylococcus epidermidis
GFKMQSKNFFKTPFTWMMIIFSCLFLGTLIFTFFNDRFYNMPIGQITQITDIQSQKVTDEHKNKDIKYKEKITFKILNGEFKGQTTTIPHQYVKSQADSESFSKNDKVLLHISKNPKDATIIEKKRDTIVVIITGLFLLTVLVVGKKVGLQSILSLIVNTIAVMGAILIHDQYGAISLFFLMTCAIIISTSFTLLLVTGWHSRTLITIVSTLIGTFLCVGITEVIIKFTGGNGIKYETITFLTLPPKDVFLASVLIGTLGAVMDVSITIASGMYEILKRSPQISMKRWALAGRHIGQDIMGTMTNILLFSYLSGSLPMFLIYLKNANTITYTISMNWSLEVARALTGGIGIVLTIPITIALMELWFKLRGVNQ

SEQ ID NO: 6665 - protein, 88 aa, Staphylococcus epidermidis
YFRIQYLSGQASLNSEALAYFIFHVKQHSIFIHITFSFKVLNQTITFVDHKSIGTDYLVIANLHQSHYYELSMHLIPGKFFLDLNPYQ

SEQ ID NO: 6666 - protein, 62 aa, Staphylococcus epidermidis
INFVIYPLLCGLFCALLEVIDLWYAKKITKTHSKDWRFNPHLIWMMFIFSAVMGIIYVLLFK

SEQ ID NO: 6667 - protein, 50 aa, Staphylococcus epidermidis
LSNVVLPDPKYPLNTVTGIFAISRTLSFVNSNYYVLHSIESSFFYQYSIF

SEQ ID NO: 6668 - protein, 40 aa, Staphylococcus epidermidis
KINVSVIYKHKSRCLTFTIIVFLKIMNVSTEMYYSKLSIL

SEQ ID NO: 6669 - protein, 62 aa, Staphylococcus epidermidis
NYFVLQRFFWKLRKKVSYQPPTKQAWWVGPSPRFGLAAIKGNGFFFFFLRVIRCFSSPGFAF

SEQ ID NO: 6670 - protein, 44 aa, Staphylococcus epidermidis
VHSFHSSDLGSDNIPHIKIFILSCVAKLTTHIYKLDNRYFGFPK

SEQ ID NO: 6671 - protein, 57 aa, Staphylococcus epidermidis
LEVVASTHSDLLASIILIIILLGVVKMSDSKTLRQICTPILQNSISDCFECIASAFS

SEQ ID NO: 6672 - protein, 43 aa, Staphylococcus epidermidis
DLPVLMKIIVGKTGRKYSVRLTIKDSLEEIKFFDYFSLMLNYK

SEQ ID NO: 6673 - protein, 307 aa, Staphylococcus epidermidis
NKTVFILLNGGKSTMDIKQLRYFVEVARREHISDAALELNIAQSAISRQITQLEKELGVTLFKRSGRNIILTVEGRQLLSQATQILELMDKTIHSFQQHVSHNQQTIYIGYEESDASQMILPLIQTFEQQSNSTMIPQLTKHDKLLDQILSNQLDLAITEFTPVLERETHLRVMPLFEENYYMYVPKSHPLAMTVHPPLSQFTNQSLYCLEPMTSSIKSKLIEKTKAQVRMISDMKLAQHILSHNKGFIISSQNSLLYDHVNWTKIPLNHTELKRMLCVVMRKDNKKNDINIAWNLICTLLNKSTIY

SEQ ID NO: 6674 - protein, 62 aa, Staphylococcus epidermidis
LDKVNYFLKALVLVIMLRCTMNYLLPSPDTITFEILDGLAFGVLTVFLINWIIGIFKKYSQK

SEQ ID NO: 6675 - protein, 47 aa, Staphylococcus epidermidis
KFQFSNLSIYLRYQQNTKPLTTLLNQQADKCCNPNLGLHPCINICLN

SEQ ID NO: 6676 - protein, 341 aa, Staphylococcus epidermidis
VIEFKNVNKVFRKKRETIQALKNVSFKIDQHDIFGVIGYSGAGKSTLVRLVNQLETVSDGQVIVDGHEIDTYKEKDLRDIKKDIGMIFQHFNLLNSKSVYKNVAMPLILSKTNKKEIKEKVDEMLEFVGLADKKDQFPDELSGGQKQRVAIARALVTHPKILLCDEATSALDPATTSSILNLLSNVNRTFGVTIMMITHEMSVIQKICHRVAVMENGEVIEMGTVKDVFSHPQTNTAKNFVSTVINTEPSKELRASFNSRKDSNFTDYKLFLDSEQIQLPILNELINEHHLNVNVLFSSMSEIQDETVCYLWLRFEHDESFNDFKLTDYLSKRHIRYEEVI

SEQ ID NO: 6677 - protein, 44 aa, Staphylococcus epidermidis
IPISFSKFFDLIANIHCFKLLNYDLKSFNIIIKSNQVFSIKAIK

SEQ ID NO: 6678 - protein, 63 aa, Staphylococcus epidermidis
KKYSCLYKRGSLTVPLNTSHLYKISLTSTIISTMIYISKFYYAINTYFPLYLSPMLHNRSNVI

SEQ ID NO: 6679 - protein, 65 aa, Staphylococcus epidermidis
EIDSDFSELDTLPDSDKNSLVDVLFDSISDLLFVLLSDVIELDSDRDELIESFADSDWFKLAVVL

SEQ ID NO: 6680 - protein, 325 aa, Staphylococcus epidermidis
LFLSTYVISVYKSKILRKMELFMSEKEIWDKVLEIAQERISNTSYQTFIKDTQLYSLKNDEAIILVSLPFNASWLNQRYSEIMQAIIYDVIGYEVKPHFISEDELASYNNVNTQEVQEPQVQHSSIDDKTWGKEQFNMHNTFDTFVIGPGNRFPHAASLAVAEAPAEAYNPLFIYGGVGLGKTHLMHAIGHHVLSNKPNAKVIYTSSEKFTNEFIKSIRDNETEAFREKYRKIDVLLIDDIQFIQNKEQTQEEFFHTFNELHQNNKQIVISSDRPPKEIAKLEDRLRSRFEWGLIVDITPPDYKTRMAILQKKLKKKILIFRQKL

SEQ ID NO: 6681 - protein, 57 aa, Staphylococcus epidermidis
LLLSFVFEHAASVKDNASIKYVMTLFFIELSNSFYVSIIKQCFKFIHLLEYHLSKNI

SEQ ID NO: 6682 - protein, 329 aa, Staphylococcus epidermidis
KVLSSFLMLSIISSLLTICVIFLVRMLYIKYTQNIMSHKIWLLVLVSTLIPLIPFYKISNFTFSKDMMNRNVSDTTSSVSHMLDGQQSSVTKDLAINVNQFETSNITYMILLIWVFGSLLCLFYMIKAFRQIDVIKSSSLESSYLNERLKVCQSKMQFYKKHITISYSSNIDNPMVFGLVKSQIVLPTVVVETMNDKEIEYIILHELSHVKSHDLIFNQLYVVFKMIFWFNPALYISKTMMDNDCEKVCDRNVLKILNRHEHIRYGESILKCSILKSQHINNVAAQYLLGFNSNIKERVKYIALYDSMPKPNRNKRIVAYIVCSISSFT

SEQ ID NO: 6683 - protein, 46 aa, Staphylococcus epidermidis
TNISTMKNVLKQENKYVSKELKSKNTKSKSMIILSESIDTNFKNLF

SEQ ID NO: 6684 - protein, 50 aa, Staphylococcus epidermidis
YYSSYYSFHISMVLLKIPIKKVAYALKIKVITSFSLNLMYMDLLFFNLFL

SEQ ID NO: 6685 - protein, 321 aa, Staphylococcus epidermidis
LVSSIDTKRRIIMKKSVRLYNMIEYCNENRNFKLNDLMSEFNISRSTALRDIKEIEALGVPLYSNPGKNGGYTIIGNRDQTKIAITDEELKALVFTLSSISNVSNLPFQTEYQEILKKLYNNSNKKELINQYNDLFQYFNEDKYQFKSYKLFNEIIRLIIENKSFETCYSQNYIKEQYKGIGIMYKNHQWYFVVANIESKLVNLLNISKIKELYEMGETQECNDITMQNFQQFMVKNETAIDILIRSNVMGLNILKGYLWSDYMIENIDEETYLFKSKVNAKDIDFIAKLIVTGGVNVKVETPNSLKNAVKVELTKIINMY

SEQ ID NO: 6686 - protein, 136 aa, Staphylococcus epidermidis
IGGLKMKLAIIKFSVGGLAVLISYIVSVVLPWKEFGGIFATFPAVFLVSMCITGMQFGNEVAMHVSRGAVFGMIGVLCSILATWGLLQATHMWLLSIIGGFVAWFVSALIIFEIVEFIAHKRRDKHGWKTKRSNNQ

SEQ ID NO: 6687 - protein, 89 aa, Staphylococcus epidermidis
RRQSIMFGLIGMIIVGGIIGWIAGLILGKDVPGGILGNIIAGIVGSWVGTMILGEWGPQLGKIHIFPALLGSIILIFIISLILKALRKK

SEQ ID NO: 6688 - protein, 413 aa, Staphylococcus epidermidis
VKFLASQLFKGGFFIDYLGVDISKRSSVVAHYKNGKFQKEFFIQNNKNGYNYLLKYLNDLDHPQLIFESTGIYSRGMERFCCVNQINYIQMNPLEAKFKTSALRSWKTDQADAHKLACLGPTLKQTGSLPIHELIFFELRERARFHLEIENEQNRLKFQILELLHQTFPGLERLFSSRYSIIALNIAEIFTHPDVVLDIDKDVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 6689 - protein, 338 aa, Staphylococcus epidermidis
  MOD_RES (332)..(332): Variable amino acid
  MOD_RES (334)..(334): Variable amino acid
VKFLASQLFKGGFFIDYLGVDISKRSSVVAHYKNGKFQKEFFIQNNKNGYNYLLKYLNDLDHPQLIFESTGIYSRGMERFCCVNQINYIQMNPLEAKFKTSTLRSWKTDQADAHKLACLGPTLKQTDNLPIHELIFFELRERVRFHLEIENEQNRLKFQILELFHQTFPGLERLFSSRYSIIALNIAEIFTHPDMVLDIDKEVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRDPGTSYTFXIXVRQR

SEQ ID NO: 6690 - protein, 181 aa, Staphylococcus epidermidis
FSTFNFFLLSACTINIERDEENSEKNKQKENTHTDSNNTSSNESNTSKQSSQENTINQTEQNQPTENNSSSQQDLQLITENEAIQKVKDEFPPIRTGNDYRIDTTRTDNNVYAIKFTSQDAEGYPMKAAVTIDKRTGEFIDYIDDRSDEDKERHVQHAKESTLYKGPYDAFRKDFSHKINE

SEQ ID NO: 6691 - protein, 80 aa, Staphylococcus epidermidis
RSTLMTLLTKVLDTLTGICVALLFTKYFVNYANDMFDWHLRWYFLENVPHLALILFILVFIFAVPSEMIKDKNKKKHNDS

SEQ ID NO: 6692 - protein, 55 aa, Staphylococcus epidermidis
ILTLYLSFYETLNILFIHIFTTLLFYQLENIRKCNINHKACKTSFALDHDALSFH

SEQ ID NO: 6693 - protein, 184 aa, Staphylococcus epidermidis
FCMFSYQINKNIKLKILEEREAEQLFKLVDSNRDYLAEFLPFVEHTKKVEDSKHFIHSALQQFIDGNGFHCGIWSNKELIGVIGLHYLDLVNKTTSIGYYLAEDFQKKGIMTKCTKALIRYVYEVYDINRIEIRMSTKNKKSRAIPIRLGFTQEGILRSNERLQGEFSDSYVFSLLREECTYTR

SEQ ID NO: 6694 - protein, 108 aa, Staphylococcus epidermidis
KCIPFYFQKSSSSIIKISSTGSPKILAIFIAVNIDGVKSLRSIKDTVCRDIPAFLASSVWLYPSRARNSLSLLRKLYHFLTYKLYNIFVIMTSILVKMTKIIDFLGIV

SEQ ID NO: 6695 - protein, 65 aa, Staphylococcus epidermidis
FPSPLAELVNKYSYSLIPNKLSSTALFQLRKYKNNPLTIAVKGLLHYYIIFYSHSIVLGGLEVMS

SEQ ID NO: 6696 - protein, 41 aa, Staphylococcus epidermidis
NLSFIYLLEVYILQTSKLIVTTIIIILLSFFILLCFFFNFY

SEQ ID NO: 6697 - protein, 192 aa, Staphylococcus epidermidis
VESLGRKVKEDGVVIDEKILKVDGFLNHQIDAKLMNDVGKTFYESFKDAGITKILTIEASGIAPAIMASFHFDVPCLFAKKAKPSTLKDGFYSTDIHSFTKNKTSTVIVSEEFLGADDKVLIIDDFLANGDASLGLNDIVKQANATTVGVGIVVEKSFQNGRQRLEDAGLYVSSLCKVASLKGNKVTLLGEA

SEQ ID NO: 6698 - protein, 40 aa, Staphylococcus epidermidis
LYFFTLQQNPSFIQCSEGVLKNSLQSAIFVLDPLLTMRDS

SEQ ID NO: 6699 - protein, 40 aa, Staphylococcus epidermidis; identical to SEQ ID NO: 6591

SEQ ID NO: 6700 - protein, 366 aa, Staphylococcus epidermidis
IMALTAGIVGLPNVGKSTLFNAITKAGALAANYPFATIDPNVGIVEVPDSRLIKLEEMVQPKKTIPTTFEFTDIAGIVKGASKGEGLGNKFLSHIREVDAICQVVRAFDDENVTHVSGRVNPLDDIEVINMELVLADLESVEKRLPKIEKMARQKDKTAEMELRILTQIKEALEDGKPVRSIDFNEDDQKWVNQAQLLTSKKMLYIANVGEDEIGDKDNDKVKAIREYAANEDSEVIVISAKIEEEIATLDDEDKEMFLEDLDIEEPGLDRLIRTTYDLLGLSTYFTAGVQEVRAWTFKQGMTAPQCAGIIHTDFERGFIRAEVTSYEDYVQHGGENGAKEAGRQRLEGKDYIMQDGDIVHFRFNV

SEQ ID NO: 6701 - protein, 56 aa, Staphylococcus epidermidis
RAITTVIRETYNNESIPLDLQILLWHMVEEKDNQPQKLYHLLLIILTASLIIFFVN

SEQ ID NO: 6702 - protein, 53 aa, Staphylococcus epidermidis
AISTDSLFLIIKPLCAPIEVERAVTKGIANPKACGQAMTNTVTRRSSAKSTSF

SEQ ID NO: 6703 - protein, 187 aa, Staphylococcus epidermidis
TAELPKKTTRIGKPYYKTDNLLQRQFKASCPMEVLTTDITYLPFGHSMLYLSSIMDIYNGEIVAYKIDDKQDQSLVNDTLNQIDIPEGCILHSDQGSVYTSYAYYQLYEEKGIIRSMSRKGTPADNAPIESFHSSLKSETFYINNELNRSNHIVIDIVEKYIKNYNNNRIQQKLGYLSPVKYRELIA

SEQ ID NO: 6704 - protein, 147 aa, Staphylococcus epidermidis
LVYTLHLLYFKKEVSMMTKKIIYFICTGNSCRSQMAEGWGKKILGDEWQVYSGGIEAHGVNPKAIEAMKEVGIDISNHTSNLIDKNILNQSDLVVTLCSDADNNCPILPPNVKKEHWGFDDPAGKPWSEFQRVRDEIKTAIESFKTR

SEQ ID NO: 6705 - protein, 425 aa, Staphylococcus epidermidis
VMEFNGILEDYATYIYRGKQPKYSTNGIPVINQKAIQWSGLNKEFLKFHNNEIKVDSRHFVKKNDLLINSTGTGTVGRVYHFKFQPEKMFVDSHITIIRTDENKLRSRFLYYQMRTNKFQNMILNEFLAGSTGQVEFNKSMVKKLPISIPEVNYQDVVIKVLDELEDKIEINKKIIANLEELSQTLFKRWFVDFEFPNEEGNPYKSSGGEMIDSELGKIPSNWKIYKLKDIASHKKETFNPKKSEEVTVKHFSLPAYDNEEQAIEEEVNKIKSNKWIINNNCVLFSKMNPDTKRIWLPVIDNKKLNVASSEFVVMESPNNKINSFIYNICLNSQFIDYLKANTTGSTNSRQRVKPTIAVNYKLAIEDSIVKKYSEIITPYMEEMKILRSEIGKLTQLRDTLLPKLMSGELEISDDIEVNSDELSI

SEQ ID NO: 6706 - protein, 127 aa, Staphylococcus epidermidis
SSNTRTQTKIEITIYKRGDYSMEFIKSSSNGTEEEQLEFYEQIFNALADKIRLKILHSIRQSNTKSLCVCDLEELLELKQSKLSYHLKKLVDANILIAEKHGTWNYYKINEQQIQVVLNEDTCCKIL

SEQ ID NO: 6707 - protein, 564 aa, Staphylococcus epidermidis
LLCTRCSIVRCVWRRIIMNHILQMLSKLLSVAKEAIDRQGLIAILTIPVNNDDEIEETAQGETVYNELIDQLRLNIPKDTDYRPNIYSYFGIKKNPNDTVLMEMMIKVFHIKRFNSELFVFKANGWQKINGDELQGLISKMIQVLLVDYKPSLSTLKNVVDGLQKSTDVEELVENEHYIGCGENMFDLNTFQVVKNSIDIFPKTRLNLSLSTNDVITDKIPPYFKQYMLQLANYDDDLQYFLFQHTAVLLTADTKYRRGLILYGGAKNGKSVYIELVKSFFYSKDIVSKPLNELEGRFDKESLIDKSLMASHEIGQSKIQEKIVNDFKKLLSVESMHVDRKGKTQVEVILDLKLIFSTNAILNFPPEHAKALERRINIIPCEYYVEKADTSLIDKLQSEKKEIFLYLMYVYQQIVKADIEYLENSRVTEITHDWLNFGYEFVSSRSVSIANQKACINLLRKLIEIKSGSRIKVSELNKVINEEIKVSSQVINQLIQANFDTQTKLYNGYDYWIDLGWKEANKKEIHDISEKDNIISLDKNENITDDEALDEENLDFDWEDCDDE

SEQ ID NO: 6708 - protein, 74 aa, Staphylococcus epidermidis
KGVTGNGKSYIAFTLVNHAIDNRYSVLFYRLTDLLSKLQQADYNSIDKLLKVISRTDILVNDDFLLPYTTEQEQ

SEQ ID NO: 6709 - protein, 380 aa, Staphylococcus epidermidis
IYYTRRIYMNKKLLWSIIGIVIIVVLIIAAFILKQVNGSGSKDSKAYDTYTVRKETPISLEGKASPESVKTYNNNQSVGNFLSVSVQDGQTVKQGERIINYDTNGNKRQQLVNKVNQAQSQVNDDYQKVNQSPNNHQLQVKLTQDQSALNEAQQSLSQYDRQLNDSMNASFDGKINIKNDSDVGEGQPILQLISSNPQINATITEFDINKIKEGDEVDVTVNSTGKKGKGKILKIDELPTSYDTSDDSTASSAQAGAQGDSEEGTEMTTSNPTINQPTGGKSGETSKYKVIIGDLDIPVRSGFSMDAKIPLKTKKLPNNVLTKDNNVFVVDKNNKVHKREIKIERNNGEIIVKKGLKSGDKVLKSPKGNLNDGEKVEVSS

SEQ ID NO: 6710 - protein, 114 aa, Staphylococcus epidermidis
TKLTRCLMYKDYNMTQLTLPMETSVLIPTNDISRHVNDIVETIPETEFDEFRHHRGATSYHPKMMLKVVLYAYTQSVFSGRKIEKLLNDSIRMMWLSQNQKLSNKPCNPQGCPQ

SEQ ID NO: 6711 - protein, 90 aa, Staphylococcus epidermidis
APSTKVAMAKVIKAFKLKPDCHCTSKYLNNLIEQDHRHIKVRKTRYQSINTAKNTLKGIECIYGLYKKNRKSLQICGFSPCHEISIMLTS

SEQ ID NO: 6712 - protein, 63 aa, Staphylococcus epidermidis
TIATFQPNKTHSINTINGFINGEAIKKLTAGPKGTLEFNRPASIGIVEQEQKGVIAPNIIPKK

SEQ ID NO: 6713 - protein, 43 aa, Staphylococcus epidermidis
PFQTRRCTNRNYKGVIYQDSVPAFYFKNIYLCLIIFHIAIKLK

SEQ ID NO: 6714 - protein, 109 aa, Staphylococcus epidermidis
MARTYNVIKYVIKKNKDDLKIHGLRLYEFNIKDEKAINISQPIFVNRATLIEKIQNDEAFTHAFRVNHNTYYAGQLISLSLNKNGYINNNFEASRDIIRNVEVSILDYE

SEQ ID NO: 6715 - protein, 99 aa, Staphylococcus epidermidis
TMRTYEIMYIVRPNIEEDAKKALVERFNGILASEGSEVLEEKDWGKRRLAYEINDFKEGFYNIVRIKTDNNKSTDEFQRLAKINDDIIRYIVIREDQDK

SEQ ID NO: 6716 - protein, 71 aa, Staphylococcus epidermidis
IIMTANVVVITMTFEFSEPNLNVRGNIMEKVPAPPMATHSEMNTILKLCVIRPTLGTPASIPTNAHKRKIV

SEQ ID NO: 6717 - protein, 147 aa, Staphylococcus epidermidis
PCKTTFLKGAIIMAKITVVNNQDELYKVINQIKSEGYLETELAVISKSKLHLDDLHNSQISLMATSGSFSDRMSRLLTGEDGEETVLSRYDLTDNELEGYKQDILNDKMLVVANSDRSSHDEVEDNNAAYKEVDITHYAAESEGPKA

SEQ ID NO: 6718 - protein, 464 aa, Staphylococcus epidermidis
GGETLMDFDTITSISTPMGEGAIGIVRLSGPQAIEIGDILYKGKKKLSEVETHTINYGHIIDPETNETVEEVMVSVLRAPKTFTREDIIEINCHGGILTINRILELTMTYGARMAEPGEYTKRAFLNGRIDLSQAEAVMDFIRSKTDRASKVAMNQIEGRLSDLIKKQRQSILEILAQVEVNIDYPEYDDVEDATTDFLLEQSKRIKEEINQLLETGAQGKIMREGLSTVIVGRPNVGKSSMLNNLIQDNKAIVTEVAGTTRDVLEEYVNVRGVPLRLVDTAGIRDTEDIVEKIGVERSRKALSEADLILFVLNNNEPLTEDDQTLFEVIKNEDVIVIINKTDLEQRLDVSELREMIGDMPLIQTSMLKQEGIDELEIQIKDLFFGGEVQNQDMTYVSNSRHISLLKQARQSIQDAIDAAESGIPMDMVQIDLTRTWEILGEIIGESASDELIDQLFSQFCLGK

SEQ ID NO: 6719 - protein, 147 aa, Staphylococcus epidermidis
ERETYMKYDDFIVGETFKTKSLHITEEEIIQFATTFDPQYMHIDKEKAEQSRFKGIIASGMHTLSISFKLWVEEGKYGEEVVAGTQMNNVKFIKPVYPGNTLYVIAEITNKKSIKKENGLVTVSLSTYNENEEIVFKGEVTALINNS

SEQ ID NO: 6720 - protein, 162 aa, Staphylococcus epidermidis
MEFAYYEAKSLNDFENELKTLALNKKYTFSKETEVLKEEEILEKSNSHERELLKVFKDNAQITTYHFKSHKSNYLIIIGETKTPNIIGLTVIFDKKPFKQIGKVALGWLIALTSGGSILAIGAVFGILTSVARRTLVIKGPLGKEISQIIENELGEPIEIKK

SEQ ID NO: 6721 - protein, 242 aa, Staphylococcus epidermidis
FYYFIGETGADNMTHLTFKQGVKECIPTLLGYAGVGLSFGIVAASQNFSVLEIILLCLIIYAGAAQFIICTLVIAGTPISAIVLTTLIVNSRMFLLSMTLAPNYKQYGFWNRVGLGTLLTDETFGVAITPYVKGEKINDRWLHGLNITAYLFWTVSCVIGAIFGEYISNPDALGLDFAITAMFIFLCISQFEGIKKSRLRIYIVLIVCVIVMMLLLSSILPSYVAILIAAIVAALLGVVMEK

SEQ ID NO: 6722 - protein, 89 aa, Staphylococcus epidermidis
ESAAENKLLALASDLNILEITRKIKNTTTTLKIVPMKAPIVVVIRNIFSSIWLLAIDWLSNSSLLVLYVMKALIIANTITMIDLSIHFG

SEQ ID NO: 6723 - protein, 65 aa, Staphylococcus epidermidis
LPYANTTATPNIATNKITPKLAKIFFTLLTPFYIYFNFILIYFATLFYIYSKIIEKEHILKSMCL

SEQ ID NO: 6724 - protein, 44 aa, Staphylococcus epidermidis
GFSASNKKHSFFVKIISLKLFKSLYPYLLRSNFKISILISFTCK

SEQ ID NO: 6725 - protein, 48 aa, Staphylococcus epidermidis
HGYFQGTRYLLLQSVDTHTSSKERFLSSHSGAYQLMKCPLFQHNTHME

SEQ ID NO: 6726 - protein, 46 aa, Staphylococcus epidermidis
RLDAYNAVRFHRQPYGLTGAVTRRSDVDRPADECWEHKCVKGAPCI

SEQ ID NO: 6727 - protein, 48 aa, Staphylococcus epidermidis
KIYLRIMNLVLINVKDHQLFCHIILRGLPYEVAFYLSPNIALRLIIHI

SEQ ID NO: 6728 - protein, 371 aa, Staphylococcus epidermidis
EELAMKDTDLAQIALTQDHTGAIANPIYLSTAYQHPHLGESTGYDYTRTKNPTRTAFEEAFAQLEKGIASFATSSGMAAIQLICNIFKPGDEILVAFDLYGGTFRLFDFYEKQYGLKFKYVDFLNYEEVEKNITPQTRALFIEPISNPQMIEIDVEPYYILSKKHQLLTIIDNTFLTPYLSTPLEEGADIVLHSATKYIGGHNDVLAGVVTVKDAQLAEQLNQFHNMIGATLSPLDSYLLQRGLKTLHLRIERSQENAQKLAQRCRQSDSIDEVLYSGRTGMLSLRLNQAYSVAKFLENLEICIFAESLGGTETFITFPYTQTHVDMPDEEKDKRGIDEYLIRLSVGIEDYNDIEADIIQALENSKVGVIS

SEQ ID NO: 6729 - protein, 169 aa, Staphylococcus epidermidis
NKKALTTIAIIIIFGILAPVVFLLQQISRSRIRKNKLQAKQKENNGSNSQIISETSNNMNPENESSSNNQEKTQTTTHEATMNQQKVTRDNIFDYAIAAINKVGNADLLKFQQPEHNGSEWTINANNKSGTGANTIVVKDDETVQIWMDLKHLWIMKLNNQIGERLLVV

SEQ ID NO: 6730 - protein, 71 aa, Staphylococcus epidermidis
EALFIEKKHLRMIHFNMNSTKVFLYNSHYWGQSKIKIDNFFNKIDTLILKQGKKIELLKQRKQGLLQKMFV

SEQ ID NO: 6731 - protein, 230 aa, Staphylococcus epidermidis
QKGAFCMNYFRYKQFNKDVITVAVGYYLRYALSYRDISEILRERGVNVHHSTVYRWVQEYAPILYRIWKKKHKKAYYKWRIDETYIKIKGKWSYLYRAIDAEGHTLDIWLRKQRDNHSAYAFIKRLIKQFGKPQKVITDQAPSTKVAMAKVIKAFKLKPGCHCTSKYLNNLIEQDHRHIKVRKTRYQSINTAKNTLKGIECIYALYKKNRRSLQIYGFSPCHEISIMLAS

SEQ ID NO: 6732 - protein, 230 aa, Staphylococcus epidermidis
QKGAFCMNYFRYKQFNKDVITVAVGYYLRYALSYRDISEILRERGVNVHHSTVYRWVQEYAPILYRIWKKKHKKAYYKWRIDETYIKIKGKWSYLYRAIDAEGHTLDIWLRKQRDNHSAYAFIKRLIKQFGKPQKVITDQAPSTKVAMAKVIKAFKLKPDCHCTSKYLNNLIEQDHRHIKVRKTRYQSINTAKNTLKGIECIYALYKKNRRSLQIYGFSPCHEISIMLAS

SEQ ID NO: 6733 - protein, 101 aa, Staphylococcus epidermidis
TLQAIKEDMHLILFDGTITLEGEHAVRIDEHKIRGDRMVVPFDTFKQIGKPRNQNDIHFKNDPFQRVTNDLWITNPSLSEVDQEQIWQTGDYFSKHLQNIE

SEQ ID NO: 6734 - protein, 47 aa, Staphylococcus epidermidis
LHEAYIEIAKEHPTMIFYRERNGICRLEEAEGLCKHNPKIPLFFINK

SEQ ID NO: 6735 - protein, 42 aa, Staphylococcus epidermidis
KLNFYAGQSISLSINKNGYINNSFDASRDVIRNIEVSILDYK

SEQ ID NO: 6736 - protein, 42 aa, Staphylococcus epidermidis
AFFYAFLHTTLYLHFTNLSDSHYLLYLTCNENLIFLYMLIFL

SEQ ID NO: 6737 - protein, 254 aa, Staphylococcus epidermidis
RYLYYGGGRLLKIKRYALLCLLGGLVGGIIGYIIGAINWEKLFNYAQFANFKVVLYTTIVASLINVILTVYLFIVQNASLHYKAKIDANISDDLADTYENKSYIKSLKVRFIYTMQLIVAFIAILIPVIGNSSENHIALIMIPFFITIISSIMIGIFYRKFDARYPKLGEKHYTEKAFNIMDEGERYITLVSLYKVHQQNIVLLFIGIMMLGIFSITTGMNQSLGIILFIILFIYNSLGYLLKVSNFYKSEQKS

SEQ ID NO: 6738 - protein, 66 aa, Staphylococcus epidermidis
LTFLPLCFKLLISAIKVKATGLSIPIANPIIQRHIIRIITFGASAAPREVTVSVSKAIDKIRLRPN

SEQ ID NO: 6739 - protein, 53 aa, Staphylococcus epidermidis
QTSYLQFYLELLLTNLLSAILLRIAFTIPLISIISVRMRIKMKITTDFVSADA

SEQ ID NO: 6740 - protein, 113 aa, Staphylococcus epidermidis
EITYIMISKQIKDLRKQHNYTQEELAEKLNTSRQTISKWEQGISEPDLIMLMQLSQLFSVSTDYLITGSDNIIKKDNKSYYEMNFWAFMSEKWWVIIIIVIIICGTIGQIFSN

SEQ ID NO: 6741 - protein, 157 aa, Staphylococcus epidermidis
KANYKWRIDETYIKIKGKWSYLYRAIDAEGYTLDIWLRKQRDNHSAYAFIKRLIKQFGKPQKVITDQAPSTKVAMAKVIKAFKLKPDCYCTSKYLNNLIEQDHCHIKIRKTRYQNINTAKNTLKGIECIYALYKKNRRSLQIYGFSPCHEISIMLAS

SEQ ID NO: 6742 - protein, 400 aa, Staphylococcus epidermidis
KDNYMKKHAYKQLLLGMIAMLIVMSISRFAYTPILPFMQQDTSMDNQEAGFLATWNYLGYLVGAVIPIFYIYKTKVIDLKIYLALNIISTILMGFTEQYLIWSIFRLISGITSGTVFVLTSNIVLDSLKKIQREGISGVLYSAVGLGIFLSSIYLYFFASVDSWKMVWFVLGIVSLVLGLIVLVFMKENTNTIINFKEEKMKINNRLNKKFVIFFSIAYFFEGAGYIITGTFLVAIVKSIPSVAEYATLSWMFVGLGAIPSTLIWSLIAEKISYKKAIYGAFILQIISVCLPVFTHEIFSLVISSVLFGGTFLGLTTLFISKGQSLMYKTDDPLNLVSLLTVIYSLGQMLAPMFAGILIGKSNNYNIALIFATVLLILGLISTIFSYKQNESIGEKYELK

SEQ ID NO: 6743 - protein, 188 aa, Staphylococcus epidermidis
FNCYTKRELCEQVYNLWITRINHVLLEDKMKITILSVGKLKEKYWKQAIAEYEKRLGPYTKIELIEVPDEKAPENMSDKEIEQVKEKEGQRLLNKIKPQSTVITLEIKGKMLSSEGLAKELQTRMTQGQSDFTFVIGGSNGLHQDVLQRSNYALSFSTMTFPHQMMRVILIEQIYRSFKIMRGEAYHK

SEQ ID NO: 6744 - protein, 42 aa, Staphylococcus epidermidis
FLSYIKYVNLCATSSIHDESIYVDIKMSFYQLVYLWGYTLKL

SEQ ID NO: 6745 - protein, 51 aa, Staphylococcus epidermidis
TPSYTYYYRNVSCRFFIDNDTKLHFLKKTQHFSFDERQLYPGSYPKTDNYV

SEQ ID NO: 6746 - protein, 57 aa, Staphylococcus epidermidis
LYLYHKLRYLYFSFVPLIKLIFYLIIPVFAPLFFYFISLLVCLELCQEIGQKSMYNE

SEQ ID NO: 6747 - protein, 55 aa, Staphylococcus epidermidis
TIVYIIITMNIGDIETFPRSFINASAANNACNKAMRSGNPKLNAIFNSKPLDISV

SEQ ID NO: 6748 - protein, 399 aa, Staphylococcus epidermidis
GDEYDMSRIVLAEAYRTPIGVFGGVFKDIPAYELGATVIRQILEHSQIDPNEINEVILGNVLQAGQGQNPARIAAIHGGVPEAVPSFTVNKVCGSGLKAIQLAYQSIVAGDNEIVIAGGMESMSQSPMLLKNSRFGFKMGNQTLEDSMIADGLTDKFNDYHMGITAENLVEQYQISRKEQDQFAFDSQQKASRAQQAGVFDAEIVPVEVPQRKGDPLIISQDEGIRPQTTIDKLAQLRPAFKKDGSVTAGNASGINDGAAAMLVMTEDKAKALGLQPIAVLDSFGASGVAPSIMGIGPVEAIHKALKRSNKVINDVDIFELNEAFAAQSIAVNRELQLPQDKVNVNGGAIALGHPIGASGARTLVSLLHQLSDAKPTGVASLCIGGGQGIATVVSKYEV

SEQ ID NO: 6749 - protein, 83 aa, Staphylococcus epidermidis
VQEYAPILYQIWKKKHKKAYYKWRIDETYIKIKGKWNYLYRAIDAEGHTLDIWLRKQRDNHSAYVFIKRLIKQFGKPQKVITD

SEQ ID NO: 6750 - protein, 115 aa, Staphylococcus epidermidis
EKRYRIGYFKKVQGIGEEVVPTVVVDLVDQLKVKYSIKLILEVLNIPKSTYYRWKNKTHKNDTVTQKVIELCKANHYTYGYRKITALINQCYTSPINHKRVQRMMQKHHLNCRVT

SEQ ID NO: 6751 - protein, 301 aa, Staphylococcus epidermidis
EKRYRIGYFKKVQGIGKEVVPTVVIDLVDQLKVKYSIKLLLKVLNIPKSTYYRWKNKTHKNDTVTQKVIELCKANHYTYGYRKITALINQCYTSPINHKRVQRMMQKHHLNCRVRPKKMTKIGKPYYKTDNLLQRQFKASCPMEVLTTDITYLPFGHSMLYLSSIMDIYNGEIVAYKIDDKQDQSLVNDTLNQIDIPEGCILHSDQGSVYTSYAYYQLCEEKGIIRSMSRKGTPADNAPIESFHSSLKSETFYINNELNHSNHIVIDIVEKYIKNNNNNNNNRIQQKLGYLSPVKYRELIA

SEQ ID NO: 6752 - protein, 563 aa, Staphylococcus epidermidis
KERYDMKGKIALYSRVSTSEQSEHGYSVKEQEQVLIKEVVKNFPGYDYETYTDSGISGKNIEDRPAMKRLLQDVKDNKIEMVLSWKLNRISRSMRDVFNIIHEFKEHDVGYKSISENIDTSNASGEVLVTMFGLIGSIERQTLISNVKLSMNAKARSGEAITGRVLGYKLSLNPLTQKNDLVIDENEAHIVREIFDLYLNHNKGLKAITTVLNQKGYRTINQKPFSVYGVKYILNNPVYKGYVRFNNHQNWAVQRRSGKSDKNDVILVKGKHEAIISEDVFDQVHEKLASKSFKPGRPIGGDFYLRGLIKCPECGNNMVCRRTYYKTKKSKERTIKRYYICSLFNRSGSSACHSNSINAEVVERVINVHLNRILSQPDIIKQIASNVIEELKQKHSNQTEIKYDIDSLEKQKAKLKRQQERLLELFLDDQMDSGMLKAKQSEMNQQLEVLDQQIKEAKQANQSQDEIPNFDKLKGRLILMITRFSVYLRKATPEAKNQLMKMLIDSIEITTDKQVKLVRYKIDESLIPQSLKKDWGSFFMPKFQFEIYGQNDYFIDQITTFTT

SEQ ID NO: 6753 - protein, 62 aa, Staphylococcus epidermidis
GAYLLLLPVTFTAYPNRAQSILEKFLKSPLICYPRSVHPQVPSLCRMKSNERQEKPPAPRHQ

SEQ ID NO: 6754 - protein, 289 aa, Staphylococcus epidermidis
CKYLSNILGGFIMKIKKLLKTLLIILLCFVLSVIVQNISMLWHIVSIWSVEYILHALTYIVLSYFSVKWFIEIVLKSNMKDYRIIPVKFFKSCFLIGLILILVIDLIYLLFIPGKLIIPHYSTSVGFMEMFFSAFLITGIAAPIFEEMVFRGILMRYFEKQYGILFGIIIPSILFSLVHLFNGELKGENLLLLLIGGSIAGIMYAVTAWTFNSIWASAILHMLWNINGLLNITTQDDHWGVYQYILETKNVLITGGDYGMDTSLLSICSYIAVIIVMIVTKRHFNFLLK

SEQ ID NO: 6755 - protein, 45 aa, Staphylococcus epidermidis
FIHLESFSRLKLSVIGDIKKMIARKLFIVGFKNEKTTAAIIPTTK

SEQ ID NO: 6756 - protein, 690 aa, Staphylococcus epidermidis
GKNLIEVISLTNNNRIKRFSIRKYAVGVVSIITGVTIFIGGQQAQAAETSVQHADAHPEDSQTTQQLKNDKVEETLKASKQGNADSQQVQTIDQSKTNQNNQHSVAESAQLKSDETANQPKKEESSSVKQDVQPSKNVNQQDAATQSNERENNDIKGEGQTSKTSNQHIQSSNSHNQSTGTKDSDSEEIDQPLVKLQKPSNDSTYQTQSKTKQDSSKQLPQEKTTKRQIQTTENEQTTKVDSKKANDTQNVEKHTQEPKNDTSTSQKNHHQVATKEQSNRSTTRKTQKQSSNANQNHQFTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDVNKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 6757 - protein, 298 aa, Staphylococcus epidermidis
LILHFSYNNIKIIFHIIALNIKFIIKESFMLKKFSYSIISLSIFATSLNFIDTQAQASSSSVSEKGTMGYGYQQYLKDHPKKQTHKTQNRSTFSAESNITETNNGERVLDISEWQGLLTNEQIKQLKKNYDFIILRAQYGSEYVDKTFEKNAELLEQNKMKYGVYSYSMYESPKDARYEAKTLSQRAPKAAFYINDYEEQTVKSGDDETATQAWANEMRKLAGNKKILFYSYENFMLNHASNAVSSYDGYWLAAYQAEEPKREKVLWQYTDSYYSPELNQNVDANYIDENVNSSWFTS

SEQ ID NO: 6758 - protein, 117 aa, Staphylococcus epidermidis
VLIQILKNVLSILHFMIQCLNLIETSVLLRILYVVYRASHETAKEALGDKELRAIAHELTKTVKDNMSVDWSKRDSAKAKMRVQVRRLLKKYGYPPDLQKMAVEQVVEQAELMASQQ

SEQ ID NO: 6759 - protein, 42 aa, Staphylococcus epidermidis
KDVHKNKNENEKCLRKFPVHLFKPPIFIGIPIAIVFYKPTWY

SEQ ID NO: 6760 - protein, 90 aa, Staphylococcus epidermidis
LVYQNKGVGTVMSDNLSLFIDYINDNIIYGSEIKREKLENLFNQFAIKNVEKNIVYDELKSLDITIIESQDSYKNKLKRLFSVLLQSKKI

SEQ ID NO: 6761 - protein, 338 aa, Staphylococcus epidermidis
SHHQMKRGVTILNWQRKCILTTLLVLSSLFLVFSTITYASERDSKDSLKITTHNVYFLPTAIYPNWGQSQRADLISKADYIQNQDVVILNELFDKKASNRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMNEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 6762 - protein, 56 aa, Staphylococcus epidermidis
ICRHFSITTPNNAATIAAIKIATYEGRIELRRSIITITHTMSTIYILNRDFLIPSN

SEQ ID NO: 6763 - protein, 59 aa, Staphylococcus epidermidis
PLDQGAVLKHKIDYSIALLLMTRYFLHKFNNIFVSLINQHKHAMKLTVEKNKTIDFIQN

SEQ ID NO: 6764 - protein, 489 aa, Staphylococcus epidermidis
LIRLSFIKNIIEGESMEMEFNENNIDLETIIRDEVNKYLSRDIGDLPATQQAPLELREKYEKMEVPNKGRDIYEVLKDLNNEVLNYLYRPNHPRSFSFIPGPASRLSWLGDILTTANNIHASNFANATLPINIERNLINYLVGKIGYEIKPAGGVFVSGGSMANLTAIVAARDAQVEMEDIKKATVYLTSQTHHSVGKALHVAGFLKNNIRRIEYNDDFTMNTDSLKAAIDKDIEEGYKPAMVIATAGTTNTGSVDDFTTLGDICDHYNLWLHVDGAYGLSHILSDKAQHLFKGIERSDSASWDAHKLLFQTYSCAMVIVKEKNHLLQSFGEDAEYLDDIASDDDVIDPEMLGIELTRPARALKLWITLQVIGEDEIIERIKYGEGLAEYAEEYVSSLDNWRIISHANLSIVNFRYENSDLTEAQNNQLNSMAAQKIADSGYAIAYTTVLNNQRVIRLCTTNPLTTHDDIRETINRLDQYIGDYDMKDA

SEQ ID NO: 6765 - protein, 614 aa, Staphylococcus epidermidis
RERLMKWLKQLQSLHTKLVIVYVLLIIIGMQIIGLYFTNSLEKELLDNFKKNITQYAKQLDVNIEKVYKDKDKGSVNAQKDIQDLLNEYANRQEIGEIRFIDKDQIIMATTKQSNRGLINQKVNDGSVQKALSLGQTNDHMVLKDYGSGKERVWVYNIPVKVDKQTIGDIYIESKINDVYNQLNNINQIFIVGTAISLFITVILGFFIARTITKPITDMRNQTVEMSKGNYTQRVKIYGNDEIGELALAFNNLSKRVQEAQANTESEKRRLDSVITHMSDGILATDRRGRVRIANDMALKMLGLAKEDVIGYYMLGVLNLENEFSLEEIQENSDSFLLDINEEEGIIARVNFSTIVQETGFVTGYIAVLHDVTEQQQVERERREFVANVSHELRTPLTSMNSYIEALEEGAWQDKELAPSFLSVTREETERMIRLVNDLLQLSKMDNESDQITKEIIDFNMFINKIINRHEMAAKDTTFVREIPQQTIFAEIDPDKMTQVFDNVITNAMKYSRGEKRVEFHVKQNALYNRMTIRIKDNGIGIPINKVDKIFDRFYRVDKARTRKMGGTGLGLAISKEIVEAHNGRIWANSVEGQGTSIFITLPCEIIEDGDWDE

SEQ ID NO: 6766 - protein, 44 aa, Staphylococcus epidermidis
TLLQKADRTEAISSGVTIETTAVEGSTLTTRSGSTVNRTDLPVP

SEQ ID NO: 6767 - protein, 46 aa, Staphylococcus epidermidis
MSLHLRLRVWFCILDLSLDDLLIQLDLTFKRPHVNYYLSWSSRITM

SEQ ID NO: 6768 - protein, 106 aa, Staphylococcus epidermidis
KRTHFEINVSLKIVTFYYFLISIGSPNSFSIICEISFPNGPLITSVRLATEVSIPNTAPMANILPPEVKAISHPNATFPICLKGFLSNITVRPMILGVFVSPIIIK

SEQ ID NO: 6769 - protein, 41 aa, Staphylococcus epidermidis
NLEQLETELFDYVNWYNNFRPHSSLQYLTPMAYKDIHMKSV

SEQ ID NO: 6770 - protein, 76 aa, Staphylococcus epidermidis
ELRHILYMNELILLLGDSITTNSDEATFNFLLSITGNQILLVSGFIFENNTQLLLIIHLLLFILLTSSSIACSSLS

SEQ ID NO: 6771 - protein, 55 aa, Staphylococcus epidermidis
LELQHQSKKQLKMENAGMDIVVAQGYEAGGHRGSFTTINGEFPLVGTLSLVTTNC

SEQ ID NO: 6772 - protein, 44 aa, Staphylococcus epidermidis
KMWHINLHILYNLRTKRHIEIEELTTQLNKKNGTHNKPLQIWEW

SEQ ID NO: 6773 - protein, 468 aa, Staphylococcus epidermidis
IGWQRVDHVPCLGCGLFLLFYHTKSSIKLNIFYLGKDEGYMLDIRLFRNEPEKVKSKIELRGDDPKVVDQVLELDEQRRELISKTEEMKAKRNKVSEEIAQKKRNKEDADDVIAEMRHLGDEIKDIDNQLNEVDNKIRDILIRIPNLINEDVPQGDSDEENVEVKKWGTPRDFEFEPKAHWDLVEELKMADFERAAKVSGARFVYLTKDGALLERALMNYMLTKHTTQHGYTEMMTPQLVNADTMFGTGQLPKFEEDLFKVEKEGLYTIPTAEVPLTNFYRDEIIQPGVLPELFTAQTACFRSEAGSAGRDTRGLIRLHQFDKVEMVRIVQPEDSWNALEEMTQNAEAILEELGLPYRRVILCTGDIGFSASKTYDLEVWLPSYNDYKEISSCSNCTDFQARRANIRFKRDAASKPELVHTLNGSGLAVGRTFAAIVENYQNEDGTLTIPEALVPFMGGKTKIEKPIK

SEQ ID NO: 6774 - protein, 237 aa, Staphylococcus epidermidis
VIFKGFIVMYEENIYIKNSEYEFDNNLKQLASYLNIPVSIVRPYKEDLTLYQYKKGQVIYHSTDQIKFVYFLVNGCILHESSNITGDNYLRLSKDENIFPMNFIFNETPAPYEICTALTDCKILTLPKDLLEYLCRKHNEIFESLFKKLNETIQFQVEYIMALRANSAKERIERILQILCLSIGDDNGEFYELKQIMTVQLISNLSGLNRKTTGEIIRELKIENIIYQDKRNWIIKK

SEQ ID NO: 6775 - protein, 84 aa, Staphylococcus epidermidis
LPFNSLITIGFVSFLADFILFSFQCISSPLYCLYILDETTFSSYSIFHYLNAIFANAFIRNFFLKLTISILIEFVQLSVDDSFT

SEQ ID NO: 6776 - protein, 85 aa, Staphylococcus epidermidis
LHFKGINAINLSSNCSILELYCCNLIVIIYILVYKAIVQHYRKLTTFYWRYYILNQFQNKLYTTYFLVLFVIRFCVSVKSAVFYN

SEQ ID NO: 6777 - protein, 164 aa, Staphylococcus epidermidis
GDFNMVKKDKDTNDQKSESHMKHNDESKVPEDMTSTNEGEFKVGDKVTITAGHMPGMKGAEATVKGAYKTYAYVVSYKPTNGNEKVNNHKWVVNEEIKDAPKDGFSKGDTVKLEANHMSGMKGATAIIDNVKKTTVYVVDYKSKDNGKIIKNHKWMTGNELKAR

SEQ ID NO: 6778 - protein, 47 aa, Staphylococcus epidermidis
FYFLTTNDCIISNYHCSMLTNLSPNFQFYYQKNTLKLEFASNFRVPH

SEQ ID NO: 6779 - protein, 508 aa, Staphylococcus epidermidis
NMLNADLKQQLQQLLELMEGDVEFVASLGSDDKSNELKELLNEIAEMSAHITITEKSLKRTPSFSVNRPGEETGITFAGIPLGHEFNSLVLAILQVSGRAPKEKQSIIDQIKGLEGPFHFETFVSLTCQKCPDVVQALNLMSVINPNITHTMIDGAVFREESENIMAVPAVFLDGQEFGNGRMTVQDILTKLGSTQDASEFNDKDPYDVLIVGGGPASGSAAIYTARKGLRTGIVADRIGGQVNDTAGIENFITVKETTGSEFSSNLAEHIAQYDIDTMTGIRATNIEKTDSAIRVTLENDAVLESKTVIISTGASWRKLNIPGEDRLINKGVAFCPHCDGPLFENKDVAVIGGGNSGVEATIDLAGIVKHVTLFEYASELKADSVLQERLRSLPNVDIKTSAKTTEVIGDDYVTGISYEDMTTGESQVVNLDGIFVQIGLVPNTSWLQNAVELNERGEVMINRDNATNVPGIFAAGDVTDQKNKQIIISMGAGANAALNAFDYIIRN

SEQ ID NO: 6780 - protein, 43 aa, Staphylococcus epidermidis
NFIKKISDLYINLLREFYTPFFNAIVFINNDFIYSLRCLLRCF

SEQ ID NO: 6781 - protein, 902 aa, Staphylococcus epidermidis
TELLKEDLLMAELPQSRINERNITSEMRESFLDYAMSVIVSRALPDVRDGLKPVHRRILYGLNEQGMTPDKPYKKSARIVGDVMGKYHPHGDSSIYEAMVRMAQDFSYRYPLVDGQGNFGSMDGDGAAAMRYTEARMTKITLELLRDINKDTIDFIDNYDGNEREPSVLPARFPNLLVNGAAGIAVGMATNIPPHNLTEVIDGVLSLSKNPDITINELMEDIQGPDFPTAGLVLGKSGIRRAYETGRGSIQMRSRAEIEERGGGRQRIVVTEIPFQVNKARMIEKIAELVRDKKIDGITDLRDETSLRTGVRVVIDVRKDANASVILNNLYKQTPLQTSFGVNMIALVNGRPKLINLKEALIHYLEHQKTVVRRRTEYNLKKARDRAHILEGLRIALDHIDEIITTIRESDTDKIAMASLQERFKLTERQAQAILDMRLRRLTGLERDKIESEYNELLEYIKELEEILADEEVLLQLVRDELTEIKERFGDERRTEIQLGGLEDLEDEDLIPEEQIVITLSHNNYIKRLPVSTYRSQNRGGRGIQGMNTLDEDFVSQLVTMSTHDHVLFFTNKGRVYKLKGYEVPELSRQSKGIPIINAIELENDETISTMIAVKDLESEEDYLVFATKQGIVKRSSLSNFSRINKNGKIAINFKEDDELIAVRLTTGNEDILIGTAHASLIRFSESTLRPLGRTAAGVKGISLREGDTVVGLDVADSESEDEVLVVTENGYGKRTPVSEYRLSNRGGKGIKTATITERNGNIVCITTVTGEEDLMVVTNAGVIIRLDVHDISQNGRAAQGVRLMKLGDGQFVSTVAKVNEEDDNEENADEAQQSTTTETADVEEVVDDQTPGNAIHTEGDAEMESVESPENDDRIDIRQDFMDRVNEDIESASDNEEDSDE

SEQ ID NO: 6782 - protein, 45 aa, Staphylococcus epidermidis
YIPKYLQLINYFLFQCLFPNFFYEILWLLPDIYNLHISLLLRKLF

SEQ ID NO: 6783 - protein, 102 aa, Staphylococcus epidermidis
ITPKPPCRAIAIAIFDSVTVSIPAEITGMFNLILSDNLTLKSTSLGKTSDAAGMSNTSSNVKDSLANLFSHIKNSLQFYLYLVTLFHIFFSLFILYTIKKEI

SEQ ID NO: 6784 - protein, 107 aa, Staphylococcus epidermidis
MMTNVQRMIQMNKKSLHFLLLKRKVLGIAFNLPEGEEFTFHDLNSRANVTCSKEVQQNVGRWFAYFVKHAPRVPFIIIGKDTHGHLVYLKTGPNPHHNSNPSKGGVR

SEQ ID NO: 6785 - protein, 51 aa, Staphylococcus epidermidis
FAANAPALVIALNRVDLPTLGKPTIPAVKAIIHSPNFLCLDEIQELFSFSY

SEQ ID NO: 6786 - protein, 71 aa, Staphylococcus epidermidis
VYCLPTCCENLYASFGKTEEGRWIAKNAHNYGFIIRYPKNKESITGYQYEPWHLRYLGKRRRQKCTNLVKH

SEQ ID NO: 6787 - protein, 41 aa, Staphylococcus epidermidis
YNHNCNNKKMTTLNNLNLYKKTLSNLKFGSGSATAYISSYN

SEQ ID NO: 6788 - protein, 284 aa, Staphylococcus epidermidis
MNHNFIKLIGEVKMHYIKFIESKDNTKLYMKVNDIQDAKANIIIAHGVAEHLDRYDEITAYLNEAGFSVIRYDQRGHGRSEGKRAFYSNSNEIVEDLDAIINYVKSNFEGKVYLIGHSMGGYTVTLYGTKHPNTVNGIITSGALTRYNNKLFGNPDRNISPDTYIENNLSEGVCSDLEVMEKYKLDDLNAKQISMGLVFSIMDGVRYLKDNAQQFTDNILILHGKEDGLVSYVDSLQLYQEIGSAHKSLHIYDRLEHEIFNESSYNRTIFNEVIEWLETELTYN

SEQ ID NO: 6789 - protein, 47 aa, Staphylococcus epidermidis
TVHKKPPRCRFTIHYYISPMANETEQMPLNQSNNFLNFVGNFKNQNL

SEQ ID NO: 6790 - protein, 440 aa, Staphylococcus epidermidis
NINKYILKKMRHNIFYNRREFQMIDNFMQVLKLIKHQRTNNVVKKSDWDKGDLYKTLVHDKLPKQLKVHIKEDKYSVVGKVATGNYSKVPWISIYDENITKETKDGYYLVYLFHPEGEGIYLSLNQGWSKISDMFPRDKNAAKQRALTLSSELNKYITSNEFNTGRFYYAENKDSSYDLKNDYPSGYSHGSIRFKYYDLNEGFTEEDMLEDLKKFLELFNELASKVTKTSYDSLVNSIDEIQEDSEIEEIRTAQKDKTLKEVEAPKGIIPKYKKGVSKTTKNDSEIEKSNKENKLTGKVGEKLALNYFNELIDNKIDEDKKEQFRNILNDNPGSQHGHGYDLVAFDPTNTDKAVEKFIEIKTSTSSSIEEPFFMSLNEMFAMKEYKQKYLILRIFNVSGKEPQFYFIDPYANYSEFKDVDDLIDKVFNVEAIQYKVFGEK

SEQ ID NO: 6791 - protein, 60 aa, Staphylococcus epidermidis
AENNTKIYKKKDNFYIISIEIVFFHLFRNVISTEFFSKITGREKVDVSHQQNLLKMLSYT

SEQ ID NO: 6792 - protein, 124 aa, Staphylococcus epidermidis
TMNNDRGKSLQIPQSTSLKEGSIYVATLHSVTETDYSGDIKHQFTYEIEIDQQIFYVNRSVVVNVTHQQLSINDWLERHSNYSASHENYEPYIDQKHLILLGQYNGNYYVQDVASLDAFGGVLS

SEQ ID NO: 6793 - protein, 399 aa, Staphylococcus epidermidis
HVNNFSNVISVAIRSILKNKRRNIFTMIGIIIGIASVITIMSLGNGFKKSTTEQFNDAGAGKNQASISYMTENMEAPKNNPFKQEDMSVVEQVNGVKSAKVKEDKDSTYSVKITNTHGSSDASLKKVDKLTDVDEGKGFTNDDNEVLEKVAVIDKKIAKKVFNNHAMGQSIYINGEGFKVVGVSDSSEVDESGMPIESLIQIPTKSFNKYMGNLTQGMPQLLVTVEKGSDKKDVGKKVEKALNKKGTGVSEGQYSYEDNEAVMKTIGSVLDTITYFVSAVAGISLFIAGIGVMNVMYISVTERTEEIAIRRAFGAKGRDIEIQFLVESVVLCLIGGIIGLILGIIIATLIDLVTPEMVKSSVSLGSVILAVGVSTLIGIIFGWIPARSASKKELIDIIK

SEQ ID NO: 6794 - protein, 45 aa, Staphylococcus epidermidis
ITNKSLFTMNKSILTIHYILILIFLLFSNISDLLLSERCPIFISI

SEQ ID NO: 6795 - protein, 124 aa, Staphylococcus epidermidis
PKNKIFLERVVRMMDENRSKGNRWGVWAFFGILLVPLLVPLLCCAGPILLVALGSTGIGALFAGATGNWWLTGIFAALAIVMIALILSKLLKNKYNSPEGNGKTKNKTDCCTPPESVDRKHETR

SEQ ID NO: 6796 - protein, 422 aa, Staphylococcus epidermidis
CECNKAKEEFEMVQGPIQVNSEIGKLKTVLLKRPGKELENLVPDHLSGLLFDDIPYLKVAQEEHDKFAQTLRDEGIEVVYLEKLAAESITEPEVRENFINDILTESKKTILGHETEIKEFFSKLSDQELVNKIMAGVRKEEIQLETTHLVEYMDDRYPFYLDPMPNLYFTRDPQASIGRGMTINRMYWRARRRESIFMTYILKHHPRFKDKDVPVWLDRNSPFNIEGGDELVLSKDVLAIGISERTSAQAIEKLARNIFKDANTSFKKIVAIEIPNTRTFMHLDTVLTMIDYDKFTVHAAIFKEENNMNIFTIEQNDGKDDIKITRSSKLRETLAEVLEVEKVDFIPTGNGDVIDGAREQWNDGSNTLCIRPGVVVTYDRNYVSNQLLRDKGIKVIEITGSELVRGRGGPRCMSQPLFREDI

SEQ ID NO: 6797 - protein, 44 aa, Staphylococcus epidermidis
LFSNYKVFYIHEHNTPGWRNPAPSFFMFYNMKKAPTPFLLVWML

SEQ ID NO: 6798 - protein, 88 aa, Staphylococcus epidermidis
IHSNSSRHCGLVDKSKKLTNSTVIHMWINCVCCVLFFHIIHNCYFLFRGTTPHLFKCLGIDLHSNYSLKDSLQSANFQFIQYGFISHY

SEQ ID NO: 6799 - protein, 53 aa, Staphylococcus epidermidis
QLFKGYIGKIHTHTSNIFKREKQNKNRTIDSLKQLLYGKIFFMTYLHEHNQCL

SEQ ID NO: 6800 - protein, 200 aa, Staphylococcus epidermidis
KHIKGAIIMKKEIIEWIVAIIVAIVIVTLVQKFLFASYTVKGASMHPTFENREKVIVSRIAKTLDHIDTGDVVIFHANAKQDYIKRLIGKPGDSVEYKKDQLYLNGKKVDEPYLSENKKHKVGEYLTENFKSKDLKGTNGNMKIPSGKYLVLGDNRQNSIDSRMDEVGLLDKNQVVGKVVLRYWPFNRWGGSFNPGTFPN

SEQ ID NO: 6801 - protein, 52 aa, Staphylococcus epidermidis
RTINSLFISIDDRVGSLLPYIYYLFIKNNGILGLCLHNPSASSNLQIPFLSR

SEQ ID NO: 6802 - protein, 56 aa, Staphylococcus epidermidis
IVANGYSDNILVKLFISEIVHTEDSFLLKLYYKFNFATEPYYGIEMLVTFIQDHYT

SEQ ID NO: 6803 - protein, 50 aa, Staphylococcus epidermidis
IVANGYSDNILVKLFISEIVHTEGSFLLKLYYKFNFATEPFAIQRGDISR

SEQ ID NO: 6804 - protein, 43 aa, Staphylococcus epidermidis
IVANGYSDNILVKLFISEIVHTEGSFLLKLYYKFNFATEPTKK

SEQ ID NO: 6805 - protein, 69 aa, Staphylococcus epidermidis
IVANGYSDNILVKLFISEIVHTKDSFLLKLYYKFNFATEPLKDMFVIHICKNQKIMVIYIIIFDNNYLK

SEQ ID NO: 6806 - protein, 46 aa, Staphylococcus epidermidis
IVANGYSDNILVKLFISEIVHTEDSFLLKLYYRFNFATEPIFCYNY

SEQ ID NO: 6807 - protein, 42 aa, Staphylococcus epidermidis
KVNKNLTKLVKKINSFYVILNLAVIFSFFIREKSYRGDFFDK

SEQ ID NO: 6808 - protein, 171 aa, Staphylococcus epidermidis
LQNKNGNITKEIEEENLDIPPEALNYIANQIQSNIRELEGALTRLLAYSKLQGKPITTELTAEALKDIIQSPKSKKITIQDIQKIVGQYYSVRIEDFSAKKRTKSIAYPRQIAMYLSRELTDFSLPKIGEEFGGRDHTTVIHAHEKIANDIKSDPTFKQEVENLEKEIRNQ

SEQ ID NO: 6809 - protein, 112 aa, Staphylococcus epidermidis
KKSKMEENSMKINRYITRGISEQLSLDLQILLWNMVKDRDNQLNTDYLHIFKLQEDDNMLSITHEQEQPAYKLEYHYTNYIKNQNALPKKVYVIREDDVDAFYYVMLLPEEY

SEQ ID NO: 6810 - protein, 43 aa, Staphylococcus epidermidis
YYGNLRTNGSELYFQAHFVGSVQSTVRTKNVQDYSADTRCDYD

SEQ ID NO: 6811 - protein, 94 aa, Staphylococcus epidermidis
KYLKQVFYMQHKNKFQRINQIIQVIGFLSFLAILTIITLNFFIKGHLQGHFEIGFNIQSNQVYVVTTLIIVTIICTILSAILNMLSNKKQNYKH

SEQ ID NO: 6812 - protein, 73 aa, Staphylococcus epidermidis
KLLKPYSLDYMSHINYFMIIANFCCIFNIIKEMFTIQKASKFSVSVILKDELSLKCFNTKLYNYLCNSFIKLD

SEQ ID NO: 6813 - protein, 74 aa, Staphylococcus epidermidis
YFIKEFDFMKINHAGTLSVDYFVSYLNLIMISREVSLKEAVSYMKNEFFKGKTDLYGKVTETHFNQAIQELKQK

SEQ ID NO: 6814 - protein, 52 aa, Staphylococcus epidermidis
KSIKKCLPYWVGNTVPTGIEPAISCVTGRRVNRYTTGPRMVTPTGLEPVLPP

SEQ ID NO: 6815 - protein, 46 aa, Staphylococcus epidermidis
KLINFIKTCITKNQFYTIPKKSIIFVILTNILVIMTNILYSLYVRK

SEQ ID NO: 6816 - protein, 127 aa, Staphylococcus epidermidis
RKVKKVKKVENTNSNMHKNDNSYVLSALSYLSIFFAPVILPLFVWILADEPTSEHGKKAFINHIMTWVSFFIGRLAFIFSKEVFDKPLDHQLLIFSILLIITIIFFLIALILYILNINRGIKILLKK

SEQ ID NO: 6817 - protein, 127 aa, Staphylococcus epidermidis
RKVKKVKKVENTNSNMHKNDNSYVLSALSYLSIFFAPVILPLFVWILADEPTSGHGKKALGNHIMTWISFCVGRGIFIFSKGVFDKPFDHQLLIFVIALIIAIVFFLIALILYILNIIRGIKILLKK

SEQ ID NO: 6818 - protein, 46 aa, Staphylococcus epidermidis
LLSNNQATHFLPKLNLIYTYYFFLSAFKINEIIKIKIIEPNNAGKM

SEQ ID NO: 6819 - protein, 84 aa, Staphylococcus epidermidis
NSSNMDGPKTSMDHETKQSDWRTVASCLASQNYISLVKGLVHYFTAIEDEEILDKIYDDFMNDDSITTVLNNDLQTIINHYLSK

SEQ ID NO: 6820 - protein, 59 aa, Staphylococcus epidermidis
RATNTHDTRSKRLYICHRWLQWFTSRRLTTQQLRSIIQHYDLPAPNDARHIDRTNLSLI

SEQ ID NO: 6821 - protein, 42 aa, Staphylococcus epidermidis
RHTNVCLKTMNIYCHRLSYKIMKIIHEVTSIYLLENACKNIK

SEQ ID NO: 6822 - protein, 374 aa, Staphylococcus epidermidis
KEQNTMYQTNTRDLITKLPQSNKTEHFLMNKFSNQDKVQQLQRQISQQLDQQYNELLSNEKAKLDQYVEVHHNLEPLKKEIESESINLDTDKLPDIKATMLEKAKNDEHSDKIEHLFDRLDQSLNGTNRLYTQLSLIGTRTHRITTKRFNVQGLPKLVQQTILPSQFKKVYTIDFKSFEPSVAAYMTQDEQLIDYLNLEEGLYDALLRDLSLSKEKRVSVKRAFIGSFLFGGRYSSSKFKINQEVSEINWLQVMSKFKKIIEFKEQVEKYKTMPTPYGIEHDMSAFQGSSIMAIYVQTVASYIFKHILLEVYKAQCEQKTFKIIVPIHDAIMIECNDKEIAQSVAQLMKDTANRLFNGEFAHVTVEALGGIDNE

SEQ ID NO: 6823 - protein, 44 aa, Staphylococcus epidermidis
QFKKHFTHCKKESKTYTAYTESLHTLREGIERKFENGLGVLMPI

SEQ ID NO: 6824 - protein, 61 aa, Staphylococcus epidermidis
EFKKKEVRFSYTNLELLYKHSLLNLNLCSSFLSKRPTAFELNFELLVELSINSYINVSNQL

SEQ ID NO: 6825 - protein, 41 aa, Staphylococcus epidermidis; identical to SEQ ID NO: 5563

SEQ ID NO: 6826 - protein, 256 aa, Staphylococcus epidermidis
KNKNARRGNMLTVYGHRGLPSKAPENTIASFKAASEVEGINWLELDVAITKDEQLIIIHDDYLERTTNMSGEITELNYDEIKDASAGSWFGEKFKDEHLPTFDDVVKIANEYNMNLNVELKGITGPNGLALSKSMVKQVEEQLTNLNQNQEVLISSFNVVLVKLAEEIMPQYNRAVIFHTTSFREDWRTLLDYCNAKIVNTEDAKLTKAKVKMVKEAGYELNVWTVNKPARANQLANWGVDGIFTDNADKMVHLSQ

SEQ ID NO: 6827 - protein, 670 aa, Staphylococcus epidermidis
VNKNITALKSTENTTYMQYTVHIDDQIINNIKECTKKFKILPMEDKIPLSPLLQPEYAGEVQDFISTYEQFMINFGKVILDSQGIKIQFESESLSSIQRGIQEHCYLNKRTNDIDVTKEWYLCKFSNRTLEEDKNQLYNALKQLMNDSKNKKQAFQEVFKVHIDIYLYNKEKSEYKYQASSYFYLVKENPKIIYKKRHLQEKQGIKGTTFTNKLKLLNKMYGVDVAKYQPFYNSNNPEYERGQFGERYISQRSNYEFNRLQYQIIYILSKILDKHPLPKSDNNYKHIPTIEKAILRDDSHNFYEYFEDIMKEIMNMDNSPLQEKLLTDFTYQSQCRWYSENKKLKLQLERFMHKVLESNYYEGNKLLRMMSNAIEETINEAKEDKVHFNYFKDYFLTDGGVKNWEQISEKITEFNGKVINDIQHEYNKIQSKNTNQNQKLNFVYLYHCFEFSNNIVKAKDNESKNYILFFIDKYKIKTPFLDQLLINCLNQEIDQESINYNMQTMFEKERYDRSSIIEKLVATRKFKYEKDDSDLFKQLFNDVENSIDRLGIYLLNNGINSNDENARYYRSFLKELSRIKSKLTPFSLEISKSSGREQHYPDDAVDDKDERRKNKEETYHAFDDKSDIDYKLKNKISDYIDNLLSVKIRNNLYDISPNTKSNNYNEPTQK

SEQ ID NO: 6828 - protein, 143 aa, Staphylococcus epidermidis
MFKNILLPYDFENDFSAIPDYLEKVTDEDSVVVIYHVVTENDLAISVKYYNKHKEDIIREKEKKLTPFLRELEKRDIQYKIDVDFGHIKDTILEKITSGDINNGEFDLVIMSNHRVDLNIKHVLGDVTHKIAKRSSVPVLIVK

SEQ ID NO: 6829 - protein, 59 aa, Staphylococcus epidermidis
NCKNFIIHKVYLFYFNFNVKALIATITVLKDINIAPTAGDNINPIKANAPAAKGTATIL

SEQ ID NO: 6830 - protein, 44 aa, Staphylococcus epidermidis
TLKNQFSDMLIYFELGFMSQAHQAQSATSLFLYLICSDMVFYTV

SEQ ID NO: 6831 - protein, 428 aa, Staphylococcus epidermidis
SRKKLTHFKNKCLKSLKRGFYVMLSKKQIKKTLNSDKMPSLIVNELDRELQNKLKQQYPSKEELIKELKYDAVNENSAVLKNELTSKLKFKLKDYQDSNEFLFYLKNSQKMIEIHDYKMEQFFEDIPLEDSDVYKSIANNEDTETYIIMKAPEFNEEDKLNISIKVDGKFKELDFHRIAYDSKKEMKYLYQNRYIKIFMLIEKNLEYISWGFHHLFNESIGEVNTINIIDTYKMLIALASGEMYTANKIKFNNDSASKNKEILESLNRDLKLFEIIHEFQNSLDKEFKISTPFNSKEIIEGVKTYFLLYKQKLILEEKRLESLLIKTSSFDLEDIKGKKFTLIQEEKVTKTIFTQKISYTQYQCYYQVKSSDYEKLQDDEFKLKFNPEDVITIILKASFNTTEPIGLENIAFEEAETLDTFISNYKSN

SEQ ID NO: 6832 - protein, 146 aa, Staphylococcus epidermidis
GGKNMKFQVSPYFLITQNAEGLKKLYEELFGAKTLYIQRIKDRPIDKQLNIDENDLNKIDQCVLQFGDIKIMIADDTEGLPITQGNNISLCLTFDQVEETKHVYDQLIEKGSEVLKTFSPEFYTEGYGYVRDPYGISLHLFTKRKN

SEQ ID NO: 6833 - protein, 173 aa, Staphylococcus epidermidis
RSENFMKTIKSTLETEAIFSDDQQHRYLLKKTWNSEKQKITIITMYPNYTGLLRIDLTTQLIMNKVSEMDTFGSINFVNLYSNITTPINLKHLENAYDNHTDIQIMKAVKESDEVILAWGAYAKKPVVESRVNEVLEMLKPHKKKVKRLMNPATNEIMHPLNPKARQKWTLKA

SEQ ID NO: 6834 - protein, 226 aa, Staphylococcus epidermidis
SGENIRRNKLMKNISEFSAQLNQTFDQGEAVSMEWLFRPLLKMLAEGDPVPVEDIAAETGKPVEEVKQVLQTLPSVELDEQGRVVGYGLTLVPTPHRFEVDGKQLYAWCALDTLMFPALIGRTVHIASPCHGTGKSVRLTVEPDRVVSVEPSTAVVSIVTPDEMASVRSAFCNNVHFFSSPSAAQDWLNQHPESSVLPVEDAFELGRHLGARYEESGPTNGSCCNI

SEQ ID NO: 6835 - protein, 281 aa, Staphylococcus epidermidis
IMENLLEVQQLNKSYKNSEFQLTDITFSVKPGEVVGLIGKNGSGKSTLINTLVGNRHKDNGSLKFFDKEVTENDFKYKEHLGVVFDDLRVPDKLTLQYINKVFTEIYDAWNSDTFFSLIKAFELPTNNQIKTFSRGMRMKAALTIALSHDAKLLILDEATAGMDVSGREHVLEILEDYLGDDRAILISSHISEDIEQLATQLVFMRDGRIILKESKEVLLSQYGIIDQPVEHFNISNEYLIATRRRNDRQISLVNNYQKVPDAQPLKTIDDATKIIMRGEV

SEQ ID NO: 6836 - protein, 322 aa, Staphylococcus epidermidis
NQEKKKTIKFEVNQDSATLWYHPHPSPNTAKQVYNGLSGLLYIEDSKKNNYPSNYGKNDLPIIIQDKTFVSKKLNYSKTKDEDGTQGDTVLVNGIVNPKLTAKEEKIRLRLLNGSNARDLNLKLSNNQSFEYIASDGGQLKNAKKLKEINLAPSERKEIVIDLSKMKGEKISLVDNDKTVILPISNKEKSSNKGNTPKVSKKIKLEGMNDHVTINGNKFDPNRIDFTQKLNQKEVWEIENVKDKMGGMKHPFHIHGTQFKVLSVDGEKPPKDMRGKKDVISLEPGQKAKIEVVFKNTGTYMFHCHILEHEDNGMMGQIKVTN

SEQ ID NO: 6837 - protein, 52 aa, Staphylococcus epidermidis; identical to SEQ ID NO: 5769

SEQ ID NO: 6838 - protein, 325 aa, Staphylococcus epidermidis
ADRKMSISEYKNRYLESLYNTFKTELENERTRYFILDTNYTNSDDTEKEFTWDVKQNNKIREGDLFIFRRPTNLSQIAQQFYFFGAGKIEKIERKNNVATAYISKPLLFVDRVLKDNIENLKWEFKERIKEEWEQFFFKNKISNITKNDFLKLLSLSRNVVEIESNYINNDISLTFKQMADMATRIKKNIYYVGNHEAFVQAKGSAHFEFSKRIKQNYSYRCAITGIKTKDFLVVTHIIPWHENEFIRLDPSNGICLSLFLAKAFKKGFITFSNSYRVVLSKEAEKDAALYEELKIYENQKIELPDCQKPNLKYLDWHREHIFKN

SEQ ID NO: 6839 - protein, 169 aa, Staphylococcus epidermidis
RYMNTIKSTIHTEAIFSDDEQHRYLLKKIWDDKKPACTVITMYLHLDGVLSLDLTTVLILNQLANSEQYGAVYLVNLFSNIKTPENLKHIKEPYDEHTDIHLMKAISESDTVILAYGAYAKRPVVIDRVEQVMEMLKPHKKKVKKLINPVTNEVMHPLNPKARQKWTLK

SEQ ID NO: 6840 - protein, 150 aa, Staphylococcus epidermidis
RRMKVIFTQDVKGKGKKGEVKDVPVGYANNFLLKNKYAVEATPGNLKQLEQQNKRAEADRQQEIDDAKALKEQLKDIEVEVSAKTGEGGKLFGSISTKQIAEALKKQHDIKIDKRKMDLPHGIHALGYTNVPVKLDKEVEGTIRVHTVEQ

SEQ ID NO: 6841 - protein, 214 aa, Staphylococcus epidermidis
SIMKGLTLSIFYTAKKSFFIYLVVGIIAAVVFSFLNPTMNSFLAIIFLISPITDNFKREKDSRWMNYISTLPVRRADYVKSYYTIFLLCALVGILAGVPSVGLITQSLSMVFISLCVAIGGAGTFSIMFPLTFKFGSENSNVIVMTTTFAVIIIYFLFYIASMILSNQTGSGSMITMLSNTQSYVVYSIYGILGLISIIISYILSIKIFNKQEL

SEQ ID NO: 6842 - protein, 424 aa, Staphylococcus epidermidis
SVMKNFILSVQHLLAMYAGAILVPIIVGTSLKFSAEEIAYLVTVDIFMCGVATFLQANKVTGTGLPIVLGCTFTAVAPMILIGQTKGLDVLYGSLLISGILVVLIAPFFSYLVKFFPPVVTGSVVTIIGINLMPVAMNYLAGGEGAKNYGDTKNLILGGVTLLIILILQRFTKGFLKSIAILIGLAIGTALAGIFGMVDIKQVGDAHWFGFPVPFRFSGFGFDVSSILVFFIVAVVSLIESTGVYHALSEITGRKLERKDFRKGYTAEGLAIILGSIFNAFPYTAYSQNVGLVSLSGAKKNNVIYGMVILLLICGCIPKLGALANIIPLPVLGGAMIAMFGMVMAYGVSILGNINFQNQNNLLIIAISVGLGAGISAVPQAFKGLGEQFAWLTQNGIVLGAISAIILNFFFNGIKYKQTEENVK

SEQ ID NO: 6843 - protein, 1041 aa, Staphylococcus epidermidis
IVMNFQFNEDDLEQVALEWLQSLGYDYKKGNEISMTGLTPERKSDKDVVLHERLEKALRKINSDIHPRFIEKAIHELTLEKSPNLLENNLTFHENLINGIEIEDYDDEGQSVVEIVKIVDFEYPQNNDFLAVNQFTVVNGDYTKRPDIVLFINGLPIVVIELKNSTIETVGVEDGYRQLETYKMRIPQLFTFNEVLVTSDGINTKAGSLTANYDRFMTWRSKDGETESSSSLASLDVLIHGMLNPETLLDLIRYFVLFQDDGKGHISKILAAYHQYYAVNKAVDRALLASSGQGDGKGGVIWHTQGSGKSLTMVFFSGKLIQMLNNPTLVVVTDRNDLDNQLYSTFVKSKGRSGKGLLRQTPKQAETRKELKSLLSVESGGIVFTTMQKFEPEQNETTMSALTERKNVIVMADEAHRTQYGFNAKYDDKGEGIKYGYAKYLRDALPNATFVGFTGTPVASTDKNTQMVFGNYIDVYDMTQAVADGSTVKIYYESRIIPLNLPQNLDLDEAYNDITEDQEEDVKQRLKSKWSRIEALAGAKPRVEALAKDIIQHFETRQQAMKGKGMIVTMSRRIAVDLYDEIIRLKPEWHSDDDDKGVIKVVMTGSSMHPISFQRHIGPKKRRNLLEKRMKDMNDELQLVIVRDMWLTGFDVPSMHTMYIDKPMKGHNLMQAIARVNRVFKDKPGGLIVDYVGIAESLKEALKEYTESDQAQTAIDTDKAVELMLLKYDVIQDMLYNLDYSKFNSEKKSERYYAISDTMDYVIGLGEDERQRFIKTVTELGKAFALCATEPTAQELNDEIAFFKAVKAGLVKLLQPPKEGKTRKTPAEVEAEINQLVSQSVVTEDVIDVYQTLGLEQPDLSILSDDFLKDVEGLKQKNVAVELLNRLLKGQVKSLMKTNATVSKRFSEMLGNSINKYNSRSIETSKVIEELIQLAKDIKQEQQRGNELGLNSDEIAFYDALASHETAKEAMGDKELRAIAHELTKTVKENMGVDWSKRDSAKAKMRVAVRRLLKKYGYPPDLQKMAVEQVVEQAELMASNQ

SEQ ID NO: 6844 - protein, 112 aa, Staphylococcus epidermidis
KSQNERKSLMNRYITQGIANNLPIILQQQLWKIVAQRENEQSKELEAIDYFHIFQFNMHNDQLYIKHKQERPEYIKTHKANYSKAININKVYIIREDDVDLSYYVMLLPEEY

SEQ ID NO: 6845 - protein, 82 aa, Staphylococcus epidermidis
LIKKMDEDKGTGKILSSLYIKDDELKKQYSTCREFLDDYLYTAWIIPVLLNEHATSQLEEYLGRYLINQNVPILNLLSHTFK

SEQ ID NO: 6846 - protein, 48 aa, Staphylococcus epidermidis
NVKKACEFCLIRALRALNEMINIILSPINMNVKKLSNSYLSIFAVNHI

SEQ ID NO: 6847 - protein, 60 aa, Staphylococcus epidermidis
IVEKLKTLLNLSHFIFLYTVSRTQHTTNEFQKVRVKLTCFFYGFKILESGQSTPLYNYKK

SEQ ID NO: 6848 - protein, 648 aa, Staphylococcus epidermidis
SNEKVMVNTLSDVNNTDNYGAGQIQVLEGLEAVRKRPGMYIGSTSERGLHHLVWEIVDNSIDEALAGYASHIEVVIEKDNWIKVTDNGRGIPVDIQEKMGRPAVEVILTVLHAGGKFGGGGYKVSGGLHGVGSSVVNALSQDLEVYVHRNGTIYHQAYKQGVPQFDLKEIGDTDKTGTAIRFKADKEIFTETTVYNYETLQKRIRELAFLNKGIQITLKDEREEEVREDSYHYEGGIKSYVDLLNENKEPLHDEPIYIHQSKDDIEVEIALQYNSGYATNLLTYANNIHTYEGGTHEDGFKRALTRVLNSYGTQSKIIKEDKDRLSGEDTREGLTAVVSIKHGDPQFEGQTKTKLGNSEVRQVVDRLFSEHFERFLYENPSVGRIIVEKGIMASRARVAAKKAREVTRRKSALDVSSLPGKLADCSSKNPEESEIFLVEGDSAGGSTKSGRDSRTQAILPLRGKILNVEKARLDRILNNNEIRQMITAFGTGIGGEFDISKARYHKIVIMTDADVDGAHIRTLLLTFFYRFMRPLIEAGYVYIAQPPLYKLTQGKQKYYVFNDRELDKLKQELNPSPKWSIARYKGLGEMNADQLWETTMNPEHRSMLQVRLEDAIDADQTFEMLMGDVVENRRQFIEDNAVYANLDF

SEQ ID NO: 6849 - protein, 50 aa, Staphylococcus epidermidis
FVWNCVKKSDKNPCIMNDLTIYKQLQSNIEWNVNSFLDTFHVYIFIRHWR

SEQ ID NO: 6850 - protein, 263 aa, Staphylococcus epidermidis
MNWKLTKTLFIFVFILVNIFLVIVYIDKVNKSQVNDSEKVNEVNFQQEEIDVPKDVLNQSVKDTELEQITARSKNFSSYAKDHSSLQTSDSDKTLEGDIDKGVQVSDKNLQDIKEYIAKKIFNGKEYQLSDLTKDKVTYEQTYKDYPIMNNSKARLTFNLSDGKATSYKQTAMDDIQVAKGSNSTKKQVITPRKAIEALYYNRYLKQNDQVLDARLGYYSVVKETNVQLLQPNWEIKVKHKGKDEVQTYYVEATNHNPKVIDY

SEQ ID NO: 6851 - protein, 61 aa, Staphylococcus epidermidis
IHRLVKMMDFFKLWMRYRVSLDKNRENLLKSDFCEEDNDDKEIRSYCDWYRFCGVNHSSKM

SEQ ID NO: 6852 - protein, 304 aa, Staphylococcus epidermidis
MNYEKNEREGIFYMNQLKHILSSLFEPLTKVETYENLITKVIMILIYILVAIVVIAILNKIIEQAFKIQNKSKKGNKKRSKTLISLVQNIVKYIVWFVVITTILSKFGISVEGIIASAGVVGIAVGFGAQTIVKDIITGFFIIFENQFDVGDYVKINSSGTTVAEGTVKSIGLRSTRINTISGELTILPNGSMGEITNFSITNGTAIVELPVSVDENIDQVEKKLNRLFVSLRSKYYLFVSDPVVDGIDAIESNKVTIRISAETIPGEGFSGARIIRKEAQKMFRQEGIRMPQPVISNYNEEKS

SEQ ID NO: 6853 - protein, 70 aa, Staphylococcus epidermidis
NTYEVFFMRLNLDWNKDFQEFQDILNSGIHPEWLYCAKANLVLEPAYTGEGKQFFSTQDIIKASKIIPFF

SEQ ID NO: 6854 - protein, 308 aa, Staphylococcus epidermidis
LKYEGTFSMLTKEFAQRVELSEKQVRKIVQHLEERGYHLSKTEYRGREATDFKEDDIELFTDIANKVKQTNSYDLAFEELEKEKDFLQVIVKDEDSQLPTDQNVAQLVEDLRSEIQKMREERQMLGQMINQVHQQQQELKELQTDITTKLDSNAQSLKSIQNSQEVIQSAQEQQSKDIAKANELKDSELRSHFDSMSNSASISQSNVASQSTTASLNQSESANDSMSSSLSESNSITSESNTNSKSEIESKSTSTSEFLSESGSVSNSEKSESISHSQSTSATPSSQSTYQQQPKEEKKGFFARLFNL

SEQ ID NO: 6855 - protein, 41 aa, Staphylococcus epidermidis
NFHDDVHGHYDDYVIHGYHDACDWNDSCDFDDYALHYYYSN

SEQ ID NO: 6856 - protein, 120 aa, Staphylococcus epidermidis
GGNDMKTTTQELKQYMTRLFQLSNNETWECETLEEAAENILPKRFINDSPLAHLILETYTYYNNELHELSIYPFLMYSNNQLISIGYLDHFDMDFLYLTDTKNTIIDERHLLKEGGNNHE

SEQ ID NO: 6857 - protein, 258 aa, Staphylococcus epidermidis
IMNDLLKIYEKLKKDIENRWLIPFHYVVFGLALVVYFLEIPIYKLVNNLDKELVDKVLYAFSLVYDHIVLIFILIIIIILIVYLFFDVFNMNRFVPSPTTYVDGSESSINYVSAIKRLINFMILIITKYWITYFIVNLIFHNDKLLYLNNDSKHLYKCLLFLNICIFIVHILKSIFIIKIMADDSLRLINENDLTDFYITLNKNDEYRMVKPKYRKIDNFIIIKKSEDFTNSNEYKVINKSKNFEEIIYHFDNLTSNH

SEQ ID NO: 6858 - protein, 45 aa, Staphylococcus epidermidis
DHRDRCHHNSHTKGVDDELDDHGRYAIVIQRCRDHQHKGWQGTTK

SEQ ID NO: 6859 - protein, 58 aa, Staphylococcus epidermidis
SNSDNSRRYICYCLLTFNLLIFGNHIKSLNLQKKLVKIKIIRKFRLLETKCISTSQYN

SEQ ID NO: 6860 - protein, 396 aa, Staphylococcus epidermidis
SRSDFMSLSKETEVIFDVRRGNDYDSANPPLYDSSTFHQKVLGGETQYDYARSGNPNRTLLEEKLARLEGGKYGFAYASGIAAISAVLLTLNAGDHVILPDDVYGGTFRLTEQILNRFNIEFTTVNATHIDHITEAIQSNTKLIYVETPSNPLFKITDIHAVATLAKEHKILLAVDNTFMTPLGQSPLALGADIVIHSATKFLGGHSDLIAGAAITNNREVANALYLLQNGTGTALSAYDSWALAKHLKTLPVRFKQSVHNAERLVQFLSQREEISEVYYPGNNLTHLKQASTGGAVIGFRLKDESKAQKFVDSLTLPLVSVSLGGVETILSHPATMSHAAVPEDVRRERGITFGLFRLSVGLENSEELIADFNYALKEAFNESFTEPIKEQRFSS

SEQ ID NO: 6861 - protein, 219 aa, Staphylococcus epidermidis
KKGDKMKQLLFKTSCVIMVLLTSSLSIVSTYSHATTSGGTSSSSLASSSSSSSAASASRGSTSSSTSMSRSSAINASRNAQQSSQRAAQQATKSSRVTATKNKGQQSVSRQKAQSRSLMPSQRPYDSSAPYSSQYIATTYYNNWLFYYIFAHSFLNQHEKKNSVDAQFNMLKQQMKPHEKLYTVTVKTKQGKRVVVVPKKQYDKIEKGKHIKVKNGVVQ

SEQ ID NO: 6862 - protein, 42 aa, Staphylococcus epidermidis
HGFESRRSHHSRSRSVAVNTPACHAGDRGFDSRRDRIAYPIG

SEQ ID NO: 6863 - protein, 42 aa, Staphylococcus epidermidis
NIVEGYVSKNLAFKFTAFSALFKYSKTQKQPRKPILTGFYNK

SEQ ID NO: 6864 - protein, 42 aa, Staphylococcus epidermidis
LPLDISTVWLRISVIGLVIVRAMKNPSITVMNSDIAVPTMNI

SEQ ID NO: 6865 - protein, 41 aa, Staphylococcus epidermidis
NMLENIIDYYKDYFYPREKIKHNNVECNVSLFFKAVDAFKK

SEQ ID NO: 6866 - protein, 254 aa, Staphylococcus epidermidis
YELEVRQMSQYPLWNQLNTLKEAQWVDLTHTFDPNIPRFSEFEKGEVSTLFNVKDHGFYVQRWSIVTQYGTHIDAPIHFVENRRYLEELDLKELVLPLIVLDYSKEAAQNSDFIVSRKHLEDWEQQHGRIEAGTFVALRTDWSKRWPDIEKFENKDVDGHQHLPGWGLDALKFLIEERGVKSIGHETFDTDASIDTAKNGDIVGERYILGQDTFQVELLTNLDQLPTRGAIIYAISPKPKDAPGFPVRAFAIKP

SEQ ID NO: 6867 - protein, 289 aa, Staphylococcus epidermidis
IKIERCGKEMAYTDDQRLKMNNDDSVQFIELELIRPNPYQPRKTFEEERLNDLASSIQQHGILQPIVLRQTVQGYYIVVGERRFRASKLAGLTEVPAIIKELSDEDMMELAIIENLQREDLNAIEEAESYKKMMTDLNITQQEVARRLGKSRPYIANMLRLLQLPKNVAQMVQHGALSSAHGRTLLTLKDASKIKKTAKQAAQESWSVRYLEEYVNGLVSKDISRKVDKETKESKPKMIQQQERFLKKQYGAKVDISTSKNVGKITFEFKSEAEFKRLIRQLNKDYKEY

SEQ ID NO: 6868 - protein, 53 aa, Staphylococcus epidermidis
NRSDKKPYLSSVHISFFRSLRIKISALHAKKPHSSVEKCGCQKSYFLFDSKII

SEQ ID NO: 6869 - protein, 45 aa, Staphylococcus epidermidis
YKQEIKKCMRHSYVSCILAYWTSMTELEHNLITSLVRLPYINFCS

SEQ ID NO: 6870 - protein, 186 aa, Staphylococcus epidermidis
HIKEGINMAGRPKDPTINKKIYTEIQRLLETTHFRDITIDQISENTGISKATIYRRWKDKSSIIMSAFIEQSQYIVIHNQDNLYDDLFQFLVKIKDIYKTKLGSAVIEILISHQQMEARETFMTNYFNHNRKVLKEIVRKHIQEEEQDLFIDLIFSPIYFNILIKPETLDKNYIKKMLNQVLRIYH

SEQ ID NO: 6871 - protein, 61 aa, Staphylococcus epidermidis
YLMEVFEIRSREKSLILCSQMTSVEWHKKLSGKVIAYAILIRAVSKSFKIFLEVESLRKIK

SEQ ID NO: 6872 - protein, 117 aa, Staphylococcus epidermidis
CLMEKAYRIKRNSDFQAIYKNGKSVANRQFVVYTYKNRDLKHFRLGISVSKKLGNAVTRNRIKRAIRENFKVHKQNIIAKDIIVIARQPAKDMNTLEIQSSLEHVLKIAKVFNKKIK

SEQ ID NO: 6873 - protein, 52 aa, Staphylococcus epidermidis
IQMEVFCMVKRTYQPNKRKHSKVHGFRKRMSTKNGRKVLARRRRKGRKVLSA

SEQ ID NO: 6874 - protein, 47 aa, Staphylococcus epidermidis
HLVEHGFYIIKVCIKKAINEVVLKTSFIAFYLVRKSSLLFKYYDDEH

SEQ ID NO: 6875 - protein, 216 aa, Staphylococcus epidermidis
YVKEIYYMSTQELKENDIQNSSIPFVNHFNKLRHQPKWILKSIIVIVLAIISAFITYNTSNELLDNQSIANSQMDENMLRMTTTIGAFIGTIFSVVVVFLIFLVISKIFKSDAKASSLFSAALSYSIIILGFTIIISLIQIVFGLKITDYKLDSLNIFSKDNKTLMAFSLTNLLKAFLTGVVYYSTSRLSKKTSMILGIIALIILIGSGMLGGMNG

SEQ ID NO: 6876 - protein, 149 aa, Staphylococcus epidermidis
TMKEINIVSLQMIKTDTLSYLKNHISNPEDAAEILRSFIGNSDREHLILICMNSKNEPTHIQTLSIGSINQTVIHPREIFKTAILSNANSIMLGHNHPSGDITPSPEDINVTKRLMLISEMMGILFYDHIIFSDSNTYSIRQHDLEVEV

SEQ ID NO: 6877 - protein, 61 aa, Staphylococcus epidermidis
CSSFIYLIKNINIEIERKVTLQAVNYNNVEILSPLIREKLYVYRHNVSTITQNKIFSFNKL

SEQ ID NO: 6878 - protein, 213 aa, Staphylococcus epidermidis
KELLNSMKKRVITYLILALSLTLAACSNTNDNNNQEHHSNAHAPKNAKTLKEKDIFSSNKKGQKISEKEMKQALEKYLQANSDVLDNKYVMQHKLDKQSDSNPKITESQADRLSKLSNLAVKNDLHFKKFIKNNHIPEEYKDPTDRIINYFHALNSTISNVDADIEKLNYQPQNSINVVDVPTKYSGDVNKKQQDKITTFLKKKGIDTEVFNK

SEQ ID NO: 6879 - protein, 50 aa, Staphylococcus epidermidis
EYVLTILKEDVRSTIITQLVLNNSCFILSPFFYFVTSSFETALPSTSSSP

SEQ ID NO: 6880 - protein, 128 aa, Staphylococcus epidermidis
TTSLLHYLGGNNMKTITQELKQYITHLFQLSNNEAWECEALEEAAENILPERFINDSPLVHLTLETYTYYNDELHELSIYPFLMYANNQLISVGYLDHFDMDFLYLTDTQNIIIDERHLLKQGGQDHE

SEQ ID NO: 6881 - protein, 70 aa, Staphylococcus epidermidis
KRALETDNLYYLAYVTTLDNCFKYYQLITQNEHFCYSQQEERESYQQKFQSMINGLKIKIGIQSSNDDAQ

SEQ ID NO: 6882 - protein, 52 aa, Staphylococcus epidermidis
RFKLLLMYWIVTHSRVVYGDTVETSKAIFSRLYESYKLFYDNSKFLLYFQYN

SEQ ID NO: 6883 - protein, 40 aa, Staphylococcus epidermidis
SIKLNNRRIEDRTNNGVKNMDELIEILADLVIEEINQTND

SEQ ID NO: 6884 - protein, 372 aa, Staphylococcus epidermidis
TMKLNTLQLENYRNYEQVTLDCHPEVNILIGENAQGKTNLLESIYTLALAKSHRTSNDKELIRFKSDYAKIEGELSYRHGTMPLTMFITKKGKQVKVNHLEQSRLTQYIGHLNVVLFAPEDLNIVKGSPQIRRRFIDMELGQISAVYLNDLAQYQRILKQKNNYLKQLQIGQKTDTTMLEVLNQQFAEYALKVTLRREHFIKELETLAQPIHAGITNDRETLTLDYVPSLKLSNYEANQSELIEEVLALLNDNLQREKERGVCLYGPHRDDLSFNVNGMDAQTYGSQGQQRTTALSIKLAEIELMNIEVGEYPILLLDDVLSELDDSRQTHLLSTIQHKVQTFVTTTSVEGIDHEIMNNAKLYRISQGEILK

SEQ ID NO: 6885 - protein, 129 aa, Staphylococcus epidermidis
IQLCNRTVLWNRDVGNIYTGSLYLSLISLLQNHTFQPEEKVCLFSYGSGAVGEIFSGSIVKGYDKALDKEKHLNMLESREQLSVEEYETFFNRFDNQEFDFERELTQDPYSKVYLYSIEDHIRTYKIEK

SEQ ID NO: 6886 - protein, 144 aa, Staphylococcus epidermidis
RGELMHWKENRIKSAKNDTNPMVIKELKGSYVVFGDVQFLPGYCVLLPKREVRLLNDLTLEERQDYLLDMSFVGDAMMKALKPTRVNYEILGNKNHFLHAHLFQRYEWEDESVRYMPVWCMMLLIGLMKKRLTILINMMKLEIR

SEQ ID NO: 6887 - protein, 51 aa, Staphylococcus epidermidis
LDCCALRDAFIALERLILVLEEVEPLDAEAALLLELELAKLELLVPPDVVA

SEQ ID NO: 6888 - protein, 758 aa, Staphylococcus epidermidis
INHCQQGGNIMTTIKTSNLGFPRLGRKREWKKAIENYWAHKIDKAELDQTLTDLHKENLLLQKNYHLDSIPVGDFSLYDHILETSLLFNIIPERFQGREVNDDLLFDIARGNKEHVASALIKWFNTNYHYIVPEWDNVEPKVEKNTLLERFKYAQSINVNAHPVIVGPITFVKLSKGGHQSFEEKVETLLPLYKEVLQSLVDAGAKYIQIDEPILVTDDSESYEDITRKAYDYFANEGLGKYLVIQTYFERVHLKFLSSLPVGGLGLDLVHDNGYNLKQIEDGDFDQSKALYAGIIDGRNVWAADIEAKKQLIETLQQHTQQLVIQPSSSLLHVPVSLDDETLDESIAEGLSFATEKLDELDALRRLFNDNDLSKYEHYKARYERFQSQSFKNLEYDFESVPTHRKSPFAKRKQLQNQRLNLPDLPTTTIGSFPQTREVRKFRADWKNNRITDAEYQEFLQNEIARWIKIQEDIGLDVLVHGEFERNDMVEFFGEKLQGFLVTKFGWVQSYGSRAVKPPVIYGDVKWTAPLTVKETVYAQSLTDKPVKGMLTGPVTILNWSFERVDVPRKVVQDQIALAIDEEVLALEEAGIKVIQVDEPALREGLPLRSEYHEQYLEDAVHSFKLATSSVHDETQIHTHMCYSQFGQIIHAIHDLDADVISIETSRSHGDLIQDFEDINYDLGIGLGVYDIHSPRIPTEEEITTAINRSLQQIDRSLFWVNPDCGLKTRKEDEVKDALTVLVNAVKKKRQESESTTA

SEQ ID NO: 6889 - protein, 42 aa, Staphylococcus epidermidis
NERLRRLTMSKIMNLITYDKLLKNITAIHINLICSDTFKIPL

SEQ ID NO: 6890 - protein, 127 aa, Staphylococcus epidermidis
SSLCLNCAAILFWLILKSSGEVISKVVLVLDCVIAAKQRILTVKAEMIAITVRDIAFFFILCMIDDVKTTSVIFTRPCLICFSVLKISDTELLKNKKAPTIVKKSMLKGVIKAVVKALKTPNISVDI

SEQ ID NO: 6891 - protein, 51 aa, Staphylococcus epidermidis
NILCLIFFNMYLFIFYRNLLYLVAERIFSKLELCFTISIQYKEYFAIIYLK

SEQ ID NO: 6892 - protein, 243 aa, Staphylococcus epidermidis
TGLWRGLAPCFKDRSGIMSFSFLFILTAGMVAAFNPCGIALLPSYISYLIGGETKDHSFRYAIFKGLGLGGAMTTGFLTIFVLAGLLIGGLGSALTGIFPILSLVMGILIALLGLGMLFGKHLPIKIGSFQVKPGKWSIYFYGIAYAVTSLGCTLPAFMLVVSASLNDNSVTAVIIKFIIYSLGMGIVVTAITMVSLISRQLVQKFLHNYMGSIQKIAAVVIFLSGLYMAYYWYFGSGGICTF

SEQ ID NO: 6893 - protein, 707 aa, Staphylococcus epidermidis
GGICYIISSFTITFSLGGVNLNNNSEEHNHQNHMNHSNHMHHDNHESHNHHSGHAHHHGNFKVKFFVSLIFGIPIILLSPLMGVNLPFQFTFPGSEWVVLILSTILFFYGGKPFLSGGKDEIAEKKPGMMTLVALGISVAYIYSLYAFYMNNFSNATGHTMDFFWELATLILIMLLGHWIEMNAVGNAGDALKKMAELLPNSAIKVMDNGQREEVKISDIMTDDIVEVKAGESIPTDGIIVQGQTSIDESLVTGESKKVQKNQNDNVIGGSINGSGTIQVKVTAVGEDGYLSQVMGLVNQAQNDKSSAELLSDKVAGYLFYFAVIVGVISFIVWMLIQNDVDFALERLVTVLVIACPHALGLAIPLVTARSTSIGAHNGLIIKNRESVEIAQHIDYVMMDKTGTLTEGNFSVNHYESFKNDLSNDTILSLFASLESQSNHPLAISIVDFAKSKNISFTNPQDVNNIPGVGLEGLVDNKTYKITNVSYLDKHKLNYDDDLFTKLAQQGNSISYLIEDQQVIGMIAQGDQIKESSKQMVADLLSRNITPVMLTGDNNEVAHAVAKELGISDVHAQLMPEDKESIIKDYQSDGNKVMMVGDGINDAPSLIRADIGIAIGAGTDVAVDSGDIILVKSNPSDIIHFLTLSNNTMRKMVQNLWWGAGYNIVAVPLAAGALAFIGLILSPAVGAILMSLSTVIVAINAFTLKLK

SEQ ID NO: 6894 - protein, 47 aa, Staphylococcus epidermidis
ITVCIAHVLSTIFARNYVYKWITSNKRHNSFFFTLGNNLYGLHELCI

SEQ ID NO: 6895 - protein, 43 aa, Staphylococcus epidermidis
FNLRRKNYSDTLVDDKTWIDLDMDTLLHKINFNYTVIGEMNSL

SEQ ID NO: 6896 - protein, 169 aa, Staphylococcus epidermidis
MLNRVVLVGRLTKDPEYRTTPSGVSVATFTLAVNRTFTNAQGEREADFINCVVFRRQAENVNNYLSKGSLAGVDGRIQSRSYENQEGRRIFVTEVVCDSVQFLEPKNAQHGGQRSQNNNFQDYGQGFGGQQSGQNTSYNNNNSSNSNQSDNPFANANGPIDISDDDLPF

SEQ ID NO: 6897 - protein, 50 aa, Staphylococcus epidermidis
LYGRLNVIFTIIPYISDLLDSLTTNIIIDILVFHTHLFNPKLISSLCLCK

SEQ ID NO: 6898 - protein, 40 aa, Staphylococcus epidermidis
ICMLILIFKLFKYIPYHVLDSIFYIIFVILCINLFIYKAL

SEQ ID NO: 6899 - protein, 60 aa, Staphylococcus epidermidis
NIIRLSNITALSLSDAIQVFFAMVKMLLGTFNMIINVDICYLDILLHRIFYRYTIKDNAL

SEQ ID NO: 6900 - protein, 117 aa, Staphylococcus epidermidis
MKKRISFTAIMTVLLIGLTACGAESDTANESKVQDIQGNPVSLPNEKPTLIYFMATWCPSCIYNEEIFKEIHQLNPNDVQLITVSLDPNTDTKESFAKFKQDYGGDWPHVLKIGVEL

SEQ ID NO: 6901 - protein, 69 aa, Staphylococcus epidermidis
YNLRNRLKELRARDGYNQTELAKKAGISRQTVSLIERNDFTPSILTAIKIARIFGEPVEDIFIMEEEDF

SEQ ID NO: 6902 - protein, 45 aa, Staphylococcus epidermidis
MYIFYLKQVFLVHFQNHLKISLHNMQIPFISLPVIFPIYSFHDYK

SEQ ID NO: 6903 - protein, 78 aa, Staphylococcus epidermidis
RKKLIIIGGHFMTSKYGINDIVEMKKPHACGTNRFKIIRMGADIRIKCEHCQRSVMIPRQVFNKKMKKVLESHQDKES

SEQ ID NO: 6904 - protein, 80 aa, Staphylococcus epidermidis
SLLRKKVMHLMMIDHNGIFLCKFGNIMWNVFTAIKVCNTHLNTMKVRDKLLNNRFEYPNIMTIRKEGLLLPSFLEKYKLY

SEQ ID NO: 6905 - protein, 662 aa, Staphylococcus epidermidis
KVIRGGRMNRQSTKKALLIPFILMVLTAIALVVVWFIFNQLVAGIATAILIVMIIISGVLLRKAFLKMDNYVDDLSGHISASSNKAIKHLPIGMIVLDEDNHIEWMNQFMTDHIETNVISENVNEVFPNILKQLEKVQEVEIENNNYYYHVRYSENEHCLYFFDMTETERTNELYEDSKPIIATIFLDNYDEITQNMNDTQRSEINSMVTRVISRWAQDYNIYFKRYNSDQFVAYFNQKILAELEDSNFEILSQLREKSVGYRAQLTLSIGVGEGTENLIDLGELSQSGLDLALGRGGDQVAIKNMNGNVRFYGGKTDPMEKRTRVRARVISHALKDILTEGDKVIVMGHKRPDLDAIGAAIGVSRFASMNNLEAFIVLNDSDIDPTLRRVMDEIDKKPELKERFVTSDEAWDMMTSKTTVVVVDTHKPEMVLDENVLNKANRKVVIDHHRRGESFISNPLLVYMEPYASSTAELVTELLEYQPTEQRLTRLESTVMYAGIIVDTRNFTLRTGSRTFDAASYLRAHGADTILTQHFLKDDVDTYINRSELIRTVKIQDQGVAIAHGSDDKIYHPVTVAQAADELLSLEGIEASYVVAKREDNLIGISARSLGSINVQLTMEALGGGGHLTNAATQIKGATIDEAIEQLQQAITEQMSRSEDA

SEQ ID NO: 6906 - protein, 229 aa, Staphylococcus epidermidis
ERVSMASYLFFHPKPACDTYGDMNIYHDKFGNNEDPYVWSERFLHSFCKITDYAYSKSTQKDIIFWISINKEGNNLKYLCDLVFKIEKWDFWYKTFSEQKDAIATNKELTINDAVVEGDEEAYEYHYSWINRGEHKWEPTYRRRRLTLKADPVLSFQPQNRQGNLLDVTELLKTIVNFNVEKSPAKSGTSYKAFELEEEQASKLYEEIKRLSFIRLKGRDLKNLRRNFS

SEQ ID NO: 6907 - protein, 180 aa, Staphylococcus epidermidis
NGVSNVKKIFASLGVILLVAILGVAVVFAYGSYKDLELKKEEAKLKDKKNKKIDKNKTTENENQDQINNQTITAPNEKAQYGNNLGVQEKSTDKNDPNGVLRFDTNGDGLISTSEVTPEAQKLVDEGKLQPSSDRMVEEWTKNKNNVDNTYDYDESYKKQQEMYKKAARGEVPEPGETIK

SEQ ID NO: 6908 - protein, 234 aa, Staphylococcus epidermidis
YMARKVVVVDDEKPIADILEFNLKKEGYDVYCAYDGNDAVDLIYEEEPDIVLLDIMLPGRDGMEVCREVRKKYEMPIIMLTAKDSEIDKVLGLELGADDYVTKPFSTRELIARVKANLRRHYSQPAQEVSGATNEITIKDIVIYPDAYSIKKRGEDIELTHREFELFHYLSKHMGQVMTREHLLQTVWGYDYFGDVRTVDVTIRRLREKIEDDPSHPEYIVTRRGVGYFLQQHD

SEQ ID NO: 6909 - protein, 41 aa, Staphylococcus epidermidis
VYASVVYDASNWSNEETSYDSDKHDEIRNKIKNELEQLYNI

SEQ ID NO: 6910 - protein, 49 aa, Staphylococcus epidermidis
MLNSLLAFFKETIYNVIMNFYINKEARLLWILIRLQVFQHRWVKVLLEL

SEQ ID NO: 6911 - protein, 112 aa, Staphylococcus epidermidis
KKSRREGNSMKINRYITRGINESIPLDLQILLWHMVEKKDNQPHTDYLHIFKLQEDENILSITHEQEQPTYKLEYHYTNYEKNQNALPKKVYVIREDDVDAFYYVMLLPEEY

SEQ ID NO: 6912 - protein, 47 aa, Staphylococcus epidermidis
LVLSGTVRLPRLYRHEYFFYGFLFFYNNGLTIFSEVKVIMKLKLIIA

SEQ ID NO: 6913 - protein, 675 aa, Staphylococcus epidermidis
SYIRSILMKKIKIVPLILIVVVVGFGIYFYASKDKEINNTIDAIEDKNFKQVYKDSSYISKSDNGEVEMTERPIKIYNSLGVKDINIQDRKIKKVSKNKKRVDAQYKIKTNYGNIDRNVQFNFVKEDGMWKLDWDHSVIIPGMQKDQSIHIENLKSERGKILDRNNVELANTGTAYEIGIVPKNVSKKDYKAIAKELSISEDYIKQQMDQNWVQDDTFVPLKTVKKMDEYLSDFAKKFHLTTNETESRNYPLGKATSHLLGYVGPINSEELKQKEYKGYKDDAVIGKKGLEKLYDKKLQHEDGYRVTIVDDNSNTIAHTLIEKKKKDGKDIQLTIDAKVQKSIYNNMKNDYGSGTAIHPQTGELLALVSTPSYDVYPFMYGMSNEEYNKLTEDKKEPLLNKFQITTSPGSTQKILTAMIGLNNKTLDDKTSYKIDGKGWQKDKSWGGYNVTRYEVVNGNIDLKQAIESSDNIFFARVALELGSKKFEKGMKKLGVGEDIPSDYPFYNAQISNKNLDNEILLADSGYGQGEILINPVQILSIYSALENNGNINAPHLLKDTKNKVWKKNIISKENINLLTDGMQQVVNKTHKEDIYRSYANLIGKSGTAELKMKQGETGRQIGWFISYDKDNPNMMMAINVKDVQDKGMASYNAKISGKVYDELYENGNKKYDIDE

SEQ ID NO: 6914 - protein, 494 aa, Staphylococcus epidermidis
NWRLFLMWENKFAKESLTFDDVLLIPAASDVLPSDVDLSVKLSDKIKLNIPVISAGMDTVTESKMAIAMARQGGLGVIHKNMGVEEQADEVQKVKRSENGVISNPFFLTPEESVYEAEALMGKYRISGVPIVDNQEDRKLIGILTNRDLRFIEDFSIKISDVMTKDNLITAPVGTTLDEAEAILQKHKIEKLPLVENGRLEGLITIKDIEKVLEFPYAAKDEHGRLLAAAAIGTSKDTEIRAQKLVEAGVDALIIDTAHGHSKGVINQVKHIKETYPEITVVAGNVATAEATRALFEAGADVVKVGIGPGSICTTRVVAGVGVPQITAVYDCATEARKHGKAIIADGGIKFSGDIIKALAAGGHAVMLGSLLAGTEESPGATEVFQGRQYKVYRGMGSLGAMEKGSNDRYFQEDKTPRKFVPEGIEGRTAYKGPLQDTIYQLMGGVRAGMGYTGSENLKKLREEAQFTRMGPAGLAESHPHNVQITKESPNYSF

SEQ ID NO: 6915 - protein, 65 aa, Staphylococcus epidermidis
LQISVTIPSFLLWEIIYMDCMNYVYDNLLLKLVKKKIAYIKSQQVIFNRYIRKFILLYKRYFVIL

SEQ ID NO: 6916 - protein, 45 aa, Staphylococcus epidermidis
YTQREHLFLFYLFYLIKIISKRTIISINIDLIYLIQILKESDYHD

SEQ ID NO: 6917 - protein, 49 aa, Staphylococcus epidermidis
LIKRLVHRFTAIEDEEILDKIYKNFMNDDTITTIFNNNLQAIINHYLSI

SEQ ID NO: 6918 - protein, 48 aa, Staphylococcus epidermidis
HEKSTHTIFIGLDALITIINVTQTIRHHQHLSLSYVRIDKHTCFNCVN

SEQ ID NO: 6919 - protein, 236 aa, Staphylococcus epidermidis
WRKSRGVIMIELRKINRHFKNGNESNHILKDIDIHIDEGEFIAIMGPSGSGKSTLINILGFIDRGYEGEYFFNNENYQKSSDNKLAEIRNHTVGFVFQNFKLIQNNTILENVSIPLIYNGLSNKARKSKVLDGLHDVGLKGKENLLPNKLSGGQQQRVAIARAIINDPKFIIADEPTGALDSKTSQDIMELFVKLNKEQNTTIIMVTHDREVAEKADRIIHILDGRVQEEEVLTRE

SEQ ID NO: 6920 - protein, 133 aa, Staphylococcus epidermidis
MEKRSINMKKVFMIISILTITVTLSACGGSGKQKEPSKESQKSDKYDYVYYEILNDGDSETPNVEIKYKDKKGKSHIEKADLDHVYEHILGDGNKKPYIVKDGKKIHVYRPPYMIYGDDDVEGKAVSKDEVTK

SEQ ID NO: 6921 - protein, 385 aa, Staphylococcus epidermidis
TTGRSLNLMMEFTIKRDYFINQLNDTLKAISPRTTLPILTGIKIDAKENEVILTGSDSEISIEITIPKQVDGEEIVEITETGSVVLPGRFFVDIIKKLPGKEVKLSTNEQFQTLITSGHSEFNLSGLDPDQYPLLPEVSRDDAIQLSVKVLKNIIAQTNFAVSTSETRPVLTGVNWLIQDNELICTATDSHRLAVRKLQLEDESENKNVIIPGKALSELNKIMSDSDEDIDIFFASNQVLFRVGNINFISRLLEGHYPDTTRLFPENYEIKLGINNGDFYHAIDRASLLAREGGNNVIKLSTGNELVELSSTSPEIGTVKEEVNANDVEGGNLKISFNSKYMMDALKAIDNDEVEVEFFGTMKPFILKPKDDDSVTQLILPIRTY

SEQ ID NO: 6922 - protein, 90 aa, Staphylococcus epidermidis
NKMSQRRQLTMAGGPRRGGRRRKKVCYFTANGITHIDYKDTELLKRFISERGKILPRRVTGTSAKYQRMLTTAIKRARHMALLPYVKEEQ

SEQ ID NO: 6923 - protein, 132 aa, Staphylococcus epidermidis
KEMRKIIMKIRLTFIILAILSTIGLVLVLAKYPTGPHTINYNEPYTVLIAITTIVIMALPALILGIFNHLACRIISAILQISALMMWGFLVIISLIMGQIVIMLMASLTILALLVSSIVTLSVHPSTSDKIN

SEQ ID NO: 6924 - protein, 126 aa, Staphylococcus epidermidis
IWMRRVIVFGISISSAILHFVIGGFAVALASIMADKVGGKLGGIIATMPAVYLAAIIALAIDHKGQQLIQMSIHLSTGAIVGIVSCIVTVFFTSIFIGKKNYRSGTVFAILCWFVISVAIFLVRHI

SEQ ID NO: 6925 - protein, 268 aa, Staphylococcus epidermidis
ERMSRLIRMSVLASGSTGNATYVESEKGSLLVDVGLTGKKMEELFSQIDRNIKDLNGILVTHEHIDHIKGLGVLARKYKLPIYANENTWKAIEKKDSRIPMDQKFIFNPYETKSLAGFDIESFNVSHDAIDPQFYIFHNNYKKFTMITDTGYVSDRMKGMIQGSDVFMFESNHDVDMLRMCRYPWKTKQRILSDMGHVSNEDAGLAMSDVITGNTKRIYLSHLSQDNNMKDLARMSVGQVLNEHDIDTEKEVLLCDTDKAQATPIYTL

SEQ ID NO: 6926 - protein, 256 aa, Staphylococcus epidermidis
RSERMAILTANQLSKVYGHKQKYRALNNISFSVEKGEFVAVMGPSGSGKTTLLNVLSSIDTISGGTVEVEGKEINKLSHKEVANFRKQHLGFIFQDYSVLPTLTVKENIMLPLSVQKFHKYEMEQNYKEVAEALGIYNLGNKYPSEISGGQQQRTAAARAFVHKPTIIFADEPTGALDSKSAQDLLHRLEDMNKQFNSTIMMVTHDPSAASYAERVIMLKDGDIHSEIYQGNDSKQTFYQEIMKLQTALGGVSHDI

SEQ ID NO: 6927 - protein, 277 aa, Staphylococcus epidermidis
IIRRCFFSMKRASYSVETKYKAVEMKAAGFPTKEIMKELNIRNRTQVKNWWRWYRNGESYRFSQHVGKQYTYGYRKITALINQCYTSPINHKRVQRVMQKHHLNCRVRPKKTTRIGKPYYKTDNLLQRQFKASCPMEVLTTDITYLPFGHSMLYLSSIMDIYNGEIVAYKIDDKQDQRLVNDTLNQIDIPEGCILHSDQGSVYTSYAYYQLCEEKGIIRSMSRKGTPADNAPIESFHSSLKSETFYINNQLNNSNHIVIDIVENTLKTIIIIEFNKN

SEQ ID NO: 6928 - protein, 196 aa, Staphylococcus epidermidis
LFRRNLSMSLINKEILPFTAQAYDPKKDEFKEVTQEDFKGSWNVVCFYPADFSFVCPTELEDLQNQYAKLQELGVNVYSVSTDTHFVHKAWHDHSDAISKLEYSMIGDPSQTITRNFDVLDEESGLAQRGTFIIDPDGVVQAAEINADGIGRDASTLVNKIKAAQYVRQHPGEVCPAKWEEGSESLQPGLDLVGKI

SEQ ID NO: 6929 - protein, 286 aa, Staphylococcus epidermidis
LRGREWIMKKPFSKLFGLKNKDDIIGYTEEERNNNVESIHIERIVPNRYQPRQVFEPNKIKELAESIEEHGLLQPIVVRPIEEDMFEIIAGERRFRALQSLHKPQVDVIVRDMDDEETAVVALIENIQRENLSVVEEAEAYKKLLEIGGTTQNELAKSLGKSQSFIANKLRLLKLAPNVIKRLREGKITERHARAVLVLPDKTQEELIEQVISQKLNVKQTEDRVRQKTGPEKVKAQTFQFSQDVTQAKEELGKSIETIEKSGIRVEQKDKEHEDYYEIKIKIYKK

SEQ ID NO: 6930 - protein, 172 aa, Staphylococcus epidermidis
ENFGSGIMKLRALEYSDLLFVHELNNEYSIMSYWFEEPYESLTELQHLFDKHLLDESERRFIVEDENQVVGIVELVEINYIHRNCEIQIIIKPEFSGKGYAKFAFEKAIIYAFNILNMHKIYLYVDADNKKAIHIYESQGFKTEGLLKEQFYTKGKYKDAYFMSLLKSEYIL

SEQ ID NO: 6931 - protein, 328 aa, Staphylococcus epidermidis
RRYGTIMTNYTVNTLELGEFITESGETIDHLRLRYEHVGLPGQPLVVVCHALTGNHLTYGTDAQPGWWREIIDGGYIPVHDYQFLTFNVIGSPFGSSSKLNDDNFPEHLTLRDIVRAIELGIQALEFKKINILIGGSLGGMQAMELLYNRQFEVEKAIILAATDKTSSYSRAFNEIARQAIHIGGKEGLSIARQLGFLTYRSSKSYDQRFTPDEVVSYQQHQGDKFKEYFDLNCYLTLLDVLDSHHLDRGRDDVDEVFQSLETKVLTMGFIDDLLYPDDQVRALGERFKYHRHFFVPDNVGHDGFLLNFNDWAPNLYHFLNLKQFRRK

SEQ ID NO: 6932 - protein, 552 aa, Staphylococcus epidermidis
QIHGGQYGNKTNQHRFTVNDIVETIPDNEFDEFRHHRGATSYHPKMMLKVILYAYTQSVFSGRKIEKMLNDSIRMMWLSQNQKPSYKTINQFRVNPKVDALLESLFIQFYSQCVKQNLIDDKAIFIDGTKIEANANRYTFVWKKSIQNHESKMNEDSKALYHELVTNKIIPEIKEDHDNELTKEEIDLIGSHLDKEIEDLNQHINNEKCTKTRKQIRLKRTKIKKYKKQINDYFERKYRYEFQKSILKDRNSYSKTDYDATFMRMKEDHMKNGQLKPGYNLQIATNSQFVLSYNVYQNPTDTRTMIPFLNSIQETYGHLPEYIVADAGYGSESNYKAIIDDFNRTPLITYGMFIKDKTKKYKSDIFNTQNWNYDEINDEFICPNNKRLGFKRYAYRHDKYGYKRDFKLYECDDCSECPLKNQCMNFNSKTNKKIMKNYNWEYFKSQINKKLSEPETKNIYSQRKIDVEPVFGFMKAILGFTRMSVRGLNKVKRELGFVLMALNIRKVVAQRAENNQKIYKKDNFYIISIEIVFFHLSKNFMSRTHYDLFFYC

SEQ ID NO: 6933 - protein, 78 aa, Staphylococcus epidermidis
TFNGNAPALEREVNAKISTSIVFFTYLTGLIPKTLSIIKWIIYIVIRAAYEAIKNLPNVQIAEKSLVARVEAIIAKMP

SEQ ID NO: 6934 - protein, 467 aa, Staphylococcus epidermidis
IMDGMYEQNQMPHSNEAEQSVLGAIIIDPELINTTQEVLLPESFYRGAHQHIFRAMMHLNEDNKEIDVVTLMDQLSSEGSLNEAGGPQYLAELSTSVPTTRNVQYYTDIVFKHALKRKLIQTADSIANDGYNDELELDTILSDAERRILELSSTRESDGFKDIRDVLGQVYETAEELDQNSGQTPGIPTGYRDLDQMTAGFNRNDLIILAARPSVGKTAFALNIAQKVATHEDMYTVGIFSLEMGADQLATRMICSSGNVDSNRLRTGTMTEEDWSRFTIAVGKLSRTKIFIDDTPGIRINDLRSKCRRLKQEHGLDMIVIDYLQLIQGSGSRFSDNRQQEVSEISRTLKAIARELECPVIALSQLSRGVEQRQDKRPMMSDIRESGSIEQDADIVAFLYRDDYYNRGEGDEDDDDAGFEPQTNDDNGEIEIIIAKQRNGPTGTVKLHFMKQYNKFTDIDYAHADMS

SEQ ID NO: 6935 - protein, 43 aa, Staphylococcus epidermidis
YKFGINFVYKITEELKPQLYFPLIFNHDNHSLSIFELSISNQY

SEQ ID NO: 6936 - protein, 229 aa, Staphylococcus epidermidis
IILGRGYNMEFKVIESAKDPLFNEALKLYDDKLDIGLDEDSKIFKRSLENNKTENDYAFIVGIENQTVVSLATAHYEATTNSAFLIYLIAKESPNHDERMSLTLEAIEKQLNLLSQEVHNRDINFIMLEVPKEPSTANIDDKLRNALEHRRQFLFENQFEKQDDIDYIHPNQNQKETPQKVDLFIKANIELTKDIYGTSVKSNYILKYVFANGISREIIYPLLKEMNLR

SEQ ID NO: 6937 - protein, 258 aa, Staphylococcus epidermidis
ILIGVGIVSDYVYELMKQHHSVRKFKNQPLGSETVEKLVEAGQSASTSSYLQTYSIIGVEDPSIKARLKEVSGQPYVLDNGYLFVFVLDYYRHHLVDEVAASNMETSYGSAEGLLVGTIDVALVAQNMAVAAEDMGYGIVYLGSLRNDVARVREILNLPDYTFPLFGMAVGEPSDEENGSPKPRLPFKHIFHKDQYDANQHQQRKELEAYDQVVSEYYKERTNGVRTENWSQQIETFLGRKTRLDMLDELKKAGFIQR

SEQ ID NO: 6938 - protein, 41 aa, Staphylococcus epidermidis
SFVGTRLIFKTTMLNDTLQYLKLSFRALTGAFLLLLHKIKQ

SEQ ID NO: 6939 - protein, 58 aa, Staphylococcus epidermidis
IAVGKKYTLCVVILRLSLESRSLAYVIVENTKNKLLKTNKVVSIHLRCQFNIVTPRFI

SEQ ID NO: 6940 - protein, 549 aa, Staphylococcus epidermidis
MKKGCNIMQQLKTKRVGIYVRVSTEMQSTEGYSIDGQINQIKEYCDFHHFEVKDIYADRGISGKSMNRPELQRMLKDAKEGNIDCVMVYKTNRLARNTSDLLKIVEDLHKQNVEFFSLSERMEVNTSSGKLMLQILASFSEFERNNIVENVFMGQTRRAQEGYYQGNLPLGYDKIPDSKHELMINQHEANIVKYIFECYAKGHGYRKIANALNHKGYVTKKGKPFSISSITYILANPFYIGKIQFAKYKDWSEKRRKGLNDKPVIAEGKHSPIINQDLWDKVQMRKKQVSQKPQVHGKGTNLLTGIIHCPQCGAPMAASNTTNTLKDGTKKRIRYYSCSNFRNKGSKVCSANSVRADVIEDYVMKQILEIVKSDKVIQRVVTHVNQENQVDGAALHHDIAYKQQQYDEVQIKINNLIKTIEDNPDLTSVIRPSIQKYEKQLNDITNQINQLKNQQNEDKTLFDAKEISKLLQHIFHDIKHIEKSRLKALYLSVIDRIDIKKDGNHKKQFYVTLKLNNEIIKQLFNNKQLDEVHLSTSSLFLPQTLYLTI

SEQ ID NO: 6941 - protein, 78 aa, Staphylococcus epidermidis
LVEGHTKPSDCLKVRDDMLGKCHKLFTERKEFTGDTPVIVNIGEWDEGDEEDKQRALDKIKENYPNRTMIVDDIPLED

SEQ ID NO: 6942 - protein, 553 aa, Staphylococcus epidermidis
IERGIQMTQNSYKIPIQGMTCTGCEEHVTEALEQAGAKDVSADFRRGEAIFELSDDQIEKAKQNISAAGYQPGEEESQPSENSVDFNRDGDYDLLIIGSGGAAFSAAIKANENGAKVAMVERGTVGGTCVNIGCVPSKTMLRAGEINGLAQNNPFTGLQTSTGAADLAQLTEQKDGLVSQMRQEKYIDLIEEYGFDLIRGEASFIDDKTIQVNGQNITSKSFLIATGASPAVPEIPGMNEVDYLTSTSALELKEVPQRLAVIGSGYIAAELGQMFHNLGTEVTLMQRSERLFKTYDPEISEAIDESLTEQGLNLITGVTYQKVEQNGKSTSIYIEVNGQEQVIEADQVLVATGRKPNTETLNLESAGVKTGKKGEVLTNEYLQTSNNRIYAAGDVTLGPQFVYVAAYEGGIVANNALGLAKRKIDLRFVPGVTFTNPSIATVGLTEQQAKEKGYDVKTSVLPLDAVPRALVNHETTGVYKLVVNAQTQKLIGAHIVSENAGDVIYAATLAVQFGLTIEDLTDSFAPYLTMAEGLKLAALTFDKDVSKLSCCAG

SEQ ID NO: 6943 - protein, 204 aa, Staphylococcus epidermidis
IVGGIINVFNTTYKEIYSMFPNKPYPVHDIYEDCRTILADLQIEMFNRINKQLYKTCHYNKPRKHHEMIKKLLIEFIIDNKDSKIVSAEPFELNLEAFYAIKQNCNISNNNKPLDEYIITYFEDLLSNISNTLTNNNRANGNNPIINYIYVTQRKDGMVCVVGKSHFKYEFKGNEYKLVKNQEGDLLRRWMKIKVPEKYYLHCI

SEQ ID NO: 6944 - protein, 296 aa, Staphylococcus epidermidis
LKGGDILDRAFRILTIYNRLLQNKSVNKQSLTLELDTSPRTIQRDIDDIRNFLYESKSWISAPKEITYDYKSESYKLEQNKSENMYFMYDILTALYLTTPKLSHYFYQYLKLLIVKHHSNYRTTLLKYLERFEIDKNQTGISTSSLVVQAMNENQYLQYNQNLLLPLSMYYQMHAFHLVYRMNDEIHIDDINQMNLSLSEKSVDTHEKSKVQTYITFEISKDVWSKMHRYYQIHVIEKYDAHYLIVTFKMTRIEAIQLCFMYRSNIRIISPPDLKEQVIDELLLLQTTYLKQQVQK

SEQ ID NO: 6945 - protein, 631 aa, Staphylococcus epidermidis
LLGGKRVVQEYDVVVIGAGHAGIEAGLASARRGAKTLMLTINLDNIAFMPCNPSVGGPAKGIVVREIDALGGQMAKTIDKTHIQMRMLNTGKGPAVRALRAQADKVLYQQEMKRVLENEDNLDIMQGMVDELIIEDNEVKGVRTNIGTEYRSKAVIITTGTFLRGEIILGNLKYSSGPNHQLPSVTLADNLRKLGFDIVRFKTGTPPRVNARTIDYSKTEIQPGDDIGRAFSFETTEFILNQLPCWLTYTNGDTHQVIDDNLHLSAMYSGMIKGTGPRYCPSIEDKFVRFNDKPRHQLFLEPEGRNTNEVYVQGLSTSLPEHVQRQMLETIPGLEKADMMRAGYAIEYDAIVPTQLWPTLETKAIKNLYTAGQINGTSGYEEAAGQGIMAGINAAGNVLGTGEKILSRSDAYIGVLIDDLVTKGTNEPYRLLTSRAEYRLLLRHDNADLRLTDMGYELGLISEERYARFNEKRQQIKDEIQRLTDVRIKPNEHTQAIIEAKGGSRLKDGILAIDLLRRPEMNYETILEILEESHQLPEAVEEQVEIQTKYEGYINKSLQQVEKVKRMEAKKIPEDLDYSKVDSLASEAREKLAEVKPLNIAQASRISGVNPADISILLVYLEQGKLQRVKQ

SEQ ID NO: 6946 - protein, 279 aa, Staphylococcus epidermidis
HVMGGYVVMKTLDSVNIPIRKDETHKGDYGKILLIGGSANMGGAIMLAARACVYSGSGLITVATHPNNHAALHSRCPEAMVIDINDTKMLTKMIEATDSILIGPGLGVDFKGNNAITFLLQNIQPHQNLIVDGDAITIFSKLKPQIPTCRVIFTPHQKEWERLSGIPIEEQTYERNLEAVERIGATVVLKQHGTEIYFCNDDVYKLPIGTPAMATGGMGDTLAGMITSFVGQFDNFKEAVTSATYMHSFIGEKLSDTMYVVPPSRLISEIPYVMKQLEG

SEQ ID NO: 6947 - protein, 246 aa, Staphylococcus epidermidis
TSKGETIMSIEWLSEKLSEQGIELSNTQKEQFQKYYKLLVEWNKKMNLTSITDEHDVYLKHFYDSIAPSFYYDFNGQLSLCDIGAGAGFPSIPLKIVYPELKVTIVDSLNKRIQFLNHLAAELGLEDVSFVHDRAEIYGKGVYRESYDIVTARAVARLTVLSELCLPLVKKGGQFLALKSSKGEEELQEATFAINILGGNVKETHTFELPENAGERQMIIIDKRRQTSKKYPRKPGTPNKSPLVES

SEQ ID NO: 6948 - protein, 112 aa, Staphylococcus epidermidis
IIRGVFFSMKRVSYSVETKYKAVEMKAAGFSTKEIMKELNIRNRTQVKTWWRWYRNGESYRFSQHVGKQYTYGKGLEELLEVEQLKLENKRKDIELDILKKYKALERKWYQQ

SEQ ID NO: 6949 - protein, 53 aa, Staphylococcus epidermidis
SVILLLLHIYNNMYHTWISLFSICIKQIELIPQVVMTFCENNPIKLTLFINRK

SEQ ID NO: 6950 - protein, 40 aa, Staphylococcus epidermidis
VIFIQLFKIYFIIKNNKGGNKNEKRKTFKSYLNCYTTESV

SEQ ID NO: 6951 - protein, 189 aa, Staphylococcus epidermidis
NSFIGHTMLLGKCLGGMAMDSHLNHILSYWQGPPLEGAKTIISKYGYPQEATMRRLIWYNSGPWKRTIVYKDPVPHNFPTPHLDFLKQTIDYKVPVHLYDAIAAFDGSVYLDRTTGEASAKCHEEAMNFLSLNLLNDIVTGKRDVQGAKAFYAQTAEQFTKYHITSPYTEGFLFPMQYNTADLGVTYFK

SEQ ID NO: 6952 - protein, 57 aa, Staphylococcus epidermidis
ELIMNIYQTYACLVIGIIVNSTTTILKRKKLISNIKQLWKSKKTLEEFIRSNSRFDY

SEQ ID NO: 6953 - protein, 460 aa, Staphylococcus epidermidis
IYIITVKGGADMKQVIGYLRQSTMKQQSLAAQKQAIEAIAEKHHIQHINFYSDKQSGRKDNRSGYRQITQLIQQGQCDILCCYRLNRLHRNLKNALKLIKLCQTYHVHILSVHDGYFDMDQAFDRLKLNIFISLAELESDNIGEQVRNGLQEKAKQGRLITTHAPFGYEYHNGTFIINQNESPTVKAVFNYYIKGHGYKKIAQLLEEDNTYINRQPYQVRNIIINPNYCGRVNNQYGQFDNMFPSIVSTSIYEQAQRLRLQKQTKQTPSDNQLKQKIKCPCCNATLTNMTIRKKNHTLRYYVCPKNMNASRFVCDFKGINAQTLEDKVLEVCRDFYQNQRIYTKIKSAIDKRIKRQRNIEKHHTLTQEQLIEKLAQGIIDAETFREQTQSLRQQPQRTTSINGHQIQHIIQNIIQKRFTLNILYPYIETIHITKDKNLIGIYFKNEPLNIVNQTMQSSIA

SEQ ID NO: 6954 - protein, 42 aa, Staphylococcus epidermidis
LYVMKAWDIDNLCPRLHSQSYIIYNNIATVVYRHQSYLLIEN

SEQ ID NO: 6955 - protein, 57 aa, Staphylococcus epidermidis
NYTIDSTLQQNLYFAIIIKLIAFVLVFPGLLTLWLAVLSDTGAAILVILNSLRLLKK

SEQ ID NO: 6956 - protein, 504 aa, Staphylococcus epidermidis
MATIGFEEKLWQAADKLRGSMDAAEYKNVALGLIFLKYVSDSFEEKYEELKQDPYADEEDQDEYLAENIFWVPKEARWQYINDNAKKPEIGQIIDKAMIAIENENESLKGVLPKEYARPALDKEKLGDIIDLFTFKVGDTESRKQDVLGRVYEYFIAKFASAEGKNAGEFYTPSSIVKLLVEMIEPYKGRIYDPCCGSGGMFVQSERFVEKHQGRLDDIAIYGQESNPTTWKLAKMNLAIRGIDNDLGERNSDTFHNDLHKGLKADYILANPPFNASDWGQERLLDDYRWQFGIPPKGNANYAWIEHMISKLAPNGTAGFVLANGSMSTSGKDELEIRKNLIEQDLVECIVTLPGQLFYSTQIPVCLWFISNNKGQNGKKERKNEILFIDAREIGHMVSRTLKEFSDEDIQKVAQTYHAWRGTNDKPYEDIAGFCKVANLEEVKNNEYILTPGRYVGLADVEEEEEPFEQKMERITSELSEQFAKSKELEDQIRKSLEGLGYGV

SEQ ID NO: 6957 - protein, 430 aa, Staphylococcus epidermidis
IMTILAIIIFLLTLMFVIWQPKGLDIGITALIGAIIAIITGVVSLSDVIEVTGIVWNATLTFVAVILISLILDEIGFFEWAAIHMVRASNGHGFKMFVYIMLLGAIVAAFFANDGAALILTPIVLAMVRNLGFNQKVIFPFIIASGFIADTTSLPLIVSNLVNIVSADYFNIGFIEYVSRMIIPNIFSLIASIVVLWLYFRKVIPNNFEIKNLKTPNQAIKDPKLFKFSWIVLSILLIGYIVSEFIQIPVSLIACLIALIFTVLAYKSRVVNTKQVIKGAPWNIVLFSIGMYLVVFGLKNVGITALLANILSSISNYGLFSSVIGMGFISAFLSAIMNNMPTVLIDAIAIGQSATTGLIKEGMIYANIIGADLGPKITPIGSLATLLWLHVLTQKGVKISWGTYFKTGIVITIPVLFITLVGLYVTLIVF

SEQ ID NO: 6958 - protein, 63 aa, Staphylococcus epidermidis
KLNIPIHAYISIIKNTVITALLTYTKTIKYDDKPKQKRQAYCKSLTYFAELYFNGKIINNIIL

SEQ ID NO: 6959 - protein, 138 aa, Staphylococcus epidermidis
GDNMEMKISELAKACDVNKETVRYYERKGLIAGPPRNESGYRIYSEETADRVRFIKRMKELDFSLKEIHLLFGVVDQDGERCKDMYAFTVQKTKEIERKVQDLLRIQRLLEELKEKCPDEKAIYTCPIIETLMGGPDK

SEQ ID NO: 6960 - protein, 314 aa, Staphylococcus epidermidis
KEDINMSKIVVALGGNALGQSPKEQLDLLKSTSKSLVSLIDKGYEIVISHGNGPQVGSINLGLNYAAEHKQGPPFPFPECGAMSQAYIGYQMQESLQNELHSMGIDKQVVTLVTQVQVASDDSAFNNPTKPIGLFYTKEQADKFTKEKGYTFVEDSGRGYRRVVPSPQPISIVELDSIETLITHGTLVIAAGGGGIPVIKENEVYTGVDAVIDKDKTSALLAAHLQSDQLIILTAVDHVYINYGKENQRGLDEVSVDEMKKHISDGQFAKGSMLPKVEAALQFLEKNTKGSVLITSLAGLGDALDGKIGTLIKN

SEQ ID NO: 6961 - protein, 454 aa, Staphylococcus epidermidis
CSIFICKFKIILVKYLVVKREKLGGAHMSSIVVVGTQWGDEGKGKITDFLAEQADVIARFSGGNNAGHTIQFGGETYKLHLVPSGIFYKDKLAVIGNGVVVDPVALLKELDGLNERGISTDNLRISNRAQVILPYHLAQDEYEERRRGDNKIGTTKKGIGPAYVDKAQRIGIRMADLLEKETFERRLKENIEYKNAYFKGMFNETCPTFDEIFDEYYAAGQRLKDYVTDTAKILDDANVADEKVLFEGAQGVMLDIDHGTYPFVTSSNPVAGNVTVGTGVGPTSVSKVIGVCKSYTSRVGDGPFPTELFDEDGHHIREVGREYGTTTGRPRRVGWFDSVVLRHSRRVSGITDLSINSIDVLTGLDTVKICTAYELDGEKITEYPANLDQLRRCKPIFEELPGWTEDITGCRSLDELPENARNYLERISELCGVHISIFSVGPDREQTNLLEQLW

SEQ ID NO: 6962 - protein, 311 aa, Staphylococcus epidermidis
SKSMGVAYVFSKIQPKATILAIISLLVVALVTHVLPVLGLILCLFATIPGIVLWNRSIQSFGISALVTVVLTTLLGNTFVLSMMVLILLLSAIIGQLLKERTSKERILYISTASLSLVTLIGWMLLQTFDKIPTAAVLIKPFKNAMHEAFLTSGIDSNYRQILEESFRQMTVQLPSFLIIVIFIFVLINLIITFPILRKFKVATPIFKPLFAWQMSRNLLWFYLIVLICVMIASEPSTFQSIVLNFDVVLSLVMYIQGLSVIHFFGKAKRWPNFATILVMVVGTLLTPATHIVGLLGVIDLCINLKKIIKK

SEQ ID NO: 6963 - protein, 110 aa, Staphylococcus epidermidis
LGGIFMSYKELSAILKVLSDPSRLEILDLLSCGELCACDLLAYFQFSQPTLSHHMKILVDNELVSTRKDGTKRMYRLNHTFLDSINKELTYISSPTQQCMCKKIKTGECK

SEQ ID NO: 6964 - protein, 41 aa, Staphylococcus epidermidis
NKIFTNNLKNKLNHHRFKLIFIKLRYSLNYKFLIFSKYIHK

SEQ ID NO: 6965 - protein, 518 aa, Staphylococcus epidermidis
RRFMTMEMAKEQELILVLDFGSQYNQLITRRIREMGVYSELHDHEISIEEIKRMNPKGIILSGGPNSVYEEGSFTIDPEIYNLGIPVLGICYGMQLTTKLLGGKVERANEREYGKATINAKSDELFFGLPSEQTVWMSHSDKVIEIPEGFEVIADSPSTNYAAIEDKKRRIYGVQFHPEVRHTEYGNDLLRNFVRRVCNCTGEWTMENFIEIEIEKIRQQVGNRKVLCAMSGGVDSSVVAVLLHKAIGDQLTCIFVDHGLLRKGEGDMVMEQFGEGFDMNIIRVNAQERFMSKLKGVSDPERKRKIIGNEFVYVFDDEAAKLTDVDFLAQGTLYTDVIESGTKTAQTIKSHHNVGGLPEDMEFELIEPINTLFKDEVRALGIELGIPEHLVWRQPFPGPGLGIRVLGEITEDKLEIVRESDAILREVIREEGLERDIWQYFTVLPGIQSVGVMGDYRTYDHTVGIRAVTSIDGMTSDFARIDWEVLQKISSRIVNEVDHVNRVVYDITSKPPSTIEWE

SEQ ID NO: 6966 - protein, 199 aa, Staphylococcus epidermidis
FQIIIKEFKAMNVSNQIKKFRERDGYSQEFLAEKMFVSRQTISNWENDKSYPDIHNLLIMCQLFKVSLDELVEDDLKNVQIKNIKKELDFWTWMMIITMVLGSVLIGPMIHYFHWLGIGITYLVFLIGIIASTKLEKIKIKNDIETYDRILAFINGKDPKEVQKSKFRDIWTSSISFIFFVGVIIGISYLSIILTDYFL

SEQ ID NO: 6967 - protein, 178 aa, Staphylococcus epidermidis
CFYIKIKIKEVNLMYNKVFAILIIIFSIIIIASNDTFAESKNDMMNMKEDKKSTMDMTNMKHHDERKKLNSSQGKNEIIFPEVAESKKDNNGYKNYTLKAQKGKTEFYKNNFSNTLGYNGNLLGPTLKLKKGDKVKIKLINNLDENTTFHWHGLEVNGKVDGGPSHVIKPGKEKNYKI

SEQ ID NO: 6968 - protein, 52 aa, Staphylococcus epidermidis
KGVFCMNYFRYKQFNKDVITVAVGYYLRYALSYRDMSETLRERGVNVHHLTV

SEQ ID NO: 6969 - protein, 53 aa, Staphylococcus epidermidis
LLHIILSALYHHKNRKNKIPKEYRNLVSDCGQTDFLSVSLFRKFYLNYSFYFY

SEQ ID NO: 6970 - protein, 347 aa, Staphylococcus epidermidis
KNNMNKILIEKEIFKMKNLRNRNFLTLLDFTQKEMEFLLNLSEDLKRAKYAGIEQQKMKGKNIALLFEKDSTRTRCAFETAAYDQGAHVTYLGPTGSQMGKKESTKDTARVLGGMYDGIEYRGFSQRVVEDLAKYSGVPVWNGLTDEDHPTQVLADFLTAKEVLKKPYNEINFTYVGDGRNNVANALMQGAAIMGMTFHLVCPKELNPTDELLNRCNDIADKNGGEILITDDIDEGVKGSDVIYTDVWVSMGEPDEVWEKRIKLLEPYRVTKELMKKTGNPHTIFEHCLPSFHDTETIIGKQIQEKYGLTEMEVTNEVFESEQSVVFQEAENRAHTIKAVMVATLGE

SEQ ID NO: 6971 - protein, 308 aa, Staphylococcus epidermidis
YWVLFLQYLAINKTKVLVKNMNLNDLEAFYKVCENRSFTKAAQELNYVQSNVTAKIQRLESYYQVKLLYRDKKGIKPTPEGIELLKYIKRIFTILHEAEHNVSNNKKLNINIGTIETIAAVHLPKLLNEYKRKNPKIQINLKTDNSIKLIEHVKNREMDCAFISGNINDKDLICTNIFNEKLVILSQKSNFKQNINENKSIIMFGEGCFYRKIFEDWLNYHDINIENKMTLNTLDGILGCVEAGLGIAFLPMSVLNKGNSDGIEITKVEESFQTISLNIIYRQDNKNNNVINQLKQVAFEKMKSNIIK

SEQ ID NO: 6972 - protein, 107 aa, Staphylococcus epidermidis
ITLIIMKGMGIMSNIIKTIGKGIGKGVGAAAYYSVATVGAAIGAIWETTGDRGLMRDALSDSSNQDLIEIYEIQKKDDGDYDTYIAAKSLLQERGFTYNHETNKWEK

SEQ ID NO: 6973 - protein, 182 aa, Staphylococcus epidermidis
KVLIMNLTTQITKMLGIKYPIIQAGMAGSTTPELVSTVSKQGGLGMIGAGYFDSHQLSKEILEVQKLTQAPFAVNLFTPNDIKYDKKQIEQMNTKLKPYREALGLSTPKNSTVKEKEKFEDAIEVIESLKVPIIAFTFGIPNQNIIKRLHNAGKILIGTATSVEEAVENGKCWYGYSCSPGL

SEQ ID NO: 6974 - protein, 44 aa, Staphylococcus epidermidis
KKLINCSTFICKASVCVTLDYGSSKSPTLLNLFIKHFCNFKHML

SEQ ID NO: 6975 - protein, 77 aa, Staphylococcus epidermidis
EVIMMTLEQQLKHYITNLFNLPKDEKWECESIEEAADDILPEQHVRLGPLSNKILQTNTYYSYTLHKSNIYPFILYY

SEQ ID NO: 6976 - protein, 224 aa, Staphylococcus epidermidis
YVIMNCKTTSRRFLMDGLITFIIITLLIIIVPGPDFIIVMKNTINSSKMNGFMAAFGITTGHILYSSLAIFGIIYILTSLHFVFLTIKILGACYLIYLGIKSILSAHSSVDFSKQALADVRNVSYITSFRQGFLSTSLNPKALLFYVSIFPQFLSNGNIHMKSEVALFAFSVVVVICLWFLFCVFIFQYIKLLFSRPRFKAIFDYIVGFVLIGLSINLLLSKSS

SEQ ID NO: 6977 - protein, 157 aa, Staphylococcus epidermidis
SKIIKGVIKMKKEKRLNLILTVIQQNQFNKKQQIVDYMARHFGVYYSLTTISRDLQELEIYKIPVENKKYIYKKINQTNQLSAKKQLEIFSDEIIEFITLNNYVLIKTSPGFAQSISYYIDQLQMKEILGIIGGNDTLMILTSSNEIAEFVCYQLFP

SEQ ID NO: 6978 - protein, 42 aa, Staphylococcus epidermidis
AYSILYFFFINSYFTNLNLLQFIFETYITENLVLNALPPTLS

SEQ ID NO: 6979 - protein, 57 aa, Staphylococcus epidermidis
VYSMFKVIYHLKFSNYLSIFRSIDNTLVYPAIMSFYLTKSKPPVQTDGLLCIYNFFY

SEQ ID NO: 6980 - protein, 52 aa, Staphylococcus epidermidis
NNVLIKRSNLNYHMTIHSNQGYHYQHKSYINILKENSAFQSMTRNANCLDNY

SEQ ID NO: 6981 - protein, 154 aa, Staphylococcus epidermidis
LPQIVDDVSIPVIAAGGIMDGRGLVASLALGAGAAQLGTAYLTTNESGADDKIKNEIIESSETDTILTNVFSGKLARGIMNEFVHNMNLYSKQVPPYPLQNQLTTQIRKSALEKGYTEWTHIWSGQSTRLADTVDAAQLTKNIINDAVKIINNK

SEQ ID NO: 6982 - protein, 912 aa, Staphylococcus epidermidis
GEQMKNIDIAIYDIDKVICKSIENNSSDLGYLSQSILSHLRNYVEHIGMKYYFESVNEDMTNSSSNIYNEIQMGIGYFRKHYKLNWLKNFHELLQQSVSHYTFDEDRSERLFIKYYDLMLELKEKLKKDFEMDLLQNLYKVPLNIDSDLKGYYHTISQLIGNKYTDNEYEVDNSRYYIEKTKPFVIENKVYYEITFRNANDKTSKYERLIGYSKHRINTNYAVKFALEMQTISYLGIKANVIIINDYEISIRPCEFNNFAKILDYDLKLQSNHNEYKKLMKLLKEFNLHLLDIVLLDDDEFNELECSVNSESAVINIFNVLRLARRYILTNKSGANVLRYLLFVFNNRIIRLQLPYNRNKCYKLSNLILDYKCVPFDQMPFTASLKGHNPNIYTLLQCIEYKGREYELLVRKIQKNTLKNKKVYTSKEEIEQYGVVNELIDKYNNNLYYKHRPNREIHSFGDKYYLYENEQSIMSIIKSIKLLSNESVEGYSNSVEFWLNNEYTSLDCKEKKEILLRMFSNSKISMVYGAAGTGKSTLINHICNFFYDKDVIVIANTNTAVDNIKRKIKLSNIKTSTISKFLYNDKEKYDLLIIDEAGTVSNKDMNRILENKQFELLLIVGDNYQIESIDFGNWFEIAKDVLSKNIINELTDMYRTKNDDLLYFWKSVREKKSNLNEIINMNKYSTRLDESIFNEFNKDEIILCLNYDGIYGINNINRLLQANNKNDSVIWGVKEYKVGDPILFNETNKYSPILFNNLKGSIIEIHVFEEYILFDLEINKVINELDIISLEIDLISSSENSSVIRIRVEKSDGLNDDDNDSSDSIVPFQVSYAISIHKAQGLEFNSVKIVISDDLDEQITNNIFYTAITRARENLKIYWSPRTEKKIIDNIISKRNLKDLSILKSRIKKQNT

SEQ ID NO: 6983 - protein, 59 aa, Staphylococcus epidermidis
FNEIHIFIPYFHLLFNRNPRSLIQYKIKIKKLLMFLKMRSDLWITRKVKNKKVVIAMFK

SEQ ID NO: 6984 - protein, 607 aa, Staphylococcus epidermidis
QQPFERRCSLMTQTNPSFNPSPRYKSKKGWYKDKPPKEKGGMPTEVEIAGPIVIENKFIDPKTNTEKVIITDEDQKVIVESSDILTTQKLPSLMKYGFSINEKYTKDLGYALQQMRNQLPISYLYEGVGILETPFGPIVSLNEIYTTTEFDNKSPSDAICENTYDLAPRGTFDNWFNMYIDEVKDHLLLELTVIFGISALVTSFLKHKHEIEFAGILFSFTGQSSTGKSTAAALAVSVAGNPTKGNETLFRSWNATRNALEGYLSNNYGVPIVFDELSSTTLKDTTGLLYSIAEGQGRQRSNVHGEVKAPKNWGTSVISTSEYSIFNDSAQNDGLRVRTIEINEQFTTNATNADNIKKAVALNYGHVLPLVAKYLINREDEVIQWFYKEVDWFEAKLKDETNNTGIRMFKRYAVITTSAKILGRVLSTDIDIANIRDYFIDYHTHTVSERSLADKAIDVIIQFVAQNRGKFSDEGALKNMFENYGLISLKDDHIEVKIIANVFKQMLNNHQFQDVNNVVNALRDKGFILADRGRQTTKRSVKDNSGKKQSLVFYHLKLDVEFASILGLTKDKSLLQNWTPSNDNKAAKELFKSANEGIGPSGVHEDF

SEQ ID NO: 6985 - protein, 199 aa, Staphylococcus epidermidis
GDRMEIYLVRHGESQSNYDNKHGYLYFCGQLDVPLTERGIKSAKELSVYFKNKYIDNVYVSDLKRTRQTYEELFPYDIPTIYTKTLRERSLGVFEGKNKEEVCKDKRFEKYFRDPNYKYFRHSFSQKAPQGESYQDVYDRVVTFIENELNQQQRRVVIVAHQVVIRCFFVYFKMITKEKALTTEIHNCYPYLIKEEMKF

SEQ ID NO: 6986 - protein, 274 aa, Staphylococcus epidermidis
LGGIMKNFKVQEAKETPLSAQNANVFIKCVKKYNWLKDIIINGYFQYRYVTEEVEYLNIETTDLSGKRIPIEDITFPMLCFCDIPLNQLKDHNKWYGDYAICMKKSWGVNKNLQPLHYVSNTSEYIKMYQEVFNNIVNKPDTDEKVYEFIFASLFFLKHFKGSQYCEKTDKIEEKIFMDEQEWRSIKLVDEDLDPFYINENSDSKRNYYNEALTKLSSNKLEFNCEDIRYIIVEKEEDVIQLINDINCSNYDDQEKSLLISKISVLNHLREDFM

SEQ ID NO: 6987 - protein, 509 aa, Staphylococcus epidermidis
KRVIIMIKNKWKIELWFQFFSYFIHKIDSEFILKEYAQHILPEEMRTNYVVGEAQPNETIYISYFVNTSNQNIEQHTVKCSEEGIFIDKIPSGFTKDNLTYSIDSQSMVDIDELSNEIIDQGVDALDVLESTTLDTYFTEFLTTINKTTDFAKKIANNTIKQIRENIELKKANYRIDYEKAIDDVSSLESFINLKDTILETHQDLSKENFDDVLISDFLTKYLIYKEKQDSYVKKNISNLNKSNYFKQLVTEGLIKERTSNSQYFEIANSIKPSIHNKYSLNQSDELDQFRQAVIGISLNLYDQNDTYFKFIRSILTEKSRKVNLTIDGLIESQNTINEFMKKQDLISDNELYYLTTIEDTFHFALFTAISDLMDELVLVTSKIIQSATQYDVLVALYSISNLKNDLNKLAHKHERSLTRFKSLIDGYVRNTRLKDLIHNIIMNDIKMTEKVERSLLTDLKKYNISNFYKRDNFNNNPNDFLDKLMIQIISKFYKTRLEDINDGPNLYY

SEQ ID NO: 6988 - protein, 156 aa, Staphylococcus epidermidis
EITIENIYCTHCMCDCDDASSKFNSTFIRSNFNSRNCCCIVRGGDGKMTTDLHTLVLIVLCGVVTLLVRVIPFIMISRVNLPAIVIKWLSFIPITLFTALIIDGVIQQHDHAFGYTLNLPYIIAIVPTVMLAIFTRSLTVTILGGIFVIACLRLIF

SEQ ID NO: 6989 - protein, 43 aa, Staphylococcus epidermidis
GVKIKKYIKEILDKIYEDFMNNDAITTLLNNDLQTIINQYLSK

SEQ ID NO: 6990 - protein, 113 aa, Staphylococcus epidermidis
LEEIDSFNELFYLIELYLKAFKGQKKTGYEFEERLNTFIQSYVIILLIDIRLPTVRLYIIRHIVDTCEKEVDNQKRIILIEKSIKKYRYVKEQIKRFGNALKEELSNATLSIE

SEQ ID NO: 6991 - protein, 470 aa, Staphylococcus epidermidis
RPWITIEKKMKIRDENMNFVKSKTDLFRLIDNEAQTSTSKVVLFLILGTIFLDAYDITILGTMTDQLTQQFHLSPATLSIVMTSLPIGALFGALLGGTLAYQFGRKRILSIALLTLTVTSLGAALAPNVIILIICRCIMGFAIGMDSPVAFTFIAEISNLKHKGRNVNYWQVVWYVAIVTSALVVTAFFMLGAGAHLWRYAVGFGALIAFVLYILRIKYLHESPTWVINHYSLEKATEFIRKYYHKDIHLEGTLEDDLNSDVTSPHNSWTDLFKPRYIKRIILATAISTLQGMQYYGVGLYIPIIATYLISKDKIGVLLGTAIVNIAGILGAYLGAQLTYKLGTRKLTMIGFTLVLLSMVCVGLFYHHLPMLLNTFLIGLFLFGHSGGPGTQGKTIGALSFPTHLRSQATGFVESVSRTGSIIGTFVFPIILAAVGLTNTMLILSIVPLLGIIITVSIKWEAVGKHIEVE

SEQ ID NO: 6992 - protein, 45 aa, Staphylococcus epidermidis
KEGIYIKILNSKIIEREATLEIESMATNCFFISPLIKKCKNIPQC

SEQ ID NO: 6993 - protein, 68 aa, Staphylococcus epidermidis
RTVFIMKFKELIKQSYEDLKNLTVNWFNVLSLTVIIFILSNIVTPLIGISVGLLGGAYILKRREEKNK

SEQ ID NO: 6994 - protein, 491 aa, Staphylococcus epidermidis
INNLNFFLTPFILITYVGILKIKKELYIDMEILFTVINVIVLLVFLVMLNIMARKHVSFPKRVFTALAIGIVFGIVLHLIYGAESKTLEQSTDWFSIVGDGYVALLQMIVMPLIFISIVAAFSKIQIGEKFAKIGSYIFMFLIGTVAIAAIVGIFYALIFGLDASSIDLGSAEHSRGTEISKQAKDLTANTLPQQILEVFPSNPFLDFTGQRTTSTIAVVIFATFVGFAYLRVARKQPEHGSLLKRGIEAIYSIVMAIVTFVLRLTPYGILAIMASTLATSDFSAIWTLGKFLIASYAALITMYIIHLIILSVLGINPVKYVKKTIEVLIFAFTSRSSAGALPLNVQTQTKRLGVPEGIANFSATFGLSIGQNGCAGIYPAMLAVMVAPVANVEIDFQFVVTLIAVVIISSFGVAGVGGGATFASILVLSTLNLPVALAGVLISIEPLIDMGRTALNVNDSMLAGTGTARLTNHWDKKTFDSNDYGDLSAN

SEQ ID NO: 6995 - protein, 58 aa, Staphylococcus epidermidis
KSDFKMFYVKQKLSLFRKLGDLNNIFTTIDLRYKLKVNDTFRLINMDEKGYCVWYINF

SEQ ID NO: 6996 - protein, 40 aa, Staphylococcus epidermidis
EVYVYQKSEQRGRKEVYINKKDACNHAIRRHDCTRFYLIL

SEQ ID NO: 6997 - protein, 68 aa, Staphylococcus epidermidis
NQNVYNLTFKDYQKIIMTKLLQLFKTSLIFNFLLKFYLEIVIFKRYLILFDIITPSNETRCNNIELAT

SEQ ID NO: 6998 - protein, 48 aa, Staphylococcus epidermidis
FYCVINILNCQNSEGMFQKDGVMKLTRISKTSPKKMLVQHLFWASKIM

SEQ ID NO: 6999 - protein, 188 aa, Staphylococcus epidermidis
RGRFLLCDAFTRRILKEVTMMNTIKSTIHTEAIFSDDEQHRYLLKKTWDEKKAACTVITMYPHLDGVLSLDLTTVLILNQLANSERYGAVYLVNLFSNIRTPENLKHIKNPYDEHTDIHLMKAISESDTVILAYGAYAKRPVVIDRVEQVMEMLKPHKKKVKKLINPVTNEIMHPLNPKARQKWILKS

SEQ ID NO: 7000 - protein, 64 aa, Staphylococcus epidermidis
TLSVSISLRRFFIINYFILFDLSPGLVIFLIFLIYTLKNILLNNNKLFKLLIKEDIFISIYFSI

SEQ ID NO: 7001 - protein, 89 aa, Staphylococcus epidermidis
LFLVMIGYVDQIGREIGGVVFMVSCCSIDPYTEFEVIIIGAGVPEVSLAFHLTSYGIRTALADEQNVDNRLKDFLRTFQELIERDSGMP

SEQ ID NO: 7002 - protein, 85 aa, Staphylococcus epidermidis
NPLVHIFNDIRTKGFFNAYSTSICLPTASHFIDTVMIIPSKGTMDKINIVFVRPTAARMIGKTKVPMILPVRLTDSTKPVACERK

SEQ ID NO: 7003 - protein, 40 aa, Staphylococcus epidermidis
SMLVIEANIYFVNLSIYMNQFLGRKLEILVIEFRWRCFAW

SEQ ID NO: 7004 - protein, 169 aa, Staphylococcus epidermidis
WVFLVIPSIYERSNMMSNITVYNVIELGVNNLLADYDNWNVEEVLDKETQHFPNTLHWQYGHVLTIFEQALSLGNQHVVDVEKYNKLFGYGSNPRDWKGQDVPAINEIKQHIQTLPERAKKLTHEQLAQKLDQPIAGCNTLDELLMLNAIHVPLHTGKIEEMTRVLREK

SEQ ID NO: 7005 - protein, 42 aa, Staphylococcus epidermidis
VLSVHILMQQRQEERVVPVWQVLVQVAVQLLHLEVQLLQVQV

SEQ ID NO: 7006 - protein, 630 aa, Staphylococcus epidermidis
VVSVMTFNQLILKNLRKNIKHYGMFLFSLLISIILYFSFSTLKYSNSINNSDSSTIIKNGATIGATILFIIIVVFLMYANHLFIKRRTKEFALYQLIGLTRGNILRMLNIEQLVFFIVTGILGTLIGIFGSKLLLVIASKLMKLNTHISIGFEPQAILITIVMLAVAFLLIMIQNYIFLKKHSILALMKDNYTPEATQKRITTFEAIGGILGIIMIVFGYYMSTEMFGVFKALTTALITPFSILFLTIVGAFLFFRSSVSLIFKTLKHIKHGRVNITDVVFTSSIMHRMKKNAMSLTVIAIISAFTVSILCFAAITQSNTNTTLEMTSPDDFNISQNKIAAQFKHKLDQENLKYHQRTYEVINPKTLSDHVMKSKNGSDMSTNTTSLMMNSHLKGHEAKITNIQSSTGLIDIHLNHKITVKGKSKQSIIVKDKDNSKIYPSQLSFGAPIVEVSPEVYNTLKTDNIVNKMYGFNFNTHKDVKKAEKIASKVNRNIVSHDEYKKFINQSNGILIFVTSFLGIAFLMAAGCIIYIKQMDETEDELDNFKILRRIGFTYTDMSKGLLLKIAFNFGLPLLIALLHALFAALAFMKLLGNVSMSPIFIVMIIYTIVYFIFAMISFIHSSRMIKHSI

SEQ ID NO: 7007 - protein, 496 aa, Staphylococcus epidermidis
KSQVIHSLNQITRFLPPLLGEINMDENKLGKTSLIGLVIGSMIGGGAFNIISDMGGQAGGLAIIIGWIITAIGMISLAFVFQNLTNERPDLDGGIYSYAQTGFGDFIGFSSAWGYWFAAFLGNVAYATLLMSAVGNFFPIFKGGNTLPSIIIASILLWGVHFLILRGVETAAFINSIVTVAKLIPIFLVIICMIVVFNFSTFKSGFYGMTSGSVGVFSWGDTMAQVKSTMLVTVWVFTGIEGAVVFSGRAKSKKDVGTATVIGLISVLVIYFLMTVLAQGVIHQNQISKLANPSMAQVLEHIVGHWGSVLVNIGLIISVLGAWLGWTLLAGELPFIVAKDGLFPKWFAKENKNKAPVNALIITNILVQLFLISMLFTDSAYQFAFSLASSAILIPYTLSAFYQVKYTIQNKSKANLKQWIIGIIASIYTIWLVYAAGLDYLLLTMLLYIPGLLVYSYVQRDNNKHLTKLDYTLFIFIIVLAIIGIVRLITGNISVF

SEQ ID NO: 7008 - protein, 83 aa, Staphylococcus epidermidis
FFKVYSDMLIFLSYDFVRACLPRGMARAISLSHILFPQASALTKSVVIFIFIRILTEIILIRGIVKAILSKIADKRFVKSSSK

SEQ ID NO: 7009 - protein, 76 aa, Staphylococcus epidermidis
LLKVLNRVDLLVEISTYVALLNAQNAEIIWYVDGRIIKRKSPKNGQSSGITFVPYSIVQGVLHVTVIPSMLKSSSV

SEQ ID NO: 7010 - protein, 381 aa, Staphylococcus epidermidis
IKGVLEVKTRAAVLHEMGAKKPYKESKPLKIEYLELDNPSEHEVLIKIHAAGLCHSDLSVINGNRPRPLPMALGHEASGEVIKVGKAVTRVSEGDHVVCTFIPSCGKCIPCKEGRPALCENGAISNEKGEMLEGGMRLSNDEGKVYHHLGISGFAEYSVVSENSIVKIDKKIPFERAAAFGCAIITGIGAVVNTAQIRSGSNVAVVGLGGIGLNAIIGAKLAGANEIIALDINEDKFELAKQFGATATFNSSDKDIDEQIKEYIPGGVEYAFETAGVVPAMKVAYQITKRGGTTVTTGLPNPKDNFSFPQVTLAAEERTIKGSYVGSCVPDRDIPRFVNLYNQGRLNIDSLISEVITLDEINEGFDRLSNGEVGRIIMKMH

SEQ ID NO: 7011 - protein, 80 aa, Staphylococcus epidermidis
SKGVLSMNHDNTIQSNWRTVASCLASQNYISIVKGLVHHFTAIDDEEILDKIYEEFINDDSITTVLNNDLQTIINHYLSK

SEQ ID NO: 7012 - protein, 87 aa, Staphylococcus epidermidis
QKGVFCMNYFRYKQFNKDVITVAVGYYLRYALSYRDISEILRERGVNVHHSTVYRWVQEYAPILYQIWKKKHKKLITNGVLMRRTSK

SEQ ID NO: 7013 - protein, 230 aa, Staphylococcus epidermidis
QKGVFCMNYFRYKQFNKDVITVAVGYYLRYALSYRDISEILRERGVNVHHSTVYRWVQEYAPILYQIWKKKHKKAYYKWRIDETYIKIKGKWSYLYRAIDAEGHTLDIWLRKQRDNHSAYAFIKRLIKQFGKPQKVITDQAPSTKVAMAKVIKAFKLKPDCHCTSKYLNNLIEQDHRHIKVRKTRYQSINTAKNTLKGIECIYALYKKNRRSLQIYGFSPCHEISIMLAS

SEQ ID NO: 7014 - protein, 80 aa, Staphylococcus epidermidis
EILVQEVVVEGNITLGQFLKTEGIIESGGQAKWFLQDFEVLINGQRETRRGKKLEHNDRIDITDIPEDTGSFLIIHQGEQ

SEQ ID NO: 7015 - protein, 466 aa, Staphylococcus epidermidis
KDKVRQSLLRFLAKSLKTVIGMNNKEHTKSIILVLLVLMSIVLTYMVWNFSPDLSNIDNTDNSKSDKPKPLTKPMTAEMEGTITPFQIVHSRDDKSQGTVASGAVLDKMIQPLKNQEVKSVSHLKREHNLVIPELSNDFIVLDFTYDLPLSTYLSQVLDIDAKVPNNFNFDRLLIDQDHNNHVVLFAISKDRHEVVKLKTTMKGNNVDKAFKSIEPDMQPYTEIITNKDTIDKATHVFAPSKPKDLKTYRMVFNTISVERMNSILFDDSTIVRSSQSGTTTYNNNTGVANYNDKDEMYHYKNLSEDAKSSSNMQETIPGTYEFINSHGGFLNEDYRLFKTDNRTGKLTYQRFLNGYPTFNKQNFNEIQVTWGDKGVYDYQRSLLKTDVTLNSEESKSVPTVESVRSALANHPDIDFEKVTNIAIGYDMDDKANNEDIEVQRNCELIPRWFVEYDGNWYAYKDGRLE

SEQ ID NO: 7016 - protein, 70 aa, Staphylococcus epidermidis
EVRVLSFYRFMKNFEGEKSHFGDLFEGMKDINFPENITTPREIMEKFQHWLQEPSLHDTIQDAIKQYQNK

SEQ ID NO: 7017 - protein, 51 aa, Staphylococcus epidermidis
TSLFKGGEIMGVKDVLKKLKPQEQSCCSVEIEEKTEKNEKGQQDNNNCCNN

SEQ ID NO: 7018 - protein, 64 aa, Staphylococcus epidermidis
IVSLSFLKRLSNISLCFLHKYSSKSFGKVNILQSVKAVHISYGAGVSLNMKFIGNIFSSLLNLK

SEQ ID NO: 7019 - protein, 53 aa, Staphylococcus epidermidis
KLSFFTYPRTLCPGLIMIYFFIADLPLILLALQLVPQPFFEDLVDSHISLIGV

SEQ ID NO: 7020 - protein, 65 aa, Staphylococcus epidermidis
SNTLHRSDKMPSRWVKVKTFKSLSTSKLEKKLQNFKSYNSFDIIEIKRHSYLFLNIVEVYYKDKT

SEQ ID NO: 7021 - protein, 41 aa, Staphylococcus epidermidis
LETLIYELIDNSTNNSKFSSNAVGLFDRNEEQRFRLSNECL

SEQ ID NO: 7022 - protein, 71 aa, Staphylococcus epidermidis
LWAFLAIQRPSSVLPKLAYRFSQQVGKQYTYGKGLEELSEVEQLKLENKRKDIELDILKKYKVLERKWYQQ

SEQ ID NO: 7023 - protein, 53 aa, Staphylococcus epidermidis
LIKLRSILIGSVALAKLEAWILFAVVKMSPSHDRRDAGPGINENERGWFGRYK

SEQ ID NO: 7024 - protein, 44 aa, Staphylococcus epidermidis
MYKFKTLFNDRDVKGVTQFYEKESHYILDTSVVFNTCSMLKYER

SEQ ID NO: 7025 - protein, 303 aa, Staphylococcus epidermidis
FNKFGGVILMIDSIIEFIKTFLMLFFELLILFIIVSFIVSLIQQVVSEDKIKSMLSKPNQGINYFFGMIFGAITPFCSCSTIPILAGLLNSKVPFGPAVSFLIASPLMNPLMVFMLWVLLGWKVAIVYFIVLAIFSIFTGLVFSKMNLAESYKGVNVKGDGFFANKEGSRFKQALNDAWAFLYPMLPYLFIGVFIGAFIYGFVPETFITKYASGDGVISVFIGSVIGIPMYIRPETMLPIAEALVSKGMSLGTVVALIIGGAGASIPEVVLLTKLFKKKFVVSFVIAILVVAIATGLIVNIVI

SEQ ID NO: 7026 - protein, 110 aa, Staphylococcus epidermidis
HDKLVVSYIFLLCNRTLFFGATWGPIMWVMLPEMFPTRARGAATGIAIVVLQIGTLIISQVFPILVNMLEVQYVFLIFAVIGALALIFVVKFLPETRGKSLEEIELQLQN

SEQ ID NO: 7027 - protein, 47 aa, Staphylococcus epidermidis
LIFSAISDQINVEGIAPNPTNIQLKVAYSATEGIDLTIATRKVPVII

SEQ ID NO: 7028 - protein, 271 aa, Staphylococcus epidermidis
YKFSDNLGEGYNMTLTNKEVAKVLFKAYRYKKPIDFISENYQLNEEEAYHVQEELIDQLTFKDRSTVTGYKVSMTSKATQAIANTNEPAYGTLLSNQIVNDGASVSLSELFSPLLEPEIIFIVQEDLPYDADLETIRYHTRIAPGIEIPDARYKNWFPNFTLSDLISDNTATGLVVVGDPVDGLDNDAFANVHLNLYKDDKCIATGESSEVLGNPLNAIHWLIKKLHTHGKQLKKGDIISSGTFISPLKLEYGTYRAEYSGIGKVSFSVNK

SEQ ID NO: 7029 - protein, 80 aa, Staphylococcus epidermidis
VAKFIGKGTYIEDIVNGSFLKSQDDLKLKASDFTVEDNYNYGVLIFPENLSLTDNNKKLESLIKTILFTGKRYQYTYFKI

SEQ ID NO: 7030 - protein, 616 aa, Staphylococcus epidermidis
RRLSMSHLLNQLKSNVLVADGAIGTIFYSEGLDTCPEAYNLTHPDKVERIHRSYIEAGADVIQTNTYGANFEKLKSFGLEHKVKEIHQAAVQIAKRAANEDTIILGTVGGFRGVRQEDISLSTIQYHTELQIDTLIDEGVDALLFETYYDLDELTRIVTATRQKYDIPIIAQLTASNTNYLVDGTEINAALKYVVECGANVVGLNCHHGPHHMQRSFSHIELPKHAYLSCYPNASLLDIENSEFKYSDNAQYFGDIAQELINEGVRLIGGCCGTTPEHIRYIKSAVKHLKPVKDKKVIPINKASSQKQTRVLKQNLTSKVKNGPTVIVELDTPKHLDTDTFFDNVGKLDEAGIDAVTLADNSLATVRVSNIAAASLIKQRYDIEPLVHVTCRDRNLIGLQSHLLGLSLIGVNEILAITGDPSKVGHLPGATNVYDVNSKGLTELALRFNKGINTDGDALKKHTNFNIAGAFDPNVRKLDGAIKRLEKKVASGMSYFITQPVYSKEKIIQVYEETKHLNTPFFIGIMPIASYNNALFLHNEVPGIKMSDDVLNQFKAVKDDKEKTKELSLRLSKELIDTVHEYFNGLYIITPFQKVDYSLELAAYSKSITANKEAIL

SEQ ID NO: 7031 - protein, 75 aa, Staphylococcus epidermidis
FWKLMLPKILTPYAITIPNIAIIAPPKTGNGIILAKAPNLGIQPQISKRITIPYITLFFLAPDKETRPTFWEYAV

SEQ ID NO: 7032 - protein, 149 aa, Staphylococcus epidermidis
TLISQELLIQKIQDADALITLLSTQVSRQVIESAPKLKIIANYGAGFNNIDIQAAREHHINVTNTPIASTNATAELTMGILLAVARRIPEDDQLCHNEGFNLKITDDNLQVDYPRQFLKGAHAPSVKAQHVIHWGDTFWVSSLWLAWFY

SEQ ID NO: 7033 - protein, 457 aa, Staphylococcus epidermidis
RVISVRRIMMTKKYDLIVIGTGSAGSITAAKCNKAGWNVAMVDDRPFGGTCALRGCDPKKVLHGAAELIDWNKRMVKNGVPSEVSINWKDLMNFKRTFTDDVPEKKEEALNKQGIDTYHGNASFVSEDKLEVNKEVLEGSHFLIASGAKPTPLPIKGEEHLTYSDEFLELDELPQRIVFVGGGYISFEFAHIAARAGSEVHIIHRGQRPLENFDIDLVDILLEKSKEIGIQVHLQHSVESIEKEQGKFHVYARKKEDITRFEADIVIHGAGRVPALDMNLEKGNIERKKHGVHVNEYLQSVSNPNVYAAGDAAATDGLPLTPVASADSHVVASNLLKGNSKKIEYPVIPSAVFTVPKMASVGMSEEEAKNSGRNIKVKQKNISDWFTYKRTNEDFAAFKVLIDEDSDQVVGAHLISNEADELINHFATAIRFGISTKELKQMIFAYPTAASDIAHML

SEQ ID NO: 7034 - protein, 53 aa, Staphylococcus epidermidis
QTSSNLGMVNYYHQSIFKDVMHLTIFQRIILTHFGIQSHNITEISSKDMYLKI

SEQ ID NO: 7035 - protein, 44 aa, Staphylococcus epidermidis
FTELCDNHSCLFAINTFKCWRDKLYDKLRLIYYESKRFNFLEIY

SEQ ID NO: 7036 - protein, 64 aa, Staphylococcus epidermidis
SCCPSIFKPAVGPSVESLAGEPESPKALAVPIKAIRAIVSKPIDAPKGINNEAIIGIFAKVFTT

SEQ ID NO: 7037 - protein, 128 aa, Staphylococcus epidermidis
YRMLYRFSHKTGVYGVSVKEETGNQILVQIEQVIKHPKQGDLHHPNETEGVFFHERKALSHFEKRYATPSQLRDFNVEAMPYEDSLQHAITHLENQLKKEKTEYSRLSLNNLNRLKEDYAIQYKRHFD

SEQ ID NO: 7038 - protein, 40 aa, Staphylococcus epidermidis
IKKPVNEFMKTHLLAILLGIMSQPRIDTFRYTIQLFVFSR

SEQ ID NO: 7039 - protein, 47 aa, Staphylococcus epidermidis
LVELFDLCYDMSVKKIEIRGYQVESSLQSRSTYQGTCDWYSTVWRIC

SEQ ID NO: 7040 - protein, 97 aa, Staphylococcus epidermidis
TKLTRCLMYKDYNMTQLTLPMETSVLIPTNDISRHVNDIIETIPETEFDEFRHHRGATSYHPKMMLKVVLYAYTQSVFSGRKIEKLLNDNIRMMWLS

SEQ ID NO: 7041 - protein, 42 aa, Staphylococcus epidermidis
HFVTLCKLWYYLNRNNYVLKAEGRFNALDNYWWWLTRNHHCT

SEQ ID NO: 7042 - protein, 92 aa, Staphylococcus epidermidis
VVKTFANIPIIASLFIPFGASIGLDTMALIALIGTASALGDSGSPASDSTLGPTAGLNIDGQHDHIRDTCIPNFLFYNVPLMIFGTIAAMVL

SEQ ID NO: 7043 - protein, 66 aa, Staphylococcus epidermidis
CGYHKIKSLLIKRLIDSKTNKKIMKNYSWEYFNVQINQKLSERKAKTIYSQRKIDVESVFGIMKLF

SEQ ID NO: 7044 - protein, 503 aa, Staphylococcus epidermidis
KERQKMIESNLLVLTLVIPILTAILLIFIGKRPIIKRYVALVGTLLTLVIALINLKNVLRDGPIKVELGSWKAPYSIVFVVDIFSALLIITSIIITILVILYSYRSIGLDRERHYYYFSIMFMLIGIIGSFTTGDIFNLFVFFEVFLMSSYCLLVIGTTKIQLQETIKYILVNVVSSSFFVMGVAVLYSVVGTLNLAHISERLSQLSVHDSGLVNIVFILFIFVFATKAGVFPMYVWLPGAYYAPPVAIITFFGALLTKVGVYAIARTLSLFFNNTVSFSHYVILFLALLTIIFGCIGAIAYYDTKKIILYNIMIAVGVILVGIAMMNESGMTGAIYYTLHDMLVKASLFLLIGVMYKITKTTDLRHFGGLIKGYPILGWTFFIAALSLAGIPPFSGFYGKFYIVRATFEKGFYLSGIIVLLSSLIVLYSVIRIFLKGFFGEVEGYTLSKKVNVKYLTTIAVASTVITVIFGLSADTLFPIIKDGAETFVDPSQYIHSVLGGK

SEQ ID NO: 7045 - protein, 41 aa, Staphylococcus epidermidis
KAKHNDHEENNHGSVLKDKVILLSIHGHSPHLIDFSVLIVI

SEQ ID NO: 7046 - protein, 50 aa, Staphylococcus epidermidis
TSLNRMRPVAAKALIKAPRTTNMIETLVTIVAIMLDHLTFIHKFRKDCSS

SEQ ID NO: 7047 - protein, 130 aa, Staphylococcus epidermidis
GVIKLNHHYKVGQHIKVRVTGIQPYGAFVETPDHTEGLIHISEIMDDYVHNLKKFLSEGQVVKAKILSIDDEGKLNLSLKDNDYFKNYERKKEKQSVLDEIRETEKYGFQTLKERLPVWIKQSKRAIHND

SEQ ID NO: 7048 - protein, 125 aa, Staphylococcus epidermidis
TMTNLLETFEMKIEQKEDGKVVVSMPVTDKVKQPFGYLHGGASLALGETACSIGAAHLIDTQQFIPLGLEMNANHIRSTRQGHVRAFASLIHQGKTTQVWNIDIKDDHDQLISVMRGTIAIKPIQ

SEQ ID NO: 7049 - protein, 144 aa, Staphylococcus epidermidis
MTMNRQQNNLIFQYAAVIIFFMVIVFGFSLFLAGHYTPGGGFVGGLLFASALLVITIAYDVKTMRKIFPLDFKILIGIGLLFCVGTPLTSWFMSKNFFTHVTFDIPLPLLEPMHMTTAMFFDFGVLCAVVRTIMTIIISIGENE

SEQ ID NO: 7050 - protein, 808 aa, Staphylococcus epidermidis
ILKEENIVSLLHIAVLLPLIFALIIPFLYRFVKRIHLGWFVLPVPIVLFIYFISLISMTMSGNNVMKNLNWMPHIGMNFNLYVDGLGLLFSLLITGIGSLVVLYSIGYLSKSEQLGNFYCYLLLFMGAMLGVVLSDNFIILYLFWELTSFSSFLLISFWREKKASIYGAQKSLIITVLGGLSMLGGIILLSLATDTFSIQAMISKASDIQNSPFFILVMILFMIGAFTKSAQVPFYIWLPDAMEAPTPVSAYLHSATMVKAGLYLIARITPIFAISEGWVWTITLVGLITLFWASLNATKQHDLKGILAFSTVSQLGMIMSMLGIGAVSYHYQGANSQLYVAGFVAAIFHLINHATFKGALFMITGGIDHSTGTRDVKKLGGLLTIMPISFTLTVITTLSMAGVPPFNGFLSKEKFLESMINVTHLNLMSLNTLGILLPIIAIIGSIFTFVYSIKFILHIFFGSYKPEALPKQAHESSILMLISPIILTSLVIVFGLFPSILTQSIIEPASVAVSQTSNITAEFHLFHGITPAFLSTIGIYIIGILLLISFSYWVRLLQAHPYQLTLNHWYDTSGQRIPGYSENITNSYVTGFSRNNLVIILGILIALTFVTVISVPFSIDFKNVSHLRVFEGATVLFLLIASTFIIFAKSRLFSIIMLSAVGYAISVLFIFFKAPDLALTQFVVESISTALFLLCFYHLPNLNRYNEKPTFKLTNAVISIGVGLSVIILGLIGYGNRHFDSITKFYQEHVFDLAHGKNMVNVILVNFRGMDTLFESSVLSIAGLGVYTMIKLRLKQKNQSSEVNDHE

SEQ ID NO: 7051 - protein, 62 aa, Staphylococcus epidermidis
  MOD_RES (24)..(24): Variable amino acid
  MOD_RES (26)..(26): Variable amino acid
  MOD_RES (58)..(58): Variable amino acid
CGVCFWNYEAILSFTRKSVRGINXDXRELGLVLMTLNIRKVPAQRAENYKKIIKKKIXILCQ

SEQ ID NO: 7052 - protein, 103 aa, Staphylococcus epidermidis
KGRREIMPFKIFIITALIIVVLSMLAMLIRVILGPSLADRVVALDAIGLQLMAVIALFSILLNIKYMLVVILMVGILAFLGTAVFSKFMDEGKVIKHDSNDRH

SEQ ID NO: 7053 - protein, 163 aa, Staphylococcus epidermidis
EVNSLAIQFVINLLVSVIWLLVTNSYTLNNFVLGFILGLFLVYLLHRVLPGQFYLVRIYRIIMLIITFLTELIKANFGVLKIILKPRIENKPGFFVYETELERDWQLVLLSNLITLTPGTVVLGISDDRKKIYIHSIDFSTKEEEIQNIKSSLEKVVRKVGEK

SEQ ID NO: 7054 - protein, 110 aa, Staphylococcus epidermidis
SLLSGILTSISVYLVSSKSLIRIIMGTTLLTHAANLFLITMGGLKHGTVPIFEKGTSRYVDPIPQALILTAIVIAFATTAFFLVLAFRTYKELGTDNVELMKGAPEDDRE

SEQ ID NO: 7055 - protein, 203 aa, Staphylococcus epidermidis
HEWRIEMTNYPQLNKEIQDNEIKVVMHTNKGDMTFKLFPDIAPKTVENFVTHSKNGYYDGVTFHRVINDFMVQGGDPTATGMGGESIYGSAFEDEFSLEAFNLYGALSMANAGPNTNGSQFFIVQMKEVPENMLSQLADGGWPQPIVEAYGEKGGTPWLDQKHTVFGQLIEGESTLEDIANTKVGAQDKPVYDVVIESIDVEE

SEQ ID NO: 7056 - protein, 390 aa, Staphylococcus epidermidis
KQRGDSMHWTIIGGGLQGTTIALKLKNEGLKNEALTIIDPYSSLCERFNIYTQRISMPYLRSPFVHHIHPKPFHLKQYARYHQYTSAYYGPYKRPQRDMFMHHVHDLIHQFKLNDCHIQGKVEAINKSRGKWCIKLSTGDKMITDCVVIANGYTQTPFIPEIFRNKANVKHIFADNYHASLDKDTQHVVGSGISAAHLTLKLLNEHNHQLVHLWMNKDIEIHNFDADPGWLGPKKLNYLASISSSDARMKLIEDERHSGSMPMELFLRLKKYVQSGRLVIHTSQIDDVTESYIISAGKYFEYKHILLATGFYNQLLTQPLIKNLIQNEQAPLNQSGYPSLSNELEWLNQLFVAGGLADLELGPFARNIMGGKESAERISKAYKRLNKKIS

SEQ ID NO: 7057 - protein, 41 aa, Staphylococcus epidermidis
LHTILIICLQIIYSPIIKMLSIVNYIQQINNNYLKFFIFPY

SEQ ID NO: 7058 - protein, 120 aa, Staphylococcus epidermidis
SSMIATIVTSVSIIFVVLGALISAFAATGLIRLRDVYSRAHAAGKAATLGAMFLLFGAFLYFIGTEGYVNMQLIIGIIFVFITGPLSSHLIMKAAYNIKTPYTKDTKIDEIKEDMKHTKL

SEQ ID NO: 7059 - protein, 390 aa, Staphylococcus epidermidis
  MOD_RES (207)..(207): Variable amino acid
HAIVITSLNKESIKNMNNKYEPLFKSLTLPNGVEVRNRFVLAPLTHTSSNDDGTISDIELPYIEKRSKDVGIAINAASNVNDVGKAFPGQPSVAHDSDIEGLKELAQVMKKNGAKAIVQIHHGGAQALPELTPDGDVVAPSAISLKSFGQQKEHDTREMTAEEIEQTIRDFGEATRRAIEAGFDGVDIHGANQCLIPQFVSPYYNIXNDVWADNYKFPVAVIDEVVKAKKAHANDDFIIGYRLSPEEAESPGISMEITEELIHQIANKPLDYIHVSLMDVNSVTREGKYKGENRLELIHQWINGRMPLIGIGSVFTAEDALNAVENIGVEFVALGREILLDYDFVAKIKEGREDEIINAFDPNREDQHYLTPNLWEQFNQGFYPLPRKDK

SEQ ID NO: 7060 - protein, 60 aa, Staphylococcus epidermidis
FCLLVFIKLYERPYFFKYFIVKLHINTKYFGETLEGAGQVEDYRLKLSLRKRANNTRYCK

SEQ ID NO: 7061 - protein, 54 aa, Staphylococcus epidermidis
KICSSISLFYDFSTLNKASKIMFYELIFIFKYNSCTFINKLCSINFDRLSQTKS

SEQ ID NO: 7062 - protein, 166 aa, Staphylococcus epidermidis
WLCSRILIKLFLNKNRKEEYIMNTKYLLAVGAIVTSLTLGACGNSNSESDHANHKDKQQEDSNVKTDTTKKLSGNFESKNGEKVEGKAKIENGKLMLENYKSSKGPDLYVYLTKNGDIKSGKKISTVDYNKSKQTFDLKNVDLEKYNEVTIYCEKAHVIFGGAKLK

SEQ ID NO: 7063 - protein, 49 aa, Staphylococcus epidermidis
IFTSLELHSENYNVLTFYCNPKKMYKFSYSVFLIILENDFSGININKNV

SEQ ID NO: 7064 - protein, 262 aa, Staphylococcus epidermidis
RHTSYFNSGGEMMKERFSPKTLSDITGVSIRTLHYYHEKGLLVPQQMSANGYRYYNVQDISKLQYILFLKELDLTLKQIQTYFEGDSDFRTKILHDNFYHIVKKRDRLNDIIRTLEHHFHKDNDEIEVTTMQNFNLNEQYEKEAASKYGDTHYYQAYKDKQKCKDESEQQNHFEEINKQLNMFFDEMNQLYLNKVSILEASGKTKKLQCILKEQVPNCDNQFLEYIAQIYIEDERFVKFINKQRERGLNLYISDAIKTFIKL

SEQ ID NO: 7065 - protein, 77 aa, Staphylococcus epidermidis
GFTSIYVVSRLGNTYLNHHDSISDNYMLRPSHRDTPRKKCDWLHSIINLLLYVKHMPILYCRQNNFFIQPMTNHLKA

SEQ ID NO: 7066 - protein, 57 aa, Staphylococcus epidermidis
PFNSISCAPINGPNKKPSENIERKTVLANLARSRELEALIDSLAEAYNCGIAGANNP

SEQ ID NO: 7067 - protein, 171 aa, Staphylococcus epidermidis
SNGSKYSKESSKSSFKSSFTKRFVTSCCGFSNTLLTAPCSITLPFSITATSSQILRITCISCVISTIVKFCCSLTFNNKSRISSVVCGSNALVASSHNNTSGSLANALAIPTLCFCPPDNSDGYALSRPFRPTSSMSSNAFCLARPLGTPAISNGNVTFFNTFLDHSRLKC

SEQ ID NO: 7068 - protein, 53 aa, Staphylococcus epidermidis
KYLSLHTKHMREIFIPKILSMGTIIHTLLCNVNHKFSFFYIQIVFNSHFLLFF

SEQ ID NO: 7069 - protein, 227 aa, Staphylococcus epidermidis
GVISMSQNDLNKEKALVVFSGGQDSTTCLFYAKKHFKEVELVTFNYGQRHDKEIEVAKKIAKEQNLKHHILDMSLLSQLTPNALTQHELSIEDNDDGIPNTFVPARNLLFLSFAGALAYQIHAKHIITGVCETDFSGYPDCRDSFIKSMNVTLSLSMDKDFVIHTPLMWLDKAQTWALSDKLGVLDYIRHNTLTCYNGIIGDGCGECPACHLRARGLKHYLEHKGEE

SEQ ID NO: 7070 - protein, 66 aa, Staphylococcus epidermidis
GGISMSLHFQILLWLSILFIIAGTILLVTMLKTKKEERKESYLGFTVIFLIFGFAILIYTFIFGIL

SEQ ID NO: 7071 - protein, 66 aa, Staphylococcus epidermidis
IQTSSWLNIRKVTAQRAENHQKNYKKDNFYIISIEIVFIYLSWNFMSQPLIFILMSLVIILKLEYL

SEQ ID NO: 7072 - protein, 55 aa, Staphylococcus epidermidis
IQTSLWLNIRKVTAQRAENNQKNYKKDNFYIFSIEIVFFTYLEPFCPSLKKPPTI

SEQ ID NO: 7073 - protein, 156 aa, Staphylococcus epidermidis
GIKSFLTMKTNVIIDGDACPVVNSVIELTKGTGIFVTILRSFSHFSQQIQPEHVKIVYVDDGPDAVDYKIVELASNNDIVITQDYGLASLLIDKVHTVMHHKGNIYHSNNIQSLLNQRYLNAQIRRRGGRHKGPPPFTTEDRLKFEHAFRKIINQI

SEQ ID NO: 7074 - protein, 69 aa, Staphylococcus epidermidis
NQMSFYDFILGFINDDTPLGHLAQYIFNDACFPKEEKNNNSIRTYVLLNYNDRQLIESTNRAISLYQLI

SEQ ID NO: 7075 - protein, 90 aa, Staphylococcus epidermidis
IKSSCNFSLLIGSRALKGSSMIITGGSAANARTTPTLCRCPPDSSSGFLFLNCSGFKPTIVNNSSTRKSISLSFHFFIWGTCAMFSLIVI

SEQ ID NO: 7076 - protein, 91 aa, Staphylococcus epidermidis
FTTLSCYYSALVTVASIQTVGIILVVALLITPASTAFLISKQLYAMMVIASIISVISSIIGLNFSYIYNIPSGSNYCYLYLYDLYCNAISY

SEQ ID NO: 7077 - protein, 342 aa, Staphylococcus epidermidis
LRESLFMSYILIVTIAIVIFSLIFDFINGFHDTANAVATAVSTRALTPRRAILLAAVMNFIGALTFTGVAGTITKDIVDPFKLQHGLVVVLAAIIAAIIWNLITWLYGIPSSSSHALIGSIAGAAIASQGSFAVLHYQGFTKIIIVLIISPIIAFCVGYMMYTIVKIVFKNSNLTRTNRNFRFFQIFTAALQSFSHGTNDAQKSMGIITLALIVGNLQDGSNVEPQVWVKVACATAMGLGTAVGGWKIIKTVGGNIMKIRPANGAAADISSALTIFVASSLHFPLSTTHVVSSSILGVGASNRAKGVKWSTAQRMVVTWVITLPISAVLAAIIYFIIHLFLK

SEQ ID NO: 7078 - protein, 45 aa, Staphylococcus epidermidis
QFTFTHFFFVACHFLKSPPIIIFNQYHYIKFILSHSNMQSNILIL

SEQ ID NO: 7079 - protein, 54 aa, Staphylococcus epidermidis
APTFVINAANNAASSVLSTAYALGNHMKITSAAFELKATRNTKDIIVIVWLFSI

SEQ ID NO: 7080 - protein, 82 aa, Staphylococcus epidermidis
LMFPLVEFCISNMAKGSDVVFEKLENDPNIDVLEYGCLQNCGLCASSLYALVDGDIVEGNTPDDLLKNIYQHIEDNDITNLL

SEQ ID NO: 7081 - protein, 52 aa, Staphylococcus epidermidis
ALTPLILYVFCAHVNCTINITKITIILQNDYVDLVDDFFNNCFSAYRETYLS

SEQ ID NO: 7082 - protein, 64 aa, Staphylococcus epidermidis
TGYPLANIAETLKTSNSVIKLKIMENIGNHKKLSPKNKAIPDPNDAPLANPNVKLSASGLFNTI

SEQ ID NO: 7083 - protein, 169 aa, Staphylococcus epidermidis
ERLLVMFIYLFHFIISFIATVLFSIIFNAPKKLLLACGFVGAVAWTIYQMTVGMDLGKVGASFLGSLILGLMSHTMSRRYKQPVIIFIVPGIIPLVPGGAAYEATRFLVSNDYTNAVNTFLEVTLISGAIAFGILVSEIVYYIYSRIKQSYGKIKGKTYKKSYNMNNRV

SEQ ID NO: 7084 - protein, 312 aa, Staphylococcus epidermidis
ERMFKTLNKNDILRGLESILPKDIIKVDEPLKRYTYTETGGEADFYLSPTKNEEVQAIVKFAHENSIPVTYLGNGSNIIIREGGIRGIVLSLLSLNHIETSDDAIIAGSGAAIIDVSNVARDHVLTGLEFACGIPGSIGGAVFMNAGAYGGEVKDCIDYALCVNEKGDLLKLTTAELELDYRNSVVQQKHLVVLEAAFTLEPGKLDEIQAKMDDLTERRESKQPLEFPSCGSVFQRPPGHFAGKLIQDSNLQGYRIGGVEVSTKHAGFMVNVDNGTATDYEALIHHVQKIVKEKFDVELNTEVRIIGDHPTD

SEQ ID NO: 7085 - protein, 89 aa, Staphylococcus epidermidis
GVTPMKLNKANIFNLIFTILFFSFNILITYNANIDYKLWLIPGLAICGFALFSSLTLVIIYSDLFSEILFFINIILALYYIYPIFYEFV

SEQ ID NO: 7086 - protein, 253 aa, Staphylococcus epidermidis
MRTPIIAGNWKMNKTVQEAKDFVNELPTLPDPKEVESVICAPTIQLDALVTAVKDGKAKGLKIGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQEVADATRIQYGGSVKPNNIKEYMAQSDIDGALVGGASLKVEDFVQLLEGAK

SEQ ID NO: 7087 - protein, 368 aa, Staphylococcus epidermidis
MKGPSIVVKGARAHNLKGVDIELPKNKLIVMTGLSGSGKSSLAFDTIYAEGQRRYVESLSAYARQFLGQMDKPDVDTIEGLSPAISIDQKTTSKNPRSTVATVTEIYDYIRLLYARVGKPYCPYHGIEIESQTVQQMVDRILELEERTKIQLLAPVISHRKGSHEKLIEDIGKKGYVRLRVDDEIVDVNEVPQLDKNKNHTIEVVVDRLVVKDGIETRLADSIETALELAEGNLTVDVINGEELKFSENHACPICGFSIGELEPRMFSFNSPFGACPTCDGLGQKLKVDLDLVIPDKNKTLNEGAIEPWEPTSSDFYPTLLKRVCEVYKINMDKPYKKLTDRQKNILMNGSGETEIDFTLHATKWCYS

SEQ ID NO: 7088 - protein, 51 aa, Staphylococcus epidermidis
PKMPCINVLHKDLFVVKRLEINVLTKYRKNTLTYLGFIFIILPSLKLYLNT

SEQ ID NO: 7089 - protein, 90 aa, Staphylococcus epidermidis
QQVPKGKRFALPNAEVMIHQPLGGAQGQATEIEIAANHILKTREKLNRILSERTGQSIEKIQQDTDRDNFLTAAEAKEYGLIDEVMEPEK

SEQ ID NO: 7090 - protein, 856 aa, Staphylococcus epidermidis
AKQFLVKGATRAMGFLSKIVDGNKKEIKRLGKLADKVLALEEDTAILTDEEIREKTKSFQKELAEIEDVKKQNDYLDKILPEAYALVREGSKRVFNMIPYKVQVMGGIAIHKGDIAEMRTGEGKTLTATMPTYLNALAGRGVHVITVNEYLSSSQSEEMAELYNYLGLTVGLNLNSKSTEEKREAYAQDITYSTNNELGFDYLRDNMVNYAEERVMRPLHFAIIDEVDSILIDEARTPLIISGEAEKSTSLYTQANVFAKMLKAEDDYNYDEKTKAVHLTEQGADKAERMFKVDNLYDVQNVEVISHINTALRAHVTLQRDVDYMVVDGEVLIVDQFTGRTMPGRRFSEGLHQAIEAKEGVAIQNESKTMASITFQNYFRMYNKLAGMTGTAKTEEEEFRNIYNMTVTQIPTNKPVQRKDNSDLIYISQKGKFDAVVEDVVEKHKKGQPVLLGTVAVETSEYISNLLKKRGVRHDVLNAKNHEREAEIVSNAGQKGAVTIATNMAGRGTDIKLGDGVEELGGLAVIGTERHESRRIDDQLRGRSGRQGDRGDSRFYLSLQDELMVRFGSERLQKMMNRLGMDDSTPIESKMVSRAVESAQKRVEGNNFDARKRILEYDEVLRKQREIIYNERNEIIDSEESSQVVNAMLRSTLQRAINHFINEEDDNPDYMPFINYVNDVFLQEGDLQDTEIKGKDSEDIFEIVWSKIEKAYAQQQETLGDQMSEFERMILLRSIDTHWTDHIDTMDQLRQGIHLRSYAQQNPLRDYQNEGHELFDIMMQNIEEDTCKYILKSVVQFEDDVVREKSKSFGEAKHVTAEDGKEKAKPQPIVKGDQVGRNDPCPCGSGKKYKNCHGKA

SEQ ID NO: 7091 - protein, 40 aa, Staphylococcus epidermidis
SLKFIETFATIFLYMITFDYTFLFILIPEKSFSKMIKNTE

SEQ ID NO: 7092 - protein, 44 aa, Staphylococcus epidermidis
GVKLFSNSKHTLKLSYHNYEFAYNYFFLSLGVKRIVLVNSKASS

SEQ ID NO: 7093 - protein, 250 aa, Staphylococcus epidermidis
NKITIVYEMRDRMTHVDIAATIAPEDKLSKTLLKDIKVNEESIDIIELRIDQWPSFNKALLNEVIKQLKIFHLKILVTYRTSVQGGKGAVNEQEYLNILGELIECPQFDMIDIEWSSAVKIEKYTHLVQRAQQKGLEVVLSHHNFQETPALDELKFIYFKMQKLNPEYLKLAVMPKCQEDVLHLLEAMSLTAKHTTCRIVGISMSSLGKVSRIAQGVFGGTLSYGCIEEPQAPGQIHVSKLKSMVSFYED

SEQ ID NO: 7094 - protein, 193 aa, Staphylococcus epidermidis
GEITMIRFEIHGDNLTITDAIRNYIEEKVGKLERYFNNVPNAVAHVRVKTYSNSTTKIEVTIPLKDVTLRAEERHDDLYAGIDLITNKLERQVRKYKTRVNRKHRDRGDQDIFVAEVQESTTNNHADDIESENDIEIIRSKQFSLKPMDSEEAVLQMNLLGHDFFIFTDRETDGTSIVYRRKDGKYGLIETTE

SEQ ID NO: 7095 - protein, 270 aa, Staphylococcus epidermidis
GGVTLKKLAFAITAASGAAAVLSHHDAEASTQHKVQSGESLWTIAQQYNTSVESIKQNNNLSNNMVFPGQVINVGGSASQNTSSNTSSSSASSHTVVAGESLNIIANKYGVSVDALMQANHLNGYLIMPNQILTIPNGGSGSGSGGTATQTSGNYTSPSFNHQNLYTEGQCTWYVFDKRSQAGKPISTYWSDAKYWASNAANDGYQVDNTPSVGAIMQSTPGPYGHVAYVERINGDGSILISEMNYANGPYNMNYRTIPASEVSSYAFIH

SEQ ID NO: 7096 - protein, 224 aa, Staphylococcus epidermidis
MNELGQTIIENYNTFAPKNMFSEWLKNLLQPLATLSLGFFVYKYTDNRHKKRLLNELDSKSEWRKTLFIIGGNSTVTLDDVYQFRTALRFNFKNNGNYIDKEKSKKEGFSYFFDNMNIIIIKYCINLIEKKQAVSNSIDLDIKDQNSIRLFCRYMLADHWEKNQNKNLKFDDPNKEEELCIFTLKEFLKLHKYYQNSKDEDSKNKFKSLFDESKELVEKKDTPS

SEQ ID NO: 7097 - protein, 183 aa, Staphylococcus epidermidis
SLATQQQKLFFKLLFFTLVHVRAKLEPSHGAILTTMMIFIHINKTDYHGEVTAPKTKAAIRDIYLPFHMMNDIEKYLKWYKENNVYKDDYVLFGTFFKAYSESTIDRWFTTALKVLDEQLPDVQTFPRIVIHELRHSHASMLVNHGASIMVIAQRLGHADSNEVYNRYGHLYPSTQKEIVKYL

SEQ ID NO: 7098 - protein, 41 aa, Staphylococcus epidermidis
LLYTNFLLYIFYTHFNRYYLINEKNSYNKSKKFMNHQKERL

SEQ ID NO: 7099 - protein, 517 aa, Staphylococcus epidermidis
RFRTIVRRCKIIMAKQPTALIILDGFANRESEHGNAVKQAHKPNFDRYYEKYPTTQIEASGLDVGLPEGQMGNSEVGHMNIGAGRIVYQSLTRINKSIEDGEFFDNTVLNNTVKHVKDNGSALHVFGLLSDGGVHSHYKHLFAILELAKKQGIDKVYVHAFLDGRDVDQKSALKYIEETEDKFKELGVGQFASVSGRYYAMDRDKRWDREERAYNAIRNFEGPTFTSAKAGVEANYKNDVTDEFVEPFIVEGQNDGVNDGDAVIFYNFRPDRAAQLSEIFTNKAFDGFKVEQVDNLFYATFTKYNDNVDAEIVFEKVDLNNTIGEVAQDNGLKQLRIAETEKYPHVTYFMSGGRNEEFEGERRRLIDSPKVATYDLKPEMSAYEVKDALLEELDKGDLDLILLNFANPDMVGHSGMLEPTIKAIEAVDECLGEVVDKIIDMGGHAIITADHGNSDQVLTDDDQPMTTHTTNPVPVIVTKEGVTLRETGRLGDLAPTLLDLLNVKQPSEMTGESLIKH

SEQ ID NO: 7100 - protein, 240 aa, Staphylococcus epidermidis
IMRTNDKVLLENINDYFSHKGMSPHLIDDIKEKYRQDIKKSEEKDQDYIEYRGKSPAQLILTIQRNLFALQLNPMIFFIINFILISYLYDKQYVPFQAITGISLFYCLVIFPITLILYVRIAKKNYLYSNKYEMRTGIIIGIIALILVIMQGFHFNWAIIPISIYGHQFVFFAGIILSLVGIFFKRIEFVGVGLLFCQKTIDAMVTDPEIAQFFSLAIWIILVVLIIFYTIRLSERTKSS

SEQ ID NO: 7101 - protein, 315 aa, Staphylococcus epidermidis
ESWFLSLFFLYLLGIFVGMLLPIQTSINSRLSQFTRSSFYASTISFAVGTICLLVLNIIIHPQVLTPEFFSKQTLNYTWVLGGLLGVIYLTGNLLLLPRLGAALTVVITVTGQIIMGVIIDTFGLLGAHQQSFTLFKGVGIIFLITGIIFMNYVRRHPVNRHKNTPIVFWLLIGFVFGFAPPIQTTINSTLAQHTHSSIFASLISFSVGTIALFILTLVFNRSLKISSTHKTLGKIKSIYFIGGILGMAFVTSNIILMPFLGAALTTIIAMMGQMIMGIIIDHFGLLGSPKNKITSRKLGGLLCIAIGIILLRLF

SEQ ID NO: 7102 - protein, 45 aa, Staphylococcus epidermidis
DIITRLRFFLYYSSVTKVNTYVFNSVTHCIGETINTNSISPNFKF

SEQ ID NO: 7103 - protein, 170 aa, Staphylococcus epidermidis
WEVTMNNIRLLNQNDLDSYIELMKFGHHNYEWDRYYLENVSIDRLKTILSNHTDYWNIFGAFEDDELVATCTLKQMNYVGKCHKAILENNFVKNNDEIVNRELINHIIQYAKEQNIETLMIAIASNNISAKVFFSSIGFENLAFEKNASKIGNEYFDENWLIYSTTESSD

SEQ ID NO: 7104 - protein, 58 aa, Staphylococcus epidermidis
TNLTRCFMCKEYNMTQHTLPMETSVLIPTNNISRHVNDIVETIPDTEFDEFSHHRGLI

SEQ ID NO: 7105 - protein, 58 aa, Staphylococcus epidermidis
TKLTRCLMYKEYNLTQHTLPMETSVLIPTNDISRHVNDIVETIPDTEFDEFRHHCGLI

SEQ ID NO: 7106 - protein, 60 aa, Staphylococcus epidermidis
TKLTGCLMYKNYHMTKHTLPMETSVIISTHDMSQYVNDIVKKFQVLNSDSIVAQHYSIPK

SEQ ID NO: 7107 - protein, 382 aa, Staphylococcus epidermidis
IMLTEKEQDIIKQTVPLLQDKGTEITSIFYPKMFEANPELLNMFNQTNQKKGMQSAALAQAVLAAAMNINNLGAIKPAIMPVAHKHCALQVYPEHYPIVGENLLAAIQDVTGLESDDPVIQTWAKAYGEIADVFIKLEQEIYNHMLWKGFKPFKITNITQETSDIKSFTVESEEYDLSQFEPGQYITVDVSSEKLPYRAKRHYSIIDGDENHLVFGVKRDVTTEHEGEVSTILHDEISEGDMINLSAPVGGFSIENTERPQLFIGSGVGMTPLVSMFKKAASLNVPTQMIQAVVTEDERPFAQKLDSITDNYEQAQLHLHVKDKEGYLEAKELEQYLSEQPEIYICGGTKFLHSIINSLKELNYDMNHVHFETFIPRLSVQV

SEQ ID NO: 7108 - protein, 55 aa, Staphylococcus epidermidis
QSITKLIYDYFKFFRTQHREFHRVNSTGKAGWGSGFRTWGNEFNLKFDTCTQLIK

SEQ ID NO: 7109 - protein, 67 aa, Staphylococcus epidermidis
IFVTNPLIKREYSIKIIPQSTSRTLLLNHYYTLIFGKVKDFLYFINCRALNNVKSYLNKALYRLIVY

SEQ ID NO: 7110 - protein, 253 aa, Staphylococcus epidermidis
MSSTLEIKDLHVSIEDKEILKGVNLTINTGEIHAIMGPNGTGKSTLSSAIMGHPSYEVTQGEVLLDGVNILELDVDERAKAGLFLAMQYPSEITGVTNADFMRSAINAKREEGQEINLMQFIKKLDKQMDFLDIDKDMAQRYLNEGFSGGEKKRNEILQLMMLEPKFAILDEIDSGLDIDALKVVSKGINQMRGEEFGALMITHYQRLLNYITPDKVHVMYGGKVVKSGGPELAKRLEEEGYEWVKEEFGAAE

SEQ ID NO: 7111 - protein, 82 aa, Staphylococcus epidermidis
SNTTAFLGFFGTSTVLEIFFLSLPLFSLPLASKLFLMVTVSLESLFFFFEVELLFELLLQAVKTKTRDNNKNKTVFFICATP

SEQ ID NO: 7112 - protein, 277 aa, Staphylococcus epidermidis
VNKTIRDIILVMIGSFIFSAGINAFVISGNLGEGGVTGIAIVLYYAFHISPGITNFVLNAILIIVGYKYLSKRSTYLTIFATVLISIFLGLTETWHVETGNVVINAVFGGTCVGLGIGIIVLAGGTTAGTVILARIVNKYLDISTPYALLFFDLIVVLISLTEIPLVKCLVTVMSLYIGTKVMEFVIEGLNTKKAMTIISSRPNEVAKAIDQQVGRGLTILNGHGYYTREEKDVLYVVISKTQVSRAKRIIKNIDENAFLVIHDVRDVYGNGFLLDE

SEQ ID NO: 7113 - protein, 266 aa, Staphylococcus epidermidis
MKKTLTVTLSSIAAFIAINTAANAQESETSQLDTYATGDVITNQSNLGIYIVKPGDSLYKIALEHNLSLEELYALNPGVEPLIFPGDEIVVSETAFEQFNNTNTFVNYETNYIPVGYNNVSTDTSNTTYDNYDSESTDTYSVSNAYDGLRSVSNSANLYTTGQCTYYAFDRRAELGKPIGSLWGNASNWAYSANQAGFNVDHTPEVGAVFQSGPGQNGAGAYGHVGVVESINSNGSVTVSEMNWNGGVNVKSYRTISNPNSYNYIH

SEQ ID NO: 7114 - protein, 281 aa, Staphylococcus epidermidis
CTMTNDVQILNNGYPMPAVGLGVYKIADEQMEEVVRTALDAGYRAFDTAYFYGNEKALGSALKHSNVERDELFITSKLWNDYQGYDQTIEYFNKSLDNLGLDYLDLFLIHWPCENDQLYIESYKALEHLYEEGKIKAIGVCNFKIHHLEKLMKETKITPQVNQIELHPYFNQQDVQDFCDEHDIKVTAWMPLMRNKGLLDDPVITDIAHRYDKTPAQIVLRWHLAHNRIIIPKSQTPKRIKENFDIFDFNLELTDVAEIDSLNKNARQGKDPDDVSIGDLK

SEQ ID NO: 7115 - protein, 319 aa, Staphylococcus epidermidis
TSMTKQRIVISSLLFIFILTTCSFSYITFSKLTSRTEDIKNIKTIKAKPKLLLSTTGIQAPLNSYIFYYTPTLGQLQKLLVKNHSKVSKNTPVLEYYNYEKDHLYEELQNTLSNERNNKTLNSKNDLHYYSFLNQLKLQMIQTKSSIKSTLFSPINGSISYINSIPSKPNEKIVQINSNERIIRANISESELNLLKINQNISVTSSDNTQFTSKIKEISNIPSKIKNGVSYYDILLSTQPNHQIGTHFKIKLASNDIKLPTSAIVQKRYVLILKNGKITKREVTYKKSLKSGYINITKGLLIDEKVVKNPTSKLINIYI

SEQ ID NO: 7116 - protein, 164 aa, Staphylococcus epidermidis
IEMTAILWILIIIAFALAFIGLIKPVIPSLLMLWIGFLIYQFGFHEGRLSWIFYVAMIIFTIMILVADFVMNKYFVNRFGGSKIGEYTALIGVIVGCFVFPPFGIIIIPFVAVFIVELVQGFNFQQAIKVSFGSVIAFLASTIAQGLIMIVMVIWFFLDVFLIN

SEQ ID NO: 7117 - protein, 97 aa, Staphylococcus epidermidis
LNATSAPSTIFFPKTLITFSKFIPDINPPTSALINKLMTTFNRHKHSMIINMTAITTAFIILPHPLSLYRTKVFIKYILARHIFNVNVKKDSTIIYI

SEQ ID NO: 7118 - protein, 524 aa, Staphylococcus epidermidis
NKETIKMAKGDQYQAHTEKYHDKKSKKSYKPVWIIISFIILITILLLPTPAGLPVMAKAALAILAFAVVMWVTEAVTYPVSATLILGLMILLLGLSPVQDLSEKLGNPKSGDIILKGSDILGTNNALSHAFSGFSTSAVALVAAALFLAVAMQETNLHKRLALLVLSIVGNKTRNIVIGAILVSIVLAFFVPSATARAGAVVPILLGMIAAFNVSKDSRLASLLIITAVQAVSIWNIGIKTAAAQNIVAINFINQNLGHDVSWGEWFLYAAPWSIIMSIALYFIMIKFMPPEHDAIEGGKELIKKELNKLGPVSHREWRLIVISVLLLFFWSTEKVLHPIDSASITLVALGIILMPKIGVITWKGVEKKIPWGTIIVFGVGISLGNVLLKTGAAQWLSDQTFGLMGLKHLPIIATIALITLFNILIHLGFASATSLASALIPVFISLTSTLNLGDHAIGFVLIQQFVISFGFLLPVSAPQNMLAYGTGTFTVKDFLKTGIPLTIVGYILVIVFSLTYWKWLGLV

SEQ ID NO: 7119 - protein, 647 aa, Staphylococcus epidermidis
QNFFENSIVDNFQYLKRKISMEAYKIEHLNKSYADKEIFNDLNLSISEHERIGLVGINGTGKSTLLKVIGGLDEDFTADITHPNQYRIRYSSQKQDLNGHMTVFEAVLSSDTPTLRIIKKYEEAVNRYALDQSDSNFNKMMEAQEEMDQKDAWDYNAEIKTILSKLGIHDTTKKIVELSGGQQKRVVLAKTLIEQPDLLLLDEPTNHLDFESIRWLINYVKQYPHTVLFVTHDRYFLNEVSTRIIELDRGKLKTYPGNYEDYIVMRAENELVEQKQQEKQKALYKQELAWMRAGAKARTTKQQARINRFNQLESDVKTQHTQDKGELNLAYSRLGKQVYELKNLSKSINNKVLFEDVTEIIQSGRRIGIVGPNGAGKTTLLNILSNEDQDYEGELKIGQTVKVAYFKQTEKTLDRDIRVIDYLREESEMAKEKDGTSISVTQLLERFLFPSATHGKKVYKLSGGEQKRLYLLRLLVHKPNVLLLDEPTNDLDTETLTILEDYIDDFGGSVITVSHDRYFLNKVVQEYWFIHDGKIEKIIGSFEDYESFKKEHERQAMLSKQTEQQNKHKHQPKKKTGLSYKEKLEYETIMTRIEMTETRLEDLEQEMINASDNYARIKELNEDKEQLEATYEADITRWSELEEIKEQ

SEQ ID NO: 7120 - protein, 170 aa, Staphylococcus epidermidis
EDIAMQHLIKKHVLNGEFELVRQLMSETDFMEFEEAYISSAHEVESMMFYTCILDMIKVEESSELHDLAFLLLVYPLSEYEGALDSAYYHADSSIKLTDGNEVKSLLQMLLLHAIPEPVISDKKAFDVAKRILKLDPSNNVARNVLKDTAKRMDNVVVDINELNNQRDAR

SEQ ID NO: 7121 - protein, 711 aa, Staphylococcus epidermidis
KYAAKVILEAATKAGAPKDCIQWIEVPSIEATKQLMNHKDIALVLATGGSGMVKSAYSTGKPALGVGPGNVPTYIEKTAHIKRAVNDIIGSKTFDNGMICASEQVMVVDKEVYTDVVKEFKLHQTYFVNKNELQQLEDAIMNEDKTAVKPDIVGKSAVDIAKLSGISVPEKTKLLVAEIDGIGKDYPLSREKLSPVLAMVTAKSTGHALQICEDILKFGGLGHTAVIHTEDSQLQQKFGLKMKACRVLVNTPSAVGGIGNMYNELIPSLTLGCGSYGRNSISHNVSAVDLLNIKTIAKRRNNMQWFKLPPKVYFEENSVMYLTEMDNVERVMIVCDPGMVNIGYTDIVEQVLRRRENQPQIKVFNEVEPNPSTHTVYKGLEMFINFQPNTIIALGGGSAMDAAKAIWMFFEHPETSFFGAKQKFLDIRKRTYKITKPKNAKFICIPTTSGTGSEVTPFAVITDSETHVKYPLADYALTPDIAIVDPQFVLSVPKDVAADTGMDVLTHAIESYVSVMASDYTRGLSLQAIKLTFDYLKSSVQENDKHSREKMHNASTMAGMAFANAFLGISHSIAHKIGGEYGIPHGRTNAILLPHVIRYNAKDPQKHALFPKYDFFRADTDYADIAKFLGLKGNTTEELVDALANAVYDLGCSVGIDMNLKSQGVTEELLHSTIDRMAELAFEDQCTTANPKEPLISELKGIIETAYDYER

SEQ ID NO: 7122 - protein, 50 aa, Staphylococcus epidermidis
NGAAPIISAGNAPVGPLIVPRSILVNGINSKINMINGIALNKLTMNDTIV

SEQ ID NO: 7123 - protein, 66 aa, Staphylococcus epidermidis
SIAALLNYVVQTLKFSSRHSIRILFFFGLESIYVACFIYNTMIQCHAKIKVCLKFRRYLTLNQVKR

SEQ ID NO: 7124 - protein, 358 aa, Staphylococcus epidermidis
SNYLKGLAMMKEKLKWIWITTLIILVVSLILAFNLKSHYNHVHDKQKSKTNVQINNKNVKLYRDISYGKGIPNSKLDIITPADMSNDTKLPVIFWMHGGGFIAGDKQYKNQLLSKVAEQGYIIVNVNYALAPQYKYPTPLVQLNQAVKFIKENKHELPIDFDQVVIGGDSAGAQLTSQYVAMQTNEDLRDEMHFEQQFKPSQIKAAVFFGGFYNMKTVKATEFPRIQLFMKSYTGTSHWETDFKNLSQMSTLNQVTHEYPPTFLSVGDADPFYSQNKEFAQGLKTENIPVDTLFYDGSHHLHHQYQFHLDKPESKENIKKVLLFLSRNTSSSGVESNESSQNQPTQNTNEVSLYPFDS

SEQ ID NO: 7125 - protein, 156 aa, Staphylococcus epidermidis
QFYAIMTFIIVRVKVSSKLNKNINIQTRQVLKQNGEKQRFEFTTKGSWQQKFADFIRYEEQIEDAKVNVTIKIEDSGVKLIRKGDINMNLHFVEGHETTTLYDVPTGKIPLTVKTLSLMHFVTHNGGKLKIHYELYQDEQKMGSYQYEINYKEISE

SEQ ID NO: 7126 - protein, 56 aa, Staphylococcus epidermidis
CATAIITFSLFRAVTFNALGIVEGSAISEWYRITLKYDGRPLKIPSLLCLILVICP

SEQ ID NO: 7127 - protein, 125 aa, Staphylococcus epidermidis
TLKAKMTFYCFIPTSKYLKTYLSLIAFIPGNSLPSKYSNDAPPPVEMCVKSSSKPNEIAAAAESPPPIIVVASSNLAIDSHTPIVPLAKLLNSNTPIGPFHTTVCAPCNSLLNNSTVLGPISIAS

SEQ ID NO: 7128 - protein, 40 aa, Staphylococcus epidermidis
KVYLFYNDYYISNVNSIIFVVKNLFEIKKRQCSYFNNDEN

SEQ ID NO: 7129 - protein, 666 aa, Staphylococcus epidermidis
EAYFGMVEHVPFKLKSEFEPQGDQPQAIQKIVDGVNEGKRHQTLLGATGTGKTFTMSNVIKEVGKPTLIIAHNKTLAGQLYSEFKEFFPENRVEYFVSYYDYYQPEAYVPSTDTFIEKDASINDEIDQLRHSATSSLFERDDVIIIASVSCIYGLGNPEEYKNLVVSVRVGMEMERSELLRKLVDVQYSRNDIDFQRGTFRVRGDVVEIFPASREEMCIRVEFFGDEIDRIREVNYLTGEVIREREHFTIFPASHFVTREEKMKVAIERIEKELEERLKELRDENKLLEAQRLEQRTNYDLEMMREMGFCSGIENYSVHLTLRPLGSTPYTLLDYFGDDWLVMIDESHVTLPQIRGMYNGDRARKQVLIDHGFRLPSALDNRPLKFEEFEEKTKQLVYVSATPGPYELEHTDEMVEQIIRPTGLLDPKIDVRPTENQIDDLLSEIQDRVDKDERVLVTTLTKKMSEDLTTYMKEAGIKVNYLHSEIKTLERIEIIRDLRMGTYDAIVGINLLREGIDIPEVSLVVILDADKEGFLRSDRSLIQTIGRAARNDKGEVIMYADKITDSMQYAIDETQRRREIQIAHNKEHGITPKTINKKIHDVISATVESDETNQQQQTELPKKMTKKERQKTIENIEKEMKKAAKDLDFEKATELRDMLFELKAEG

SEQ ID NO: 7130 - protein, 148 aa, Staphylococcus epidermidis
GGRALASIREDVQFSNPTISESSFKINENFDSENFEGFGDIKLNLKKYYYEENNEIDNNNNNNGSALLSLEIIIGDIAWQYPFMFKVEIESFFEWENFKGTDIDKFLEINGAAILYSYSRAHISHITNTSKYPSFDLPFYNFTDNDYQ

SEQ ID NO: 7131 - protein, 459 aa, Staphylococcus epidermidis
NLMAIGVILNRVFRLNNNPLFDYIYSNKESINHCYFIIPTEEFEEEAKKKAQYYYGSIQKFMYELQRYDIEPFLMSYDKLIDFCKKQAIDKVVVAGDIMSYHHEEYDILHQRKRFKQANIQVISLRANHYFNPRKTHNKQGEPYKVFTSFYRKWRPYLMIRDEYDYHLEDISKVVVKSQHKIKEDYHSYGISERDVQNRWSEFLSQDIENYKENREYLPEVLTSQLSIYLAYGMIDIIQVFNDLLQNYDKNEQNYETFIRELIFREFYYVLMTNYPETAHVAFKEKYQQLKWSYNEENFKLWKDGNTGFPIIDAAMEELKTTGFMHNRMRMVVSQFLTKDLFIDWIWGESFFKQKLIDYDAASNVHGWQWSASTGTDAVPYFRMFNPIRQSERFDNNARYIKTYIPRLNQVDAKYLHDTHKFEQQIKGQGVEIGKDYPKQMIDHKESRQRVMSEFKALD

SEQ ID NO: 7132 - protein, 158 aa, Staphylococcus epidermidis
VIVAKKKSKSPGTLAENRKARHDYNIEDTIEAGIALRGTEIKSIRRGSANLKDSFAQVRRGEMYLNNMHIAPYEEGNRFNHDPLRTRKLLLHKKEIQKLGERTREIGYSIIPLKLYLKHGQCKVLLGVARGKKKYDKRQALKEKAVKRDIDRAVKARY

SEQ ID NO: 7133 - protein, 55 aa, Staphylococcus epidermidis
KREAINSDEFYCTPLMFKFYFLQIYFTTKRDSSNLFLNSFCSALDFFLKVLRNAS

SEQ ID NO: 7134 - protein, 265 aa, Staphylococcus epidermidis
FMHFKRVVKWGLNMYQNQRIKDKINILGVSFDNTTMLEMVENIKQFISSNTDDNLFIVTANPEIVDYATEHELYRNLINQADYVVPDGTGIVKASKRLKQPLKRRVPGIELLEECLKIAHVSHQRVYLLGSKNEIVESAEKKLQSQYPNIHFAHHHGYIHLEDETVIKRITSFNPDYIFVGMGFPKQEQWIQKHKDKFKHTVMMGVGGSFEVFSGSKKRAPQIFRKLNIEWVYRVLIDWKRIGRMISIPKFMLKVAIQKYKMKSK

SEQ ID NO: 7135 - protein, 108 aa, Staphylococcus epidermidis
GFNFGGDTMIEMFTQIFIISALVIFGMALLVCLVRLIKGPTTADRVVSFDASSAVVMSIVGVMSVIFNSVSYLDSIMLIAIISFVSSVSISRFIGEGRVFNGNHKRHR

SEQ ID NO: 7136 - protein, 203 aa, Staphylococcus epidermidis
RVNFILKYRQNKHFRLNGVFKMVIYIETERLNLRDWETKDLLPFQKMNANAQVRRYFPSLLSYRRSEIDMENMDSIIQESGLGLFAVELKETGEWLGFIGVNYVSKDSHYPFKELPFYEIGWRLIPEVWGNGLATEGAEAVMKYARDKGIKELYSFTSENNLPSRKVMEKLGMTFLDNFEYPNLSKYHPLKRHVRYYKELLPS

SEQ ID NO: 7137 - protein, 43 aa, Staphylococcus epidermidis
KDNLSCSANLSFNHYILWLFIYFKGYLQIEKILRKSNYFQLFL

SEQ ID NO: 7138 - protein, 41 aa, Staphylococcus epidermidis
IAFYHCVIYHFKDNYDMNFSLQYIYLIFTFYIFTKYLKWNF

SEQ ID NO: 7139 - protein, 49 aa, Staphylococcus epidermidis
KIFYLRHTHHCRFYGENKKISNTLLYVNQFNVIVIFKPLTTVISSQEQK

SEQ ID NO: 7140 - protein, 256 aa, Staphylococcus epidermidis
ATLYWLRYHLKKSSLILETVITEVKISMTHLLIVDDEKDIVDICQTYFEYEGYQVTTTTCGKEALKLLSSDIDIMILDIMMPEVSGYDIVKKMKDMQLDIPFIYLTAKTQEHDTIYALTLGADDYIKKPFSPRELVLRTNNLLARMSKSNHSNKIEQLEFDGLVLKNLSKTLTINNIEIPMRIKEFELLWYLASREGEVISKSELLEKVWGYDYYEDANTVNVHIHRIREKLEKHDFLPYTITTVWGLGYKFERSR

SEQ ID NO: 7141 - protein, 54 aa, Staphylococcus epidermidis
YRNLKSKFKYKSSNHTSIFVSILSIKYSFNWLIQNLSKQNKLRHLLRIRTPKLD

SEQ ID NO: 7142 - protein, 68 aa, Staphylococcus epidermidis
KEVYMLYVIIGFFIIGIGLYIFSFFLAQNQGLSYKSHCRNFSAVFISLGVLCLMGYLVHYVSKHYLGI

SEQ ID NO: 7143 - protein, 60 aa, Staphylococcus epidermidis
LLYYSKKVKSNGLSGAISGGAEQLFGKQKQRGVDLFLHRLTIILAILFFVLMFCISYLGM

SEQ ID NO: 7144 - protein, 60 aa, Staphylococcus epidermidis
KTHYIELYFITIYLINIKKSNEICLINSDISTFFNKCSEQYIILTMLQDNNKAHKVKYFC

SEQ ID NO: 7145 - protein, 43 aa, Staphylococcus epidermidis
IMNLIVDVLLLMKNKKMTNVINISKDKLWDRTPSEFYPTFCFI

SEQ ID NO: 7146 - protein, 47 aa, Staphylococcus epidermidis
NKHYFWFVYCFISKNKVNQFNKLKNRRLSLILKYMILHKCYYKKNHS

SEQ ID NO: 7147 - protein, 115 aa, Staphylococcus epidermidis
IMNLILLLVIGFLVFIGTYMILSINLIRIVIGISIYTHAGNLIIMSMGKYGPHMSEPLIQGHAQNFVDPLLQAIVLTAIVIGFGMTAFLLVLIYRTYRVTKEDEISALKGDEDDE

SEQ ID NO: 7148 - protein, 47 aa, Staphylococcus epidermidis
LKNYSLMDSILYKIKFYSLLDINKNSYLFVICQFRKKATVLESMYAQ

SEQ ID NO: 7149 - protein, 82 aa, Staphylococcus epidermidis
WICYKYLVQKHVEVFYMNNGTVKWFNAEKGFGFIERENGGDVFVHFSAIVEDGYKSLEEGQSVEFDIVEGERGEQAANVVKM

SEQ ID NO: 7150 - protein, 144 aa, Staphylococcus epidermidis
HYCYKRSCFKWFFGHCSLAIDHDTVLQIEGPGDKPMTEDFESYRDRYGKGKNEWIKVYRCSHPNAGTKAAQWAKKHYENSDSEYLVTFNLKSETFTYCTKIIYQAYKYGVDKNSVSDHGLYIISPYALTDNFTDEYKLKLVKTY

SEQ ID NO: 7151 - protein, 47 aa, Staphylococcus epidermidis
IQSYFVFEIILHLRIFFDYFRTRNPITLVQYYNLVNKYIGGESHVHH

SEQ ID NO: 7152 - protein, 44 aa, Staphylococcus epidermidis
NCGYVNFVIFSSRDKTGCWRTSINDYYILNLHNFYNIRIASYFL

SEQ ID NO: 7153 - protein, 42 aa, Staphylococcus epidermidis
PQFYLQILNKLDIKFLHKCLIILLKMMSDKIMETLLSTPTLK

SEQ ID NO: 7154 - protein, 47 aa, Staphylococcus epidermidis
IQVLFHLSHRLPIYNKILRQNLVSQDFVIYYLIKKFHFVSIHFYYFF

SEQ ID NO: 7155 - protein, 41 aa, Staphylococcus epidermidis
SKVLMWDIKNKFAINFKIIGMLTILEKKGGSYEKTIIHSLF

SEQ ID NO: 7156 - protein, 50 aa, Staphylococcus epidermidis
QPNYNPNNKYLNMSNQEWRNKTRNRLSSSEMQIRDEILNDNYEEITHRKF

SEQ ID NO: 7157 - protein, 72 aa, Staphylococcus epidermidis
VMLYSLHIKHLVKLVYWYLLNYTKGPYFLKYFNIKLHISTKYFGETLERTGQAEDYRLKLSDKKASQQYEVL

SEQ ID NO: 7158 - protein, 40 aa, Staphylococcus epidermidis
FTIYLSDFYFLYFYKVFKVEFLEDLTLCFNKCNELLWLIV

SEQ ID NO: 7159 - protein, 69 aa, Staphylococcus epidermidis
DYQYVILCILLMMNNDEQQKNESVCFTYYISVQTPKVLLILQKLLYHVKNRVKMTFLQNLYKKPRPSTH

SEQ ID NO: 7160 - protein, 47 aa, Staphylococcus epidermidis
YPQYPINTRFYKKPKPSKIIHELSILYQLWFQLHYPCQFLIIFFLIY

SEQ ID NO: 7161 - protein, 185 aa, Staphylococcus epidermidis
TEGYKMKLKLLGTLALSSIILTACGQENVKKTESNPKEEQNKTDNMQTNGSVTNSNSNQKQKTAQKQISAQEAEQIVSNYYINKGINKQQVLEFKTNIDRSNANEYYVEHLVRDAAGTPIKFCAVVNKSTGEVINRFNDMNEEEMKEFEEFKKRSPKYHNSGEEKNKMQENSSSSEQQEVHNSVI

SEQ ID NO: 7162 - protein, 40 aa, Staphylococcus epidermidis
IDLYIIDYNIAEVELRILISLLNKVIMINRIRVTNTHMYS

SEQ ID NO: 7163 - protein, 52 aa, Staphylococcus epidermidis
NFMYHINYRYSISEALMPLFLIVFKNYYLIELFFTLALFLFSCFIHLLISMI

SEQ ID NO: 7164 - protein, 48 aa, Staphylococcus epidermidis
SGAYYLAQCISISRCYSTRIYVKLHKIDTREPVTYLYVQALTLFSPYY

SEQ ID NO: 7165 - protein, 72 aa, Staphylococcus epidermidis
VFKYSFKEGNIMKMNPRYVKVFFLYLVSTFISNRLTTNKSLCKTLMQGILGYGLFALGLKYLTIKKKQHQAQ

SEQ ID NO: 7166 - protein, 722 aa, Staphylococcus epidermidis
SLKYKGQIKTLLNLRIRWAISMKTMEEKKYNHIELNNEVTKRKDNGFFDLEKDQEALKVYLEEIHDKMISFDDEIERLHYLVDNNFYFNVFEKYSEAELIEITEYAKSIHFQFASYMSASKFYKDYALKTNDKTKFLEDYNQHVAIVALYLANGNVKQAKQFISAMVEQRYQPATPTFLNAGRARRGELVSCFLLEVDDSLNSINFIDSTAKQLSKIGGGVAINLSKLRARGEAIKGIKGVAKGVLPVAKALEGGFSYADQLGQRPGAGAVYLNIFHYDVEEFLDTKKVNADEDLRLSTISTGLIVPSKFFDLAKEGKDFYMFAPHTVKQEYGVTLDDIDLEKYYDDMVANPNIDKKKKDAREMLNMIAQTQLQSGYPYLMFKDNANKVHANSNIGQIKVSNLCTEIFQLQETSVINDYGIEDEIKRDISCNLGSLNIVNVMESGKFRDSVFTGMDALTVVSDEANIQNAPGVKKANSELHSVGLGVMNLHGYLAKNKIGYESEEAKDFANIFFMIMNYYSIERSMEIAKERGEKYQDFEQSDYANGKYFEFYTSQEFEPKFEKVRQLFDGIDIPTSNDWKELQNKVEQYGLYHAYRLAIAPTQSISYVQNATSSVMPIVDQIERRTYGNAETFYPMPFLSPETMWYYKSAFNTDQMKLIDLVATIQTHVDQGISTILYVNSEISTRELSRLYVYAHHKGLKSLYYTRNKLLSVEECTSCAI

SEQ ID NO: 7167 - protein, 215 aa, Staphylococcus epidermidis
MLDFINHLLSYQFLNRALITSILVGIVCGTMGSIIVLRGLSLMGDAMSHAVLPGVALSFLFNIPMFIGALVTGMLASLFIGFITSNSKTKPDAAIGISFTAFLASGVIIISLINSTTDLYHILFGNLLAITHQSFWTTIVITVLVILLIIIFYRPLMISTFDATFSRMSGLNTTLIHYFVMLLLRTCNCCEHTNSWNYPCSCFTNHSSFYSFFNQ

SEQ ID NO: 7168 - protein, 343 aa, Staphylococcus epidermidis
IIDLHWFKTLYFIHKYDRRILMKAVNWNTQEDMTNMFWRQNISQMWVETEFKVSKDIASWKTLTDSEKNTFKKALAGLTGLDTHQADDGMPLIMLHTTDLRKKAVYSFMAMMEQIHAKSYSHIFTTLLPSSETNYLLDTWVIEEPHLKYKSDKIVENYHKLWGKEASIYDQYIARVSSVFLETFLFYSGFYYPLYLAGQGKMTTSGEIIRKILLDESIHGVFTGLDAQSLRNELSESEKQKADQEMYKLLNELYDNEVSYTHLLYDDIGLAEDVLNYVRYNGNKALSNLGFEPYFEEREFNPIIENALDTSTKNHDFFSVKGDGYTLALNVEPLRDEDFVFDN

SEQ ID NO: 7169 - protein, 41 aa, Staphylococcus epidermidis
LIFQKISCGIEHQVSSIPLFVLYKDTHHLRNNKLLYIKITQ

SEQ ID NO: 7170 - protein, 43 aa, Staphylococcus epidermidis
SLLHTFMIKNVYFNREKFKVKKYMNKYICSSELTKLKMHAYIK

SEQ ID NO: 7171 - protein, 226 aa, Staphylococcus epidermidis
QLIQYPKMKFRNFTIKLKFWSGYNMHLFETMKLDKGFIPRLDYHYQRISTSSEHLGFQFDHLFWKQFIHNIKTLHSKGVFRLKVTLNKEGELNYELFPIPDKPFFTARLVQQKKNIDKVIITNKTTERDYLTHNHFTDLILIYDEDGKILEFDIGNVMIQERDKLYTPTYKGDMLPGCMRQSLIDQGKVIEKDFYIEEFKEKIKSSQINVYLINSLREVVGVKVYV

SEQ ID NO: 7172 - protein, 378 aa, Staphylococcus epidermidis
QIVQRKGCHLMKIRVIVPCYNEGEVVLKTYDKLTEIMKKDSLIKNYEYDLLFINDGSTDTTIHHIKNIVAYDNHVKYLSFSRNFGKEAAMIAGYQHSTMHDAVIMIDGDLQHPPEYIPQMIEGYIEGYDQVVAKRNRQGENFVRKTLSRCYYKLINAFVEDIQFEDGVGDFRLLSRRAVQALTTLDEYNRFSKGLFEWIGYETKVFKYENVTREDGESKWTFRKLLNYGIDGLISFNNKPLRMMIYLGMFTFSISILYIIYLLINILINGINIPGYFTTIAAILLLGGIQLMSIGVVGEYIGRIYYEVKHRPKYIVENSNIQTENLDMRYNALNLNKNRNNKRSNDLYKLSSFYKVKTYSDTYASNYSQDEGFKERVH

SEQ ID NO: 7173 - protein, 49 aa, Staphylococcus epidermidis
WKAHFLNSQSLDKKENIPRSSNNVILCTLTFKIFMKGDYYEKIQMDKYI

SEQ ID NO: 7174 - protein, 41 aa, Staphylococcus epidermidis
YKCHLSLQSDLQLFNINRNVCFIQHHKLSKALYISVYNHIS

SEQ ID NO: 7175 - protein, 40 aa, Staphylococcus epidermidis
NYSHNGRIINSISEGISTTLSTFITKRHKDKTGIIKFSIH

SEQ ID NO: 7176 - protein, 74 aa, Staphylococcus epidermidis
NGFHCKSVEDITETQAIANNEVKGKDLIKHIKITLGDFKDFQVKHDFDDANLLNMIAPVATMASKVKDMPSDCY

SEQ ID NO: 7177 - protein, 86 aa, Staphylococcus epidermidis
AVLHLTPFARFEAPTPRIDEDTTCVVDNGKCNDDATKIVNAEEISAAAPLAGLIFIIFPPTVLMIFQPPTAVPNPIAVAHATLTHT

SEQ ID NO: 7178 - protein, 40 aa, Staphylococcus epidermidis
IQSHPFYVYIIQKISNESKNEISEIVKQPNIQPHPECVQP

SEQ ID NO: 7179 - protein, 375 aa, Staphylococcus epidermidis
QILHSVRYNLFNEGELMYTLLLIAFTMIVSLIITPIIIVISKKLDLVDRPNFRKVHTKPISVMGGTVILFSFLIGIWLGHPIEREVKPLILGAITMYMVGLIDDIYDLRPYLKLAGQIVAALIVTFYGITIDFISLPIGPTIHFGIFSIPITVIWIVAITNAINLIDGLDGLASGVSALALMTIGFIAILQANIFIIMICCVLLGSLLGFLFYNFHPAKIFLGDSGALMIGFIIGFLSLLGFKNITFIALFFPIVILAVPFIDTLFAMIRRMKKGQHIMQADKSHLHHKLLALGYTHRQTVLLIYSIAIMFSLSSVILYLSQPLGALMMFILIVFTIELIVEFTGLIDDNYRPILNLITKKGNGKQHHYDEHHRS

SEQ ID NO: 7180 - protein, 283 aa, Staphylococcus epidermidis
GVTHMNITLGYIDPVAFSLGPIQVRWYGIIIACGILLGYFIAQAALKQVGLHKDTLIDIIFYSAIVGFIVARIYFVTFQWPYYMNHLSEIPKIWHGGIAIHGGLIGGLISGIIVCKIKNLHPFQIGDIVAPSIILAQGIGRWGNFMNHEAHGGPVSRAFLEHLHLPDFIIRNMYIEGQYYHPTFLYESIWDVIGFVILITLRKRLKLGETFFGYLIWYSVGRFFVEAMRTDSLMLTSHIRVAQLVSVVLIMISVIFVIYRRVKYQPIKYENSGPLTWPIKKAK

SEQ ID NO: 7181 - protein, 351 aa, Staphylococcus epidermidis
GVAHMKKTVLFLLLSLVLVLTACSNSSNNNSTSKKKNSDSKETVTIKNSFEASGKENNGSDKKKISNTVEVPKNPKNAVVLDYGALDVLKELGVADKVKGLPKGENNQSLPKFLDEFKDDKYINTGNLKEVNFDKVASAKPDVIFISGRTANQKNLDEFKKAAPKAKVVYVGTSDDNLIKDMKKNTENLGKIYDKEDKAKKINKDLDRKISDMKDKTKDFNKKVMYLLVNEGELSTFGPGGRFGGLVFDTLGFKPADKKVSKSPHGQNINNEYINKQNPDVILAMDRGSVVGGKATTNQVLKNKVIKNVKAVKSNHIYELDPKLWYFSSGSSTTTIKQIDELNEVVEKVEK

SEQ ID NO: 7182 - protein, 241 aa, Staphylococcus epidermidis
VGQHLRLLGKIGQCSMRDITIMRRFVGGEIMLSIEKLYQILYQNMGPQYWWPAETPIEMMLGAILVQNTNWNNADIALSRLKEETSFNAQTILKMPLESLQQVIRSSGFYKNKAKAIQALLLWLNQHHFDYSSIAKLYGDSLRKELLTIRGIGEETADVLIVYIFKGKEFIPDSYTRRIFRKLGYQHTESYHKLKQELTLPESFSNQDANEFHALLDNFGKNYFNGKGKQRYTFLDTYFKK

SEQ ID NO: 7183 - protein, 260 aa, Staphylococcus epidermidis
LVKHYQAYLIDLDGTMYKGTDEIDGAAQFIDYLNNNHIPHLYVTNNSTKTPVQVTEKLREMHIDAKPDEVVTSALATADYISEQHPNATVYMIGGHGLITALTDAGLSIKNDEHVDYVVIGLDEKVTYEKLSIATLAVRNGAKFISTNPDVSIPKERGFLPGNGAITSVVSVSTGIQPEFIGKPEPIIMSKSLDILGLEKSEVAMVGDLYDTDIMSGINVGIDTIHVQTGVSTYEDIQSKEIPPTYSFKDLNVAIAELEK

SEQ ID NO: 7184 - protein, 226 aa, Staphylococcus epidermidis
FVMQILLVEDDNTLFQELKKELEQWDFNVVGVEDFSHVMETFETFNPEIVILDVQLPKYDGFYWCRKMRQQSNVPILFLSSRDNPMDQVMSMELGADDYMQKPFYTNVLIAKLQAIYRRVYEFGVEEKRTLSWQDATVDLSKDSIQKDDKTIFLSKTEMIILEMLINKRNQIVTRDTLITALWDDEAFVSDNTLTVNVNRLRKKLSEIDMDSAIETKVGKGYLAHE

SEQ ID NO: 7185 - protein, 51 aa, Staphylococcus epidermidis
EWTQTFYNFCYLIKHCWILSRHVTCLLSEQLFHNHYYYIIIDKVVKIYKTR

SEQ ID NO: 7186 - protein, 45 aa, Staphylococcus epidermidis
FDWQQPFSIDNHLYYKMYINISINNNFILTRCNHFFLAIKHVFKK

SEQ ID NO: 7187 - protein, 56 aa, Staphylococcus epidermidis
FIFNKFNSDSDILARIIRSLLLICTIFSFGFEGIELIYEILPLIGENKVDLIEDLV

SEQ ID NO: 7188 - protein, 228 aa, Staphylococcus epidermidis; identical to SEQ ID NO: 6176

SEQ ID NO: 7189 - protein, 46 aa, Staphylococcus epidermidis
SNFNSIAFTLYFQATIGIVCEKFNLISDGNMKLTLLWISSDFSCFK

SEQ ID NO: 7190 - protein, 176 aa, Staphylococcus epidermidis
QNFKIYVEKNFNSGYFLSGGDNMKYKIEKLDDSSVVYMRMIGTYQSDKNFEMMKTFKHWIQTNHYWKYVEKYGVLGIALDNPLHVQSNQCRYDVVLRIDETVNDQTISKRDFTGGIYAVFKVSHTKINIEKFFSNLENILNESHLRMRNEPIIERYIEEEGTDKVCEMLVPIYEVN

SEQ ID NO: 7191 - protein, 87 aa, Staphylococcus epidermidis
EAFKMTEVDVDVAIIGAGPAGMTAAVYASRANLKTVMIERGMPGGQMANTEEVENFPGFEMITGPDLSTKMFEHAKKFGGGIPIWRY

SEQ ID NO: 7192 - protein, 44 aa, Staphylococcus epidermidis
LQFNNATHILFIQLLLQRINELKFVFKYTKHHFNLYFFINVHFL

SEQ ID NO: 7193 - protein, 163 aa, Staphylococcus epidermidis
CRFKIMMTANDWIDRLELISHPEGGYFKETMRGDGKGRASFSSIYFLLTQRDISHFHRIDADEVWYYHAGQTLKIHMITPKGEYHTVKLGRDIDCGECLQYCVPKGTIFASTLDSAEGYSLVGCMCQPGFEYEHFELLTQEYLIRQYPQYESIIKRLAISQED

SEQ ID NO: 7194 - protein, 40 aa, Staphylococcus epidermidis
NLFNVHFIIMIHQNSIGCMTPRNIHNLFLYFAYGSIILET

SEQ ID NO: 7195 - protein, 56 aa, Staphylococcus epidermidis
KYFLIKTFSIFFYQFKILLVDFNHIFTLQKNEIEALSIKNTINHLPISSIHTFIKI

SEQ ID NO: 7196 - protein, 62 aa, Staphylococcus epidermidis
LKLLFDSISKLSINETVGDGAEINDVVNKRDEYKESIRYYNNHLVLVKYNEKSICKLKYLRN

SEQ ID NO: 7197 - protein, 68 aa, Staphylococcus epidermidis
IPIKPSVGLKARDLLGRYHSLFTEKVDLNGATPVFIDSIDEDDEKNERDIENLSKQYPNAKFHIDDIR

SEQ ID NO: 7198 - protein, 453 aa, Staphylococcus epidermidis
STIKYINFKEGDHVMELTIYHTNDIHSHLNEYARIQAYMAKHRPQLEHPSLYIDIGDHVDLSAPVTEATVGHKNIELLNEAHCDIATIGNNEGMTISHDALQNLYNDADFKVICTNVIDEEGHLPHHITSSYIKEIKGTRILFVAATAPFTPFYRALDWIVTDPLAAIKDEINAHQGEYDLLMVMSHVGIFFDEKLCQEIPEIDVIFGSHTHHHFEHGEINNGVLMAAAGKYGYYLGEVNITIENGKIVDKIAKIHPIETLPLVETHFEEEGRALLSKPVVNHHVNLVKRTDVVTRTSYLLAESVYEFSRADCAIVNAGLIVNGIEADKVTEYDIHRMLPHPINIVRVRLTGKQLKQVIQKSQKQEYMHEHAQGLGFRGDIFGGYILYNLGFIESEDRYFIGDEEIQNDKQYTLGTVDMYTFGRYFPLLKGLSTDYIMPEFLRDIFKEKLLKL

SEQ ID NO: 7199 - protein, 431 aa, Staphylococcus epidermidis
SKIKYYGRLISPTHQLEDESVSQVSKGVIKDSERWYCIQCGNTSLQYFVTYNSTILDKTITYCRRCIQLGRMDSITDICLVKSFQKATKANYQLPFELSKQQQYASETIVQAIKNNNDLLLYAVTGAGKTEMMFEGIRIARQMGHNIAIVSPRVDVIIEISHRIKDAFIDEHIDVLHQSSRQQYNGHFVIATIHQLLRFKQHFDTVFLDEVDAFPLSMDPQLSNAIQLASKSNHSHIFMTATPPRHFLKQFPPEKIIKLPARFHRSPLPIPKFKYFKLKSTRKQNLLLNIFRYQINQQRFTLVFINNIEIMNKMYQQYKMDIPDLICVHSEDDLRFEKIEALRRGQHKIVFTTTILERGFTMTHLDVVVVDAGSFQQEALIQIAGRVGRKQQSPSGLVLFLHEGVTLSMILAKRNIISMNRLAIKRGWIDA

SEQ ID NO: 7200 - protein, 150 aa, Staphylococcus epidermidis
IKVNLTNKGGLTMELYSMPMFNKFLVNDIEKSSEWYQENLGFKSIFKFKNEQNQILMEHLRLAKYQDLMLISGKQFEVGNAVYTNILVPNIRILKQRISSQYIVEDLEGKPWNSIEMTIKDLDNHLITLTQSNIKNEEFNALMQHTSKTF

SEQ ID NO: 7201 - protein, 366 aa, Staphylococcus epidermidis
LMVNKGVGMEMFEAIIYNISVMVAGIYLFHRLQYSENKRMIFSKEYVTVLMTFVSLLLAAYPIPFQNEYLVHLTFVPLLFLGRYTNMIYTLTAAFIVSLVDVFIFGNSIIYGITLIVIAGIVSAVGPFLKQNDIISLLILNLISIIILLFLALLSPIYELVEILVLIPISFIITIASAITFVDIWHFFSLVNRYENEDKYDYLTGLGNVKEFDRHLNEVSSKAEEKKQSLALLLIDIDGFKDVNDHYSHQSGDAVLKQMSQLLKNYVPNQFKIFRNGGEEFSVVIRDYTLDQSVKLAENIRSGVEKSSFHLPNKEVIKLSVSIGVGYLTQEDRKSQRKVFKDADDMVHVAKSEGRNKVMFNPIVKL

SEQ ID NO: 7202 - protein, 46 aa, Staphylococcus epidermidis
SSCFRISIINVIFQKRTNVCIVLIEFVKIENDIHEKVIDLRCVKSL

SEQ ID NO: 7203 - protein, 51 aa, Staphylococcus epidermidis
CRFLIQINVYFELPTKILSLLAVFMSDSSYSNIYVESYILKLKIAFYFSIY

SEQ ID NO: 7204 - protein, 413 aa, Staphylococcus epidermidis
LQSKNRIEVEKMFTALLQIKNYKLFVVNMLLLGMGIAVTVPYLILFATKDLGMTTTQYGLLLALAAISQFIVNSIIARFSDTHHLNRKILIITALFMGAVSFSIYFYVHQIWLFIVLYALFQGLFAPAMPQLYASARESINASSSRDRAKFANTVLRSMFSLGFLFGPFIGAQLIELKGYSGLFGGTIAIILFTLILQVFFYKNLPVKNQISEQQHIEKIAPNMFKDKSLFIPFIAFILLHIGQWMYTMNMPLFVTDYLNEKERYVGYLASLCAGLEVPFMVILGILSAKLPTRTLLIIGSVFGGAFYFSIGVFKNFHMMLVGQICLAIFLAILLGLGISYFQDILPDFPGYASTLFANAMVIGQLGGNLLGGVMSHWVGLENVFFVSASSIFVGMILILFTKDQKITIEDVE

SEQ ID NO: 7205 - protein, 397 aa, Staphylococcus epidermidis
IMAKKIVSDLDLKGKVVLERADFNVPIKDGEITNDNRIVQALPTIEYIIEQGGKLVLFSHLGKVKEESDKEGLSLKPVAENLSKKLGKEVIFVPETRGEKLETAIENLNEGDVLLVENTRFEDLDGKKESKNDPELGKYWASLGDVFVNDAFGTAHREHASNVGISTHLETAAGYLMEKEIKFIGGVVNDPQKPVVAILGGAKVSDKINVIKNLVNIADKILIGGGMAYTFIKAQGKEIGLSLLEEDKIDFAKDLLENNGDQIVLPVDCKIAKEFSNDAKITEVSINEIPSDQEAMDIGPKTVELFNKELQGAHTVVWNGPMGVFEFSNFAKGTIGVCESIAKLEDATTIIGGGDSAAAAISLGFEDDFTHISTGGGASLEYLEGKELPGIKAINDK

SEQ ID NO: 7206 - protein, 40 aa, Staphylococcus epidermidis; identical to SEQ ID NO: 6180

SEQ ID NO: 7207 - protein, 175 aa, Staphylococcus epidermidis
EEHKETCRMKHQKNQSRFKLLIAGIIAGLLSGVVKLGWEVMFPPRTPSRDATNPPQQLLQLLGIPSNITHLTYNFSEHALPWISFIVHYSFSIAIAIIYIYIAKKYTKITLGYGALFGIVIWIVFHLILMPIMHVVPNAFDQPFSEHLSEFFGHIVWMMVIEMVRRYFYNIQLNK

SEQ ID NO: 7208 - protein, 280 aa, Staphylococcus epidermidis
YGHKRLRERGKDMANSCLHILSKKEYTATRCQDGILLFWPIEGSMHFQQFMKERILSDELYIVNNMDVFSISDNGITLEVYISSDWFTELGYSFFNYHYISDLIQSKKEIKELVAQLTLNFLDNDVDKEQDIINKIVHILANEAIIDKKIAEDQYMYDYYGELKDELNYIYNHIEERLTLKDISNKLYVSKSNLSTQFHLLLGMGFKKYIDTLKISKSIEMLLTTTKTISQISETLGFSNVSTYSRQFKNYLSVTPNAYRAMKKYDKYNGCSDDDVSEHF

SEQ ID NO: 7209 - protein, 55 aa, Staphylococcus epidermidis
FANKYGKVKAIASEMVPCTPHRVMISAYKLRLGLLSVTLSSSFLEIIFWNGLTDK

SEQ ID NO: 7210 - protein, 43 aa, Staphylococcus epidermidis
CTNNPCNLFTLLKFIHVSHIPSIECDNVNFFNLIKLTILLYPL

SEQ ID NO: 7211 - protein, 75 aa, Staphylococcus epidermidis
VSNKHNHLLFNNFVVYIIDLLFSSFLLYGLSFPIIQKLQIPIREGAFMNHNFICTRTTNFPFKKEVALYNILHDV

SEQ ID NO: 7212 - protein, 347 aa, Staphylococcus epidermidis
LMNNFRWFWFFIKSRINWILWILFLNIILLGVAYIDYEISVESVFYIVILNVGLSILFLLFTFVKEVRLSKHFYEDKEIEEIKHKDLAETPFQQQVIDYLYRHIAAQKEKVVEQQLQIKNHEQTITEFVHDIKTPVTAMKLLIDQENDDQRKRALLFEWSRINEMLDKQLYLTRLETHHRDMYFDYISLKRMVIDEIQVTRHISQAKGIGFELDFKDEQKVYTDVKWCRMMIRQVLSNSLKYSDNSTINLSGYNIEGHVVLKIKDYGRGISKRDLPRIFDRGFTSTTDRNDTASSGMGLYLVQSVKEQLGIEVKVDSIVGKGTTFYFIFPQQNEIIERMSKVTRLSF

SEQ ID NO: 7213 - protein, 318 aa, Staphylococcus epidermidis
NICNSKGYIKMKNNKNEKLKITIVSGFLGSGKTTFLTHYINELLKIDEKITVIMNEFGSFDVDGNHLSELVKVYPLLNGCVCCDMKSDLVQQIEMLSHNHETDHIIIEATGIAHPIELIMACQDPRIVQFVERPHVVSIVDALRFLQRQQYTDSTKRLMEEQLEVSDVLVVNKLDLISVEDRDALKNQLNEVNKYSSKIYTTYGQVNIEELSQFRDQLVMTHTHSHHHGINSMQYTFTTAIDRQLFYQFILRMPDNVLRLKGYVQFKDEPNVTYEFQYSFGMPDYEVINGDYPLTIVLIGEQLDVNRLKNKLDVLQFS

SEQ ID NO: 7214 - protein, 98 aa, Staphylococcus epidermidis; identical to SEQ ID NO: 6183

SEQ ID NO: 7215 - protein, 212 aa, Staphylococcus epidermidis
FSSKKKKTVPIKINNPVVVNTSLECKDNFLKLLAFHKSTTTKCPKPPKMISIGIVIMITGSFEKSIKLFLKRANPALLNAETEVNKLKNRPLPMPNFGINDKHRQSVPNNSVAMLYMARCLISLITPPGSSIFQVIINKILLLIDIFLFKKMRVSIATVTIPNPPICISNKIMISPKILNCVPTSTGDRPVTVNALEATNNASIKLMGFFPV

SEQ ID NO: 7216 - protein, 232 aa, Staphylococcus epidermidis
NMGKSYGEIFHEMVTMPNVQWPEVWQAILETLYMTVVSTLFAFVFGLILGVLLFLSAKSNSLAAKIFYTIVSFIVNLFRAIPFIILILLLIPFTSILLGTISGPTGALPALIIGAAPFYARLVEIAFKEIDKGVIEAAWSMGANTSIVVRKVLLPEAMPALISGITVTAIALVGSTAIAGVIGAGGLGNLAYLTGFTRNQNDVILVSTVFILIIVFIIQFLGDWLTNKIDKR

SEQ ID NO: 7217 - protein, 353 aa, Staphylococcus epidermidis
LPLKYLCYKDIRRKVVVKDLIKVQQKLIPDLIDKMYRRFYILSTISQNQPVGRRSLSEHMDMTERVLRSETDMLKKQELIRVKPTGMEITNEGTEVLAQLGEYFNVYSDDHKLASAIKDKFHIKDVHVIPGDSDSNRTVKREMGQQAGQLLEGILYEDAIVSVTGGSTMACVSESIHLLPFNVFFVPARGGLGENVVYQANTIASSMAQQAGGYYTTLYVPDNVSESTYDTLMLEPSVMHTLDKIKQANITIHGIGDALKMAHRRQSSQNVIDNLQHHQAVGEAFGYYFDAQGQIVHKVKTIGLQLEDLENKDFIFAVAGGQSKGEAIKAYLSIAPENTVLITDEAAAKVILQ

SEQ ID NO: 7218 - protein, 50 aa, Staphylococcus epidermidis
FVYKVFSFLNCFIHFPVSGYNWCSHSLHSLIFSVKFVSFYPNTCLFRNKR

SEQ ID NO: 7219 - protein, 45 aa, Staphylococcus epidermidis
QNYNRTNKFGDTAHIVYLSFILKHEFILKTILLNHCKKSNLNYFQ

SEQ ID NO: 7220 - protein, 253 aa, Staphylococcus epidermidis
SQVLTYLLKCLNMLKNLVAEYQYGDIKSVEDKGDYKVINLGNKEITAHAVIISTGAEYKKIGVPGEQELGGRGVSYCAVCDGAFFKNKRLFVIGGGDSAVEEGTFLTKFADKVTIVHRRDELRAQNILQERAFKNDKVDFIWSHTLKTINEKDGKVGSVTLESTKDGAEQTYDADGVFIYIGMKPLTAPFKNLGITNDAGYIVTQDDMSTKVRGIFAAGDVRDKGLRQIVTATGDGSIAAQSAADYITELKDN

SEQ ID NO: 7221 - protein, 49 aa, Staphylococcus epidermidis
TSNNTIYILYFNFTIHYIYVSNIIQFKFYVLLRIVFKILHIQIICQQLN

SEQ ID NO: 7222 - protein, 149 aa, Staphylococcus epidermidis
RGDKRMYFVDKDKLTQKITYLQKLTEDYNDNKRNLYAFERIGQMLIESSVDIGNMIIDGFILRDPGNYKDVIDILELENVISKETQSHINRTIDVRKQFAHHYIDLNMNKIEPLFDDALPYYKQFIQEVGQFLENENVPITAFGKGANN

SEQ ID NO: 7223 - protein, 348 aa, Staphylococcus epidermidis
YFLNIILKEAIIMAIKVAINGFGRIGRLAFRRIQDVEGLEVVAVNDLTDDDMLAHLLKYDTMQGRFTGEVEVIEGGFRVNGKEIKSFDEPDAGKLPWGDLDIDVVLECTGFYTDKEKAQAHIDAGAKKVLISAPAKGDVKTIVFNTNHDTLDGSETVVSGASCTTNSLAPVAKVLSDEFGLVEGFMTTIHAYTGDQNTQDAPHRKGDKRRARAAAENIIPNSTGAAKAIGKVIPEIDGKLDGGAQRVPVATGSLTELTVVLDKQDVTVDQVNSAMKQASDESFGYTEDEIVSSDIVGMTYGSLFDATQTRVMTVGDRQLVKVAAWYDNEMSYTAQLVRTLAHLAELSK

SEQ ID NO: 7224 - protein, 85 aa, Staphylococcus epidermidis
LWLKSTSKVMNMKDWTINNHSKRQLIIQSNHDDISIIEPLRNGSFKILAEFNALNTDYIQVYDHTLVVSIHEKEISVLDRSSQSI

SEQ ID NO: 7225 - protein, 42 aa, Staphylococcus epidermidis
DILNSFNPSFSFYIYIKCNHLLSVIIVWRFETYRISINLNIS

SEQ ID NO: 7226 - protein, 351 aa, Staphylococcus epidermidis
YELNLKEKCIMIIAIILLIFVSFFFSGSETALTAANRTKFQTEAKKGDRKAQGLTKLLDKPSEFITTILIGNNVANIILPTLVTILAIDIGVNVGIASAIVTIVIILISEVIPKSIAATFPDKISKLVYPIIHICVIVLKPITILLNKMTDGINHLLSRGQPVEKRFSKEEIRTLLNIAGREGAFNEIENTRLQNVMDFEQLKVKDVDTTPRINVVAFSKEVTYDEAYDTVMNNPYTRYPVYDENIDDIIGVFHSKYLLAWSKHKEESITNYASSPLFVNEHNRAEWVLRKMTVSRKHLAIVLDEFGGTDAIVSHEDLIEELLGMDIEDEMDREEENKLKHQKFPQSMMHR

SEQ ID NO: 7227 - protein, 44 aa, Staphylococcus epidermidis
FNIKSSKILCVKVILKLFKLIYHFITSHTPYYSTLSLSNTGFKY

SEQ ID NO: 7228 - protein, 42 aa, Staphylococcus epidermidis
VFINSCAKLTVNKPRNVTGPINAVDIETSKATKIRNIRVIFS

SEQ ID NO: 7229 - protein, 46 aa, Staphylococcus epidermidis
NLINIGWGIVLICSLQSRYDINQALEFVFLISVSAYFVCLNFELTN

SEQ ID NO: 7230 - protein, 168 aa, Staphylococcus epidermidis
DRINLKRNVGKEMKLKNLFLSSVAVILSICLVLLLFLATNQNALAKVHKTICTFTKVKTVSHNDIFPNLNMNHVAEASEKNSDHQKNVNKTNQQSVRTQASYDFNPQECKVIALNYAENHLSKKYNIERTFNESLHSVYVFSSENKLHQTKVKVNKSGTVHASNINNH

SEQ ID NO: 7231 - protein, 43 aa, Staphylococcus epidermidis
NVINSFQSHHFPIDKNIKLILKTIFKYVVNNVFYSNKTIIAYF

SEQ ID NO: 7232 - protein, 40 aa, Staphylococcus epidermidis
DYVNTQYLTRMYDKEIDKMIANSSEKRMSFNENQSHRPLL

SEQ ID NO: 7233 - protein, 86 aa, Staphylococcus epidermidis
FIVKGCDVVMNKNLLKKYLNDDSFKSVVVVIGNKRIVLENDIHVDYENEVIIYPCKNCTRIIPFSSISYLELIDKQDQFINYFKEG

SEQ ID NO: 7234 - protein, 74 aa, Staphylococcus epidermidis
FLSKLLGKLAYHHRLLTTVLPLISTNNHSCHTSTKLSFYEDKLNVDYHIFFNLHLLLYRLFITIVIIVSNKTHV

SEQ ID NO: 7235 - protein, 147 aa, Staphylococcus epidermidis
VTTKESIMRKWLTLLLITTLVLTACGKSNEKASLEKSIDQLKKENKDLKKQKKKLQEQKDKLKHKQDSLQEDVNDLPAKSTSRDKKNKDNHDAKEKSSDNQSTSANHDDQTNKIKSNQDEHDSQSSKPHTQQKPSQNDRKNNHRQER

SEQ ID NO: 7236 - protein, 45 aa, Staphylococcus epidermidis
LQTNVECNLIIMKFKKINKIKIVIPTDSQDIEYFVIMFKLIKIRR

SEQ ID NO: 7237 - protein, 55 aa, Staphylococcus epidermidis
TNAKYFYSLSWLTLMKFINNLTIPFIKNQTISHNNSLHLLKQRVKSSKNSTLNTL

SEQ ID NO: 7238 - protein, 54 aa, Staphylococcus epidermidis
LIAKISIMLLIKTDNNMELNLSCLKRCRYKSKPRISKTMAMLINIYIIMLNSYS

SEQ ID NO: 7239 - protein, 252 aa, Staphylococcus epidermidis
KYQKYLKILNKVVPLNDDETFKLGIVLSYLKQYRASQNLLYPLYKKGKFVSIQMYNALSFNFYYLGNKDESIEMWNKLTQISEVDVGYAPWVIEESKTVFESRVLPLLLDDNNHYRLYGIFLLHQLNGKEILMTEDIWSILESMNDYEKLYLTYLVQGLTLNKLDFIHRGMQRLYNFKKFKYNTSLFTDWINQAEMIIAENVDLVDVDRYVAAFVYLSYRRSSQPLTKRQLMDDFNVSRYKLNKAIEFILSI

SEQ ID NO: 7240 - protein, 226 aa, Staphylococcus epidermidis
MAQKENNIIPMIFDEAFYRKMATQKWRQQDYKKAAEYYEKVLELSPKDFDIQQHYAQCLVKLNIGKKAERLFYENIVKDFHVAESFYELSQLNIELNEPNKAFLFGINYVILSEDKDFREMLEKTFEVTYTNEQKIELEAQLFSTQLLFQFLFSQGRLEEARTYILNQSYEIQQHRVIRNLLAMCYLYLGEYDSAKAMFEELLKEDNSDVHALCHYTLLLYNKKEA

SEQ ID NO: 7241 - protein, 129 aa, Staphylococcus epidermidis
MIKKTYQKGVKIIVDMRDRIIIIVPVVIGLLILRNSERRSTSSILKVPTKSKIAPIINIVGDKYGMDMYTDCVLDLSVINCNKLITMASIIAINFWSEITKGYSLKFKYICKSVHIINSVTVNIVIKLN

SEQ ID NO: 7242 - protein, 80 aa, Staphylococcus epidermidis
NHKKTFDFSPFFKVLKTLESPTYILSPINHTRLLEFLCAKNSFLHYIHKLFLLIMIIFIYFCSCDEITVVRGLKITITLN

SEQ ID NO: 7243 - protein, 355 aa, Staphylococcus epidermidis
SMKNLVLLGGGYGNMRIMSRILPHSIPEGYHLTLIDRMPFHGLKPEFYALAAGTKSDKEVRIQFPDSSQINTVYGEISDIDLDEQMITVGNSKIDYDELIIGLGCEDKYHNVPGAEAYTHSIQTLSKSRETYHRISELPKGARVGIVGAGLSGIELASELRESRSDLEILLYDRGPRILRNFPEKLSKYISNWFSKHNVTVVPNSVIDRVEPGKIYNNGKPENIDLVVWTAGIQPVEIVRNLPIDMSTTGRVIINQYHQVPTYRNVYVVGDCANLPHAPSAQLAELQGEQIAEVLKKQWNNEPLPDKMPEIKVQGFLGSLGDKQGFAYIMDRTVTGRLASILKSGVLWRYKYHNG

SEQ ID NO: 7244 - protein, 398 aa, Staphylococcus epidermidis
FKEKKGSIMSEYVLTNGIVYTENEMINNGYVHIKDGKILDVGKCPFHPSSSHNTIDIIDVKKRHILPGFIDIHIHGGYGEDAMDASEQGLQHLAESLLSEGTTSFLATTMTQSTVNIERALQTIAKYTQQQDVTNAAEIVGVHLEGPFISEHKVGAQHPQFVQRPTVDKIKSFQEVANGLIKIITYAPEVDGATETLKTMKNDIIFSIGHTVATFDQANTAVSHGAKHITHLYNAATGFQHREPGVFGAAWLNQGLHTEMIVDGVHSHPASIALAYRLKGNQSCYLITDAMRAKGMPEGHYDLGGQDVIVKGSEARLSSGALAGSILKMNEGLKNLIQFTGDTIEHLWRVTSLNQAITLGIDDIKGSIKIGKDADIVIIDDACNVETTIKNGKYHAFK

SEQ ID NO: 7245 - protein, 185 aa, Staphylococcus epidermidis
RERNTLELQEAISNRRSVKKFKHDMVVDDQTVYDAIYKATDAPNHGMREPWRLVHISKDKLGDFSRDITRFAFPDSPDKREDHFHAVTNLGGMLLLILKDDPRQRQSRENYFAFGAFAQNLMLLLYEAGIGTCWKSPQYIFDPKIRKALGVKDNEILAGFLYLTDLEEVPTKAKRKNKNLITEFE

SEQ ID NO: 7246 - protein, 46 aa, Staphylococcus epidermidis
LLRKNNIKRNRILMIVLPLIKLVFYQATSNSVYDSVTRCLFLCSHF

SEQ ID NO: 7247 - protein, 324 aa, Staphylococcus epidermidis
KVGKIMQMSANKKISILVVMAICMAIFYLLVGLDFDIFEYQFQSRFKKFILILLVGASIGTSVVIFQSITTNRLLTPSIMGLDSVYLFVKVLPIFILGEQATVVTNIYLNFLITLIAMVFFSLLLFQVIFKLGHFSVYFILLVGVILGTFFRSITSFLQLIMNPESFLAVQNVMFASFEASNSKLVTVSGILLVILIIVTIILRPYLDVLLLGRAQAINLGVSYENMTRMFLILVALLVSISTALIGPVTFLGLLTVNLAHEFMKTYEHKFILPATILFSWISLFIAQWVVENLFEATTEFSLIVDLVGGSYFIYLLVKRRNAN

SEQ ID NO: 7248 - protein, 199 aa, Staphylococcus epidermidis
TEGKNFAILNTYITNRECKSMTRQRIAIDMDEVLADTLGAVVKAVNERADLNIKMESLNGKKLKHMIPEHEGLVMDILKEPGFFRNLDVMPHAQEVVKQLNEHYDIYIATAAMDVPTSFHDKYEWLLEYFPFLDPQHFVFCGRKNIILADYLIDDNPKQLEIFEGKSIMFTASHNVNEHRFERVSGWRDVKNYFNSIEK

SEQ ID NO: 7249 - protein, 42 aa, Staphylococcus epidermidis
NSLKFEEFKVEIIICKMDFTLALLFILVANDDMINHYVQVKL

SEQ ID NO: 7250 - protein, 49 aa, Staphylococcus epidermidis
LVLKMLLKSSCLLKLKSSSCKLQLFIKILNSFGGDEICQIQSLSLMKIK

SEQ ID NO: 7251 - protein, 171 aa, Staphylococcus epidermidis
VLMKKLITSLLVLGLVLTGVSVGNNVEAATGNSMKTVQQLNKGDKSLENVKIGESMKSVLKKYSHPIYSYNPNSNEKYYEFRTDKGVLLVTANGKKERGNVTRVSMTYNDANGPSYKAVKQQLGHKAISRVHYNNVTGNFGYIQKDQASYQFSSNSPKDKNVKLYRIDLNK

SEQ ID NO: 7252 - protein, 414 aa, Staphylococcus epidermidis
TRMKKQIIERLTRYVKIDTQSNPDSKTTPSTNKQWDLLNLLEEELQSLGLKTDMDEHGYLFATLESNINYNVPTVGFLAHVDTSPDFNASHVNPQIIEAYNGQPIKLGESQRILDPDVFPELNKVVGHTLMVTDGTSLLGADDKAGVVEIMEGIKYLIDHPDIKHGTIRVGFTPDEEIGRGPHQFDVSRFNADFAYTMDGSQLGELQFESFNAAEVTVTCHGVNVHPGSAKNAMVNAISLGQQFNSLLPLHEVPERTEGYEGFYHLMNFTGNVEKATLQYIIRDHDKEQFELRKKRMMEIRDDINVHYNHFPIKVDVHDQYFNMAEKIEPLKHIIDIPKRVFEALDIVPNTEPIRGGTDGSQLSFMGLPTPNIFTGCGNFHGPFEYASIDVMEKAVHVVVGIAQEVANSHQSYK

SEQ ID NO: 7253 - protein, 109 aa, Staphylococcus epidermidis
IVMKNIHQTEEFNSTIGSTDPVIIKFEADWCPDCKAMDMWIDPIVEKYNNYQWYVVDRDELEDVTTENDVMGIPSILIFQNGKKLAHLHSANAKSPEQVESFLTEHLDQ

SEQ ID NO: 7254 - protein, 504 aa, Staphylococcus epidermidis
KVMKMMSNLIILPMLLPFVCALILVFTKNKNRISKILSITTMIVNTMISIALLIYVVNHKPITLDFGGWKAPFGIQFLGDSLSLLMVSVSSFVVTLIMAYGFGRGEKRVNRFHLPTFILLLTVGVIGSFLTSDLFNLYVMFEIMLLASFVLVTLGQSVEQLRAAIVYVVLNILGSWLLLLGIGMLYKTVGTLNFSHLAMRLNHMENNQTITMISLVFLVAFSSKAALVIFMWLPKAYAVLNTELAALFAALMTKVGAYALIRFFTLLFDHHPSVTHTLLVFMACITMIIGAFGVIAYKDIKKIAAYQVILSIGFIILGLGSHTISGVNGAIFYLANDIIVKTLLFFVIGSLVYMSGYRNYQYLSGLAKREPFFGVAFVVVIFAIGGVPPFSGFPGKVLIFQGAITNGNYIGLALMIVTSLIAMYSLFRVMFIMYFGDADGEQVQFRPLPIYRKGLLSVLVVVVLAMGIAAPVVLKVTEDATNLNMKEDVFQKNVNTHLKEVNHK

SEQ ID NO: 7255 - protein, 655 aa, Staphylococcus epidermidis
WGVKKMRITELLTKETIAMDLDASDKSGVITELVNQLDKAGKLSDPVSFKEAIHNRESQSTTGIGGGIAIPHAKVAAVKTPAIAFGKSKEGVDYQSLDMQPAHLFFMIAAPEGGAQTHLDALAKLSGILMDEKIREKLIHAESPEEVLNIIDEADDEATKEEEAEANENATVSTDNSNQDNNEPYVLAVTACPTGIAHTYMARDALKKQAEKMNIKIKVETNGSSGIKNHLTEQDIERATGIIVAADVHVETDRFDGKNVVEVPVADGIKRPEELINTALDTNRKPFVAQGGSKKHDDNEEKLSPGKAFYKHLMNGVSNMLPLVISGGILMAIVFLFGANSFKPDSSEYNAFAEQLWNIGKNSAFALIIPILAGFIARSIADKPGFAAGLVGGMLAISGGSGFIGGIIAGFLAGYLTQGIKYITRKLPQAIEGLKPTLIYPLLSVSITGLLMVYVFNPPAAWLNHLLLNGLNSLSGSNIMLLGLVIGAMMAIDMGGPFNKAAYVFATAALTEGNAAPITAAMIGGMIPPLAIATAMLIFRRKFTKEQRGSIVPNYVMGLSFITEGAIPFAAADPLRVIPSMMVGSGVAGAIALGLGSSIKAPHGGIFVIIGTDFNHILQTLIALVVGTLVSALIYGFLKPKVTENEIQASQAMDE

SEQ ID NO: 7256 - protein, 262 aa, Staphylococcus epidermidis
IFKNIYCLYKKGVTMRDKDNQHSRLYYIILTIVIIAICVVVVILFNTLKTNRSHSTDRYADFTELKKDTIKNKDWRIKTKHRKNKDILVTAIHGGGIEPGTTEIARRISNVGKYNFYTFEGLRKSNNDQLHVTSTHFNEPILDKLLKNTKETLSIHGFSGDDPIVYIGGKDKEMSHSITKELRKKDFTVKESPNKIDAKSSDNIANKNESNSGVQLELTTALRKQFFKHYKLDRHTRSDSDKYTKDFYKFANAVQKGIEKVN

SEQ ID NO: 7257 - protein, 325 aa, Staphylococcus epidermidis
FLKKKLNKGALLMVNRRKISIIGAGHTGGTLAFILAQKELGDIVLIERQQSEGMAKGKALDILESGPIWGFDTSVHGSVNIEDIKDSDIVVMTAGIPRKSGMTREELVQTNEQIVRETALQIATYAPHSIIIVLTNPVDVMTYTAFKASGFPKERIIGQSGILDAARYRTFIAQELNVSVKDVNGFVLGGHGDTMLPLINNTHINGIPVKHLISEEKIDQIVERTRKGGAEIVALLGQGSAYYAPATAIYETIDAIFNDRKRLLPSIAYLEGEYGCSDICFGVPTIIGYQGIEKIIEVDMNNDEYQQLQHSAQAVSEVKNSLKFK

SEQ ID NO: 7258 - protein, 279 aa, Staphylococcus epidermidis
TLKKRGLYSMKKLFGIILVLALTIALAACGGGKDKEKTITVGASPAPHAEILEKAKPLLKKKGYDLKIKPINDYTTPNKLLDKGEIDANFFQHTPYLNTESKEKGYKIESAGNVELEPMAVYSKKYKSLKDLPKGATVYVSNNPAEQGRFLKFFVDEGLIKLKKGVKIENAKFDDITENKKDIKFNNKQSAEYLPKIYQNQDADAVIINSNYAIDQKLSPKKDSIALESPKDNPYANLIAVKKGHKDDKNIKVLMEVLQSKEIQDYIKDKYDGAVVPAK

SEQ ID NO: 7259 - protein, 58 aa, Staphylococcus epidermidis
FINLVFHECVDVNALYLVDATIQKFYGKDYVLRCGLTAIILRIEILLEYINRQFILYQ

SEQ ID NO: 7260 - protein, 283 aa, Staphylococcus epidermidis
IQFDSRFSWWKLLHIFACQKEKCKLIQIRNLDKTIDNKPILKDISVDIKKGKLTSLIGPNGAGKSTLLSAISRLFSYENGSILIEDKEISEYKTDDLAKKLSILKQSNHTDMNITIEQLVKFGRFPYSKGRMKQEDYDKVEYALDLLQLNEIKHRNIKTLSGGQRQRAYIAMTIAQDTDYILLDEPLNNLDMKHSVQIMQTLRDLCRQLNKTIIIVLHDINFASCYSDDIIALKQGELVKADDKDNVIQSDILKSLYEMEVRIEEIRGQRICLYYDETTFDSV

SEQ ID NO: 7261 - protein, 57 aa, Staphylococcus epidermidis
LEFERCYLKMKGKEPSNKYFDKMKPYLITLLYLAIFIALYLIYGSGDTQNNFIYNEF

SEQ ID NO: 7262 - protein, 41 aa, Staphylococcus epidermidis
ILLDRTKLFIYYNIIYFVQVNILTFIKNILFETYTSLSFLW

SEQ ID NO: 7263 - protein, 61 aa, Staphylococcus epidermidis
TCSDFFDASFCMSPYVPPIYLNTISVVKKRNFNIIQPNYITFMFFKCLNNMSFNLQDMLVL

SEQ ID NO: 7264 - protein, 41 aa, Staphylococcus epidermidis
KEPETLILSQILFTYSQFITEVKVVLSYSRYCCHRELTHLI

SEQ ID NO: 7265 - protein, 423 aa, Staphylococcus epidermidis
SMHESIKIHIGRCQMFLLVNIIGLFIFLGIGVIFSRNRKNIQWKSIFILVILNLFLAWFFIYFPWGRAGVKGAANGIAWVIESAHEGTGFAFKSFTSNKMMDMAVSALFPILLVVPLFDILMYFNILPKIIGGIGWVLAKVTRQPKFESFFGVEMMFLGNTEALAVSSEQLKRMNEMRVLTIAMMSMSSVSGAIVGAYVQMIPGELVLTAIPLNIINAIIVSCILNPVSVEEQEDVVYSIKDHQTERQPFFSFLGDSVLAAGKLVLIIIAFVISFVALADLIDRLIHLITHLIANGIGVKGSFGLDQILGVFMYPFALLLGLPFNEAWEVAQQMAKKIVTNEFVVMGEISNQVNAMTPHHRAVISTFLVSFANFSTIGMIIGTLKGIVDKKTSDFVSKYVPMMLLAGILVSLLTAAFVGLFAW

SEQ ID NO: 7266 - protein, 659 aa, Staphylococcus epidermidis
RKNDSLLKTEETNMSLPKKKIGIFAFFLLTVFTITLKTYFSYYVDFSLGVKGLVQNLILLMNPYSLIALVLSVFLFFKGKKAFWFIFIGGFLLTFLLYANVVYFRFFSDFLTFSTLNQAGNVESMGGAVSASFKWYDFVYFIDTIIYLAILIFKRKWLDNRAFSKKFVPVVMATSVALFFLNLAFAETDRPELLTRTFDHKYLVKYLGPYNFTVYDGVKTIENNQQKALASEDDLTKVLNYTKQKRTEPNPEYYGAAKKKNIIKIHLESFQTFLINKKVNGKEVTPFLNKLSSGNQDFTYFPNFFHQTGQGKTSDSEFTMDNSLYGLPQGSAYSLKGDNTYQSLPAILDQKQGYTSNVMHGDYKTFWNRDQVYKHFGIDNFYDATYYDMSDDNIVNLGLKDKPFFKASADYQSKMKKPFYSHLITLTNHYPFTLDEEDASIDKPNTGDSTVDGYIQTAHYLDQALEEYITDLKKKGLYDNSVIMIYGDHYGISENHNNAMEKLLGEKITPAKFTDLNRTGFWLKVPGKSGGVNKEYAGQMDVMPTLLHLVGIDSKNYLMFGSDMFSKQHNNVVPFRNGDFITEDYKYVNGKIYSNKDNELLTEKPKDFDKNKKQVEKDLEMSDSVLNGDLFRFYKNPDFKKVNPGKYEYKSGPKGNEKK

SEQ ID NO: 7267 - protein, 249 aa, Staphylococcus epidermidis
LLLEVNHLNLFLGKKHILKDITFSLPINGEIIGIVGPNGAGKSSLLKAFIGEFKATGKHTLYDHPIHTQLRYITYIPQKAHIDLDFPIKVDQVILSGCYEDIGWFKKASVVEKTKLNQLLNDLELDHIRHRQIAELSGGQLQRVLVARALMSNSDIYCLDEPFVGIDIYSEQLIMKKIKHLRHMGKLILIVHHDLSKADQYFDRILLLNQSLQFLGPTKEALSSERLNATFINYKDDSLLTLSSQGSTN

SEQ ID NO: 7268 - protein, 113 aa, Staphylococcus epidermidis
IFLEVNRMAIKLSSIDQFEQVLEENKYVFVLKHSETCPISANAYDQFNKFLYERDIDGYYLIVQQERKLSDYIAEKTNVKHESPQAFYFVDGEMKWNADHDDINVSQLAQAEE

SEQ ID NO: 7269 - protein, 275 aa, Staphylococcus epidermidis
GDLDMSDLFQNAPPYIQALIAGIITWLLTALGAAAVFIFKKVNDKVLNSMQGFAAGIMIAASFWSLLQPAIESSENSAMPWLPAAIGFILGGVFIRVLDYIIPHIHQNAQDKNQQQEGVPTSLGKNALLVLAITLHNIPEGLSIGVAFGGVVSGNSHATFLGAIGLAIGIGIQNIPEGAALSMPIRAAGATRWKAFNYGQASAIVEPIFATIGAAAILVVNPILPYALAFAAGAMIFVVVEELIPDSQSSNNTDLATLSLMIGFTIMMILDVALG

SEQ ID NO: 7270 - protein, 95 aa, Staphylococcus epidermidis
MLSLYVMKTLFLIINIVLLKRFLLKLVGISFFMKVGIIKYFDVLLLLDKTFIKFPKNMKKLLKKENRVYNIDVNDNHYHYHYHYFRILTLYIFNI

SEQ ID NO: 7271 - protein, 428 aa, Staphylococcus epidermidis
YLLEGKLIYRKVVTIMAEHSFDVKAVIKDFPILEQKVNNKRLAYLDSTATSQTPVQVLNVLDDYYKRYNSNVHRGVHTLGSLATDGYENARETVRRFINAKYFEEIIFTRGTTASINIVAHSYGDANISEGDEIVVTEMEHHANIVPWQQLAKRKNATLKFIPMTKDGELQLDDIKATINDKTKIVAIAHVSNVLGTINDVKTIAKIAHEHGAVISVDGAQSAPHMALDMQDIDADFYSFSGHKMLGPTGIGVLYGKRELLQNMEPVEFGGDMIDFVSKYDATWADLPTKFEAGTPLIAQAIGLAEAIRYIENLGFNAIHQHEKELTEYAYEQMLTIDGLEIYGPPKDRRAGVITFNLADIHPHDVATAVDTEGVAVRAGHHCAQPLMKWLGVSSTARASFYVYNTKEDVDQLVQALKQTKEFFSYEF

SEQ ID NO: 7272 - protein, 52 aa, Staphylococcus epidermidis
KDIEAHLLSINLQMRFFFIVFRLFITVSKYLSLNHLLNVSILILYYNTYELK

SEQ ID NO: 7273 - protein, 327 aa, Staphylococcus epidermidis
IRIEKRVRKGECSMSFASDMKNELTRIEVDESNAKAELSALIRMNGALSLSNQQFVINVQTENATTARRIYSLIKRIFNVEVEILVRKKMKLKKNNIYICRTKMLAKEILNDLGILKKGVFTHDIDPDMIKDDEMKRSYLRGAFLAGGSVNNPETSSYHLEIFSQYEDHSEGLTKLMNSYELNAKHLERKKGSIAYLKEAEKISDFLSLIGGYQALLKFEDVRIVRDMRNSVNRLVNCETANFNKTVSAAMKQVESIQLIDEEIGLENLPDRLREVAKLRVEHQEISLKELGEMVSTGPISKSGMNHRLRKLNELADKIRNGEQIEL

SEQ ID NO: 7274 - protein, 254 aa, Staphylococcus epidermidis
DMSDSITIIDENKVIDVVLIAGRILLEAGAETYRIEDTMNRIAHSYGLHDTYSFVTSTAIIFSLNDRTSTKLIRIRERTTDLEKIALTNSLSRKISSKQLTIDEAKSELLQLKRASLQYSFLTNLIAAFVACGFFLFMFGGVASDAWIACLAGGIAFLTFSFVQKYIQIKFFSEFVASAVVISIAAIFTKLGIAKNQDIITIASVMPLVPGILITNAIRDLLAGELLAGMSRGVEAALTAFAIGAGVAIVLLLL

SEQ ID NO: 7275 - protein, 55 aa, Staphylococcus epidermidis
SVKEILLSANVLFVTRPVNQLAGKNKNIINMTPLIIMGKNGFSFIVTLLKLLQFY

SEQ ID NO: 7276 - protein, 435 aa, Staphylococcus epidermidis
DYKERDNLACHMFIAFIYIVGWLKYYESLGELEMAQDRKKVLVLGAGYAGLQTVTKLQKELSADAAEITLINKNEYHYESTWLHEASAGTINYEDLLYPVEKTVNKNKVNFVVAEVTKIDRNAKRVETDKGVYDFDILVVALGFVSETFGIDGMKEHAFQIENVLTSRKLSRHIEDKFANYAASKEKDDKDLSILVGGAGFTGIEFLGELTDRIPELCSKYGVDQSKVKLTCVEAAPKMLPMFSDDLVSYAVKYLEDRGVEFKIATPIVACNEKGFVVEVNGEKQQLEAGTSVWTAGVRGSHLMEESFEGVKRGRIINKQDLTIEGHNDIFVIGDCSAFIPAGEERPLPTTAQIAMQQGEHTASNIKRLLNGESTQDFQYVNRGTVCSLGANDGVGIVYGRDIAGKKAAFLKKVIDTRAIYKLGGIGLAFKKGKF

SEQ ID NO: 7277 - protein, 40 aa, Staphylococcus epidermidis
LKKDKYLTKWIITVFHLLKVLFKPRDFHLSMFNKMIVTLN

SEQ ID NO: 7278 - protein, 63 aa, Staphylococcus epidermidis
MAEDKFEQAKGNIKETVGNATDNKELEKDGKGDKASGKAKEAVENVKEKANDVIDKFKGNKGD

SEQ ID NO: 7279 - protein, 46 aa, Staphylococcus epidermidis
TRGDILNIYIAIVLGLIFVFLSDMDYRRRNNSTNMDKKMIKISFFT

SEQ ID NO: 7280 - protein, 596 aa, Staphylococcus epidermidis
MVLEKQKLTLLYTQRNGVTRRRKMVFEGVIPNIDRRYHESPSEYTREMMSKYMTELPCETCHGKRLSKEALSVYVGDYNIGEVVEYSIKNALYYFENLKLSDQDKSIADQILKEIISRLSFLNNVGLEYLTLDRSSGTLSGGEAQRIRLATQIGSRLTGVLYVLDEPSIGLHQRDNDRLINTLKEMRDLGNTLIVVEHDDDTMRAADYLVDVGPGAGNHGGEVVSSGTPNKVMKDKKSLTGQYLSGKKRIEVPEYRREITDRKIQIKGAKSNNLKNVNVDFPLSVLTVVTGVSGSGKSSLVNEILYKALAQKINKSKVKPGNFDEIKGIDQLDKIIDIDQSPIGRTPRSNPATYTGVFDDIRDVFAQTNEAKIRGYQKGRFSFNVKGGRCEACKGDGIIKIEMHFLPDVYVPCEVCDGKRYNRETLEVTYKGKNIADVLEMTVEEATHFFENIPKIKRKLQTLVDVGLGYITLGQQATTLSGGEAQRVKLASELHKRSTGRSIYILDEPTTGLHVDDISRLLKVLNRIVENGDTVVIIEHNLDVIKTADHIIDLGPEGGEGGGTIIATGTPEEIAQNKGSYTGQYLKPVLERDSVE

SEQ ID NO: 7281 - protein, 80 aa, Staphylococcus epidermidis
LIMEFREQVLDLLAEVAENNIVKENPDVEIFEEGIIDSFQTVGLLLEIQNKLDIEVSIMDFDRDEWATPNKIVEALEELR

SEQ ID NO: 7282 - protein, 133 aa, Staphylococcus epidermidis
INQEGILVAVPSEFKYSKEHEWVKIENNVATIGITEYAQNELGDIVFVELPETDDELNEGDTFGSVESVKTVSELYAPISGKIVEVNEELEDSPEFVNESPYEKAWMVKIEISDDSQLEELLSADQYSEMIGE

SEQ ID NO: 7283 - protein, 111 aa, Staphylococcus epidermidis
FFKEDTSLAKVYGSLIDNETRCTHYYSSLDVIAIKFKCCNKYYPCYKCHNEHVSHTIERWAENEFDEKAIMCGVCKHEMRIRDYMMVEMCPRCKAHFNSRCKFHYHLYFEV

SEQ ID NO: 7284 - protein, 316 aa, Staphylococcus epidermidis
TKKERFNVKKILALAIAFLIILAACGNHSNHEHHSHEGKLKVVTTNSILYDMVKRVGGNKVDVHSIVPVGQDPHEYEVKPKDIKALTDADVVFYNGLNLETGNGWFEKALDQAGKSTKDKNVIAASNNVKPIYLNGEEGNKNKQDPHAWLSLENGIKYVKTIQKSLEHHDKKDKSTYEKQGNAYISKLEELNKDSKNKFDDIPKNQRAMMTSEGAFKYFAQQFDVKPGYIWEINTEKQGTPGQMKQAIKFVKDNHLKHLLVETSVDKKAMQSLSEETKKDIYGEVFTDSIGKEGTKGDSYYKMMKSNIDTIHGSMK

SEQ ID NO: 7285 - protein, 236 aa, Staphylococcus epidermidis
NLREYFIMKSTAQLTKENNVKALRLNNTDREIFENYMTYVRADLRVNPHDSELMLNRTLKHLIRAGDTGMLAMEFFNHDPKAHAKKEIRELPNETFKNIFKYISHNFILLIGIFCFLKGLIGFFIGGDSNLLYLYTFPLTVIIGLVIIFLFIWMNFKTVQLQCFNNSYWTWWLTYGVIALLLITLFYVFFIPQSFLAFGPYIKVSNWTFIIIAIIIIPISFYVNHHFYNKEANTRI

SEQ ID NO: 7286 - protein, 336 aa, Staphylococcus epidermidis
KWREIMKQMNVVLIGGGTGLSVLARGLREFPIDITAIVTVADNGGSTGKIRDVMDIPAPGDIRNVIAALSDSESILTQLFQYRFGENQVDGHSLGNLVIAGMTNITNDFGHAIKELSKVLNIKGQVIPSTNASVQLNAVMEDGEIVHGETNIPKTHKKIDRVFLEPSDVEPMNEAIEALEQADLIVLGPGSLYTSVISNLCVKGISEALLRTSAPKLYVSNVMTQPGETDNYDVKEHIDALTRQVGEPFIDFVICSSESYSKDVLQRYEEKNSKPVAVHKEQLKDSGIRVLTASNLVEISNEHYVRHNTKVLSKMIYELALELTSTIRFTPSDKKK

SEQ ID NO: 7287 - protein, 337 aa, Staphylococcus epidermidis
NGLLFCRGNEGEKVIKFKNVTKRYANNIAVDNVSFNIKEGEFFVLIGPSGCGKTTTLKMINRLIPLSEGYIYFKDKPISDYPVYEMRWDIGYVLQQIALFPHMTIKENIAQVPQMKKWKDNDIDLRVDELLTMVGLNPEQFKNRKPDELSGGQRQRVGVVRALAADPPVIIMDEPFSALDPISREKLQDDLIHLQTQIKKTIVFVTHDIQEAMKLGDRICLLNEGRVEQIDTPDSFRTRPKSDFVKQFMGSHLDTTHNIVNQVKIKDLGINRSVDDNASVIHYPEVDAELYLNNIYEDLSHYDAVVVNDKEQHRRYLLNREDVFTYLSLNKEEATHE

SEQ ID NO: 7288 - protein, 374 aa, Staphylococcus epidermidis
GMSLFIIGTKFFKISVNLRCDLCMKKQLDQLTAYTPGLSPESLKKQYGIKGELHKLASNENVYGPSPKVKTAIQSHLDELYYYPESGSPKLREAISQQLNVDASRILFGAGLDEVILMISRAVLSPGDKIITSESTFGQYYHNAIVESADVIQVPLKDGGFDLDGMLQQIDNKTSLIWLCNPNNPTGTYFSHDELFNFLKRVPSDIPVLIDEAYVEFVTADDFPDTLKLQEDFDNAFLLRTFSKAYGLAGLRVGYVIASEDAIEKWNIIRPPFNVTRISEYAAIAALEDQEYLKEVTQKNSFERDKFYQIPQSQHFLPSQANFVFVKTSRSQALYDALLNVGCITRLFPNGVRITIGLPEQNNKMIEVLKHFEY

SEQ ID NO: 7289 - protein, 63 aa, Staphylococcus epidermidis
LKQLIISQLSTQSSSAIILKNFEQRITPLYSSYYITSSPISCGFILPSYNINNIFYTRYGGIS

SEQ ID NO: 7290 - protein, 319 aa, Staphylococcus epidermidis
LHKLFIESRYIFMKQPYNHGVLFYHEHSGLKDIHNGIGEVAKSLSSMCKHLSLQLSENKGDIIKYCKSIKNENYSSDVDVLFILGGDGTLNELVNGVMQYQLNLPIGVIPGGTFNDFTKTLQLHPNFKTASEQLLTSHAESYDVLKVNDLYVLNFVGLGLIVQNAENVQDGSKDIFGKFSYIGSTVKTLLNPVKFDFSLTVDGETKEGNTSMMLIANGPNIGGGQIPLTDLSPQDGRANTFVFNDQTLNILNDILKKRDSMNWNEITQGIDHISGKHITLSTNPSMKVDIDGEINLETPIEIQVLPKAIQLLTATEQNN

SEQ ID NO: 7291 - protein, 41 aa, Staphylococcus epidermidis
SQKLTKIQINNYEVLHLKLLDFCENCVKGIFSLIYKSAFLI

SEQ ID NO: 7292 - protein, 81 aa, Staphylococcus epidermidis
VNSCKIKFCRFSDITAIPPLIHLYCNGYAYIFQSKSSIFNQKQSFYDKNKNTFQIRCLKWIVSSHFKTYILIFRNHFLSIK

SEQ ID NO: 7293 - protein, 43 aa, Staphylococcus epidermidis
LISCAYIMIHYKLSISYVHQSPGRFNLSSKTDGQGTRLLIFYL

SEQ ID NO: 7294 - protein, 374 aa, Staphylococcus epidermidis
YNDWKFKDGEKMRLIIKKIYIIAIVLLNMVFKPFNINSKHIVIMMTFKQDILPIIEALCSEGYHVTVIGKKIYQKDINNINHAYFIPAGNKYIMRHMKVLSKAKVIILDTYYLMMGGYQKKKGQTVIQTWHAAGALKNFGLTDHQVDLKNKAMVRQYKKVYDATDYYLVGGEKMAQCFIQSFDASPSQMLKFGLPRLTQYFRSNLKLEQQRLKKKYHITNKLAVYVPTYREGQVAQRTIDKENFERHLPNYTLLSHLHPSTVDCQTSHSIDVTSLLIMADIIISDYSSLPIEASALNKPTLIYNYDEQQYEKVRGLNEFYYAIPERYKMSNEESIIQAIQDNDEQFQSLFNDWHQYNSKDSLNQLVHFINKLVK

SEQ ID NO: 7295 - protein, 50 aa, Staphylococcus epidermidis
IRSCYNDILNSILDCLKNMANPITYDLRSKDVSHYILSTNKKRLGQKVPG

SEQ ID NO: 7296 - protein, 226 aa, Staphylococcus epidermidis
EYRLILILRRCLIMGMHQYFKRLSDLEKLIRLPGKFKYFEHNVAAHSFKVTKIAQYMATVEEYHGNKIDWKSLYEKSLNHDFAEVFTGDIKTPVKYASKELKHLFSQVEEEMVDTFIKEEIPTQYQHVYRERLQEGKDDSLEGQILSVADKIDLLYETFGEIQKRNPEPLFFEIYEMSLETIIQFDHLESVKDFIENVIPEMLTENFIPRTELRETTMSILNRRNG

SEQ ID NO: 7297 - protein, 85 aa, Staphylococcus epidermidis
KETCHMPTENPTMFDQVAEVIERLRPFLLRDGGDCTLVDVEDGIVKLQLHGACGTCPSSTITLKAGIERALHEEVPGVIEVEQVF

SEQ ID NO: 7298 - protein, 349 aa, Staphylococcus epidermidis
RFKCSYCRIRKIKYHLSVFEINRGVHMNKILVTRQIPQHYVEQLKKIGQVVMWEHDLTPMSRESFLANVEDATACVITLSEHIDEEVFLRAQQLKVIANMAVGFDNIDISLAKKHGVVVTNTPHVLTETTAELGFTLMLTVARRIIEATSYIQKGKWKSWGPYLLSGKDVYGATVGIFGMGDIGKAFARRLQGFDARIIYHNRKRDLNAERDLNATYVTFKSLLEQSDFIICTAPLTKETENQFDARAFNKMKNDAVFINIGRGAIVDEEALLEALKNHEIQACGLDVMRQEPIQPNHPILKLPNAVVLPHIGSASQVTRNRMVQLCIDNIKAVLNNDAPITLVTSLHF

SEQ ID NO: 7299 - protein, 57 aa, Staphylococcus epidermidis
HPKCCKLCNFNIQLLMYVTMFFVVDIITFFIRTHAKDYLLVQKIARHLFLFSVTFLC

SEQ ID NO: 7300 - protein, 367 aa, Staphylococcus epidermidis
FSLCNSKEVNIHMGLNKEAIKIGFAYVGIVVGAGFSTGQEVMQFFTPFGLWSYIGVIISGFILGFIGRQVAKIGTAFEAKNHESTLQYVFGKKFSKVFDYILVFFLFGIAVTMIAGSGSTFEQSFGIPTWLGALIMTVLIYLTLLLDFNKIVRALGLVTPFLIIMVILIAVFYLFTGSISLGEVNSAMPETSAWKGIFWGLVYGGLAFAVGFSTIVAIGGDASKRRVSGAGAMFGGVLYAILLALINFSLQTEYSKIKDVAIPTLNLAKGIHPWLGLVLTVIMLAVMYNTILGLCYSFAARFTEPYSKKYHIFIIIMMVMAFILSFVGFADLINVLYKFMGIVGLFIVVAVLIKYYKRKKDDEEHIA

SEQ ID NO: 7301 - protein, 277 aa, Staphylococcus epidermidis
EKAWLSLMFAVGTVLKEHIKNFYLIQRLAQFQIKITNHNNYLGIAWEVLNPALQIMVYWLVFGLGIRSNAPIHGIPFVFWLLVGISMWFFINQGVLEGTKSISQKFNQVAKMNFPLSIIPTYIVTSRFYGHLGLLAIIIIACMFNGIIPSIHIVQLLIYVPFAYLLTSSVALLTSTLGILIRDTQMIMQALMRILFYMSPILWVPKNHGVSGLIHQIMLFNPVYFIAESYRAAILFHQWYFIDHWKLMLYNVIIILLFFIVGSILHRRYRDHFADFL

SEQ ID NO: 7302 - protein, 43 aa, Staphylococcus epidermidis
YCKCKEVRFCPRWDLKSQSLVMIASQVPLLQRYKEEGSSERLN

SEQ ID NO: 7303 - protein, 201 aa, Staphylococcus epidermidis
VKRCLQLVKTLYLMRHGQTVFNLKGKIQGASDSPLTALGVQQANAAQQYFKTKNIHFDYLYSSPQQRACDTLENAVPNQQYWCVKDLKEWGFGLFEGESIELLRAIKQPRYLYGDAVVPFGGESRSEVEHRVYRALYEMMDTTDGETILAVSHGSTIGLFVRNILGYDKGSKFEIGNCNIVKFEYDGEEFIFKDLINPIKK

SEQ ID NO: 7304 - protein, 137 aa, Staphylococcus epidermidis
GEFRIMKRVITYGTYDLLHYGHIELLRRAREMGDYLIVALSTDEFNQIKNKKSYYDYEQRKMMLESIRYVDLVIPEEGWGQKEKDVDRFDVDVFVMGHDWEGEFDFLKDKCEVIYLNRTEGISTTKIKQELYGKDTK

SEQ ID NO: 7305 - protein, 270 aa, Staphylococcus epidermidis
VCLRKKIIWLKYDRSDYLSILEVRQLSKVYGDKQAFQEVLKEINLDVDEGEFISIMGPSGSGKTTLLNVLSSIDYMTKGSITINGKQLEKLSNKQLSDIRKKDIGFIFQDYNILNTLTVKENIMLPLSVQKLDKQIMHERYQRIVEALNISDISDKYPSELSGGQRQRTSAARAFINLPSIIFADEPTGALDSKSTLDLLKRLKYMNEEFNTTILMVTHDPVAASFSNRVVMLKDGQIFTELYQGDDDKQTFYKEIIRTQSVLGGINYEL

SEQ ID NO: 7306 - protein, 226 aa, Staphylococcus epidermidis
KRIRALQQDINNYMIPEFKKYKNSTQHLTADTNEVKHLKEDYLKTVENKEKSIYDLKEFVDLCNRSIKDNEDILDYTKLFEKNRTEVESDINKAQNKEDASQLKSKLEENNQQLKDTAKKYLNSSNNDSDSAKEAIKNHISPLIDKQITDINKTNISDNHVDNARKNAIEMYYSLQNYYDTRVDTIKTSEKLAQIDVDRLPKEGKDISEMDKSFKREFKKIRESVN

SEQ ID NO: 7307 - protein, 73 aa, Staphylococcus epidermidis
ELHRKKKGYKMKDTQLTYILLIIASILLIANGIFAFERTLSMILMSILFILVGIILLSTTLNTMYQSSKHSKR

SEQ ID NO: 7308 - protein, 178 aa, Staphylococcus epidermidis
VIILRRLSKEKHHQVNPLWHIYRKIKFVKVLKQTLIIEIARFVPSMKLKNKIYKKLLKMDVGNHTSFAYKVLPDLFYPEYISVGKNTVIGYNTTILTHEVLVDEWRVGKVIIGDYTLIGANTTILPGITIGNHVKIGAGTVVSKDVPDYSFAFGNPMQIQLDSGGDNEWHKKKITSFQ

SEQ ID NO: 7309 - protein, 203 aa, Staphylococcus epidermidis
IIYRVLIHEFGHVLFNKLAGGKAKDLVIVTSPRERKVTSQQGYAITQSKGYLGQFITTIGGYLMPPLMFLTGLVSIHYQYPSIFITIYLFIFIYYFFITSRKLSPLIVIILISSLLYLVFKQDHQWFIYDIVTLSYHFILGVLLGEILQSSWTIFRLTFQRPKPSWDGSALTKVTRVPTFIFSLVWILFNLYTVYLLIKYTIL

SEQ ID NO: 7310 - protein, 412 aa, Staphylococcus epidermidis
ENCRGCKRMIPYGTFTFFLIAFIVLIPVIILGFLGKRSYIYNGISTAIMIVIIFASDKHNLLGQKYLSAQLFCFIIYVIWQVALIMYYYQSRQKKNTFTKFVTIMVLSILPLAIVKILQSSWLGGHQIHFHESKLIEFVGFLGISYVTFKSVQLIMEIRDGSIKEIKVGKLIQFISFFPTISSGPIDRYKRFVKDDKKVPSGAEYRELVVKAIHMIMLGFLYKYIIAYLIQTYAVNPLQLNLHGFTHMWLYMYAYSLYLFFDFAGYSLFAIAVSYLYGIKTPPNFKQPFKAKNIKDFWNRWHMTLSFWFRDCIYMRSLFYMSRKKLLKSQFAMSNVAYFLNFFIMGVWHGLEVYYIVYGLYHAALFIGYGYYERWRKKHPPRWQNGFTTAISIIITFHFVTFGFLIFSGKFI

SEQ ID NO: 7311 - protein, 155 aa, Staphylococcus epidermidis
VFIRYLITKIGGGKMKENDVVLKSVTKIVVFILLTFGFYVFFAGHNNPGGGFIGGLIFSSAFILMFLAFDVNEVLKSLPIDFKKLMIIGSLISVATASVPMFFGKPFLYQTEANVTFPLLGHVHVTTVTLFELGILLTVVGVIVTVMLSISGGRS

SEQ ID NO: 7312 - protein, 55 aa, Staphylococcus epidermidis
MRIRHCLDYVVVNFLLRFLNVCNLIVIKIHSSIYKYIVLCLKYQVKARYTGKLST

SEQ ID NO: 7313 - protein, 344 aa, Staphylococcus epidermidis
IVQRMEASRFTLFKYCFVNIVIKKVLKERVMNKYRSVIIWLFILILSMSLSLSWDVGKLDDVFNQTILFQVRLPRLLEAMLTGAVLTLAGQVYQIVLNNPLADSFTLGLASGASLGSGIALFLGLSFLWFPIFSIIFSLITLLLVLSVSAMLAKGYPVQMLILTGLLFGALLNALLYLLVLINPKKMNPIASYLFGGFASAEYQDVMIISLIASVAIIVLFLMQKGIKLLQVGELKSQSLGLNVQQVTYIVLIVASIMTAVVVAYVGVIGFIGMIIPQLIRKFYWRYQIGLQMLLNIIIGAVVMIIADFIGSTMIQPIQIPVGIVMALLGVPVLFYILIKQTNI

SEQ ID NO: 7314 - protein, 165 aa, Staphylococcus epidermidis
NLKRMIKYIYWWVSIKYIQFEEVIMMAVQYETKATNVGGRKGHVHTDDNAINVDVLPPQQADGKATNPEQLFAAGYASCFNGAFDLILKQNKVRDAEPEVTLTVRLEDDPDAESPKLSVDIHAKVKNVLSQEDAEKYLQDAHDFCPYSKATRGNIDVNLNVEVVE

SEQ ID NO: 7315 - protein, 40 aa, Staphylococcus epidermidis
NLVRFAAVNAVSLPEKKNETNINSIIAIIMMHFSLRFSSY

SEQ ID NO: 7316 - protein, 557 aa, Staphylococcus epidermidis
GDKRMNIIDQVKQTLIEEIEASIRKANLAEDIPEIKIEIPKDTKNGDYSSNIAMVLTKIAKRNPREIAQAIVDHLDTSKAHVKQVDIAGPGFINFYLDNQYLTDIIPEAITKGDRFGYATQSKNTNILLEYVSANPTGDLHIGHARNAAVGDSLANILIAAGYNVTREYYINDAGNQITNLARSIEARYFEALGDTSYEMPADGYNGKDIIEIGKDLAVKHPEIKDYSDEERLKTFRQLGVDYEMEKLKKDLSDFNVHFDNWFSETSLYENGAIKNTLSKMKELGYTYEADGATWLRTSDFKDDKDRVLIKKDGNYTYFTPDTAYHYNKINRGNDILIDLMGADHHGYINRLKASLETFGVDSDRLEIQIMQMVRLMQNGEEVKMSKRTGNAITLREIMDEVGIDAARYFLTMRSPDSHFDFDLELAKEQSQDNPIYYAQYAHARICSILKQAKEQGIEVSTDADFSKINNDKAIDLLKKVAEFESTIESAAEHRAPHRLTNYIQDLAAAFHKFYNAEKVLTDDTEKTKAHVAMIEAVRITLHNALALVGVTAPESM

SEQ ID NO: 7317 - protein, 77 aa, Staphylococcus epidermidis
MKFREWTITINGKGPINVVANEDTLLILQKYQHVEVALKIDNETVQVKSLGYNEDIIINHNTKEITINVTNLLEDDE

SEQ ID NO: 7318 - protein, 91 aa, Staphylococcus epidermidis
LNIRFTWNKGGLMMSTHSQCNYVNPNSISLDWECLIISKTDMLLDGVPKELINTWLDQNVIEPFCVRNNEINFKTKDVWNALKTHNWYYSN

SEQ ID NO: 7319 - protein, 52 aa, Staphylococcus epidermidis
ETPRLIACALPNKRTSKYGRSIIVTIINITNNMPETVTNLEFDASKLANITF

SEQ ID NO: 7320 - protein, 569 aa, Staphylococcus epidermidis
GEDRSMKSHIHFSIDRDLICAIMVGVLSGIVTLAMFFLSGYMITQSALGAPLYALMILVVSVKLFGFLRAITRYIERLLSHKTTFTMLRNVRVQFLKMLYPVVPDIYRRFNSSDLITKMISRVEALQNIYLRVYYPPIVIGLTAIVSVITMLFLSPLHALVITLSMLLTLWIVPWLSAMKARKLKQQVTQTQKTFLKRYYDYKEGHEELKRFNRSDDFENTVSQSLRQFDDMQLKERRFLSIYDYLLNLIAMFSIFMCLVLGAQQIHDGQLNAIYITSIILMILTLFEQAVPMSNVAYYKADTDLALEEIQEVIVPKYKIPSEHTNLKRSQNLLLEIKNVTFKYEHQHHSTLKQINLTIEYGDKVAIIGPSGSGKSTLLHVLLGLYQIEEGEVRLNGKDMNSINDNDKYQTFNAMLQSQYIFDGSIRDNLFSEQSDDNLKKVLEDVGLEYLNLDSIVTLDGHNLSGGEAQRLSLARLLLRPSAGFWILDEPTTALDINNTQKIINLIESLSQTLIIATHDLEILPRFNKIIVMNDGEIIENDSYQELMQHDGYLKKVIEMNGNEMKFFN

SEQ ID NO: 7321 - protein, 84 aa, Staphylococcus epidermidis
RIISNIDTNIINTPKYKLNESSVRYLLKKEPTKDPGSSPNRNIEPFFISTCLVFKYPNEEDNPVTIRITEEVPIAICVVIPCRR

SEQ ID NO: 7322 - protein, 93 aa, Staphylococcus epidermidis
RSVRVMIDMYLYDDEEQSQVQFVGFVGEHSRYDLMLVQTDRHYGKTLVLNMQTNQFGIIGSDDIEEEGYISHILGVSKEEADEIIEYLNEVIQ

SEQ ID NO: 7323 - protein, 70 aa, Staphylococcus epidermidis
STSRQQIILLTEIKLSELGTEFVISSRVTRFIKEIPRRNVFFVYFFDSQYIKCLGTMFCILSILLFYLAS

SEQ ID NO: 7324 - protein, 145 aa, Staphylococcus epidermidis
FYQRKWTLNQLVDYFSRWLDETKGTFVHTQKQDHHYIIYNRNIKRPLAIFKMVNTTEDIITLHLVDGKLMKPKSKKQAKLEFRLLKGTRLIMVHLYDYIPRLFWPIYYFIQAPIQGLLMRGFEIDCRIKHYQGRIQSGEKIKYTK

SEQ ID NO: 7325 - protein, 46 aa, Staphylococcus epidermidis
NHKSIYTILFITLGNKIVPNECKNAILLELCFSLIIYLIEYYRNTF

SEQ ID NO: 7326 - protein, 206 aa, Staphylococcus epidermidis
YNKSKELVTVKVKYIDKRHWRRLVEREYTEVKVNNNRFKGIIGLVTMKKVREPLEVTVVGQNIIVADDNYKWLQILPDKKRYSMTVMFDNKGNPLEYYFDINIKNITQKGNARTIDLCLDVLVLPNGEYELVDEDDLMYALQNKQISKKQYHEAYIIAHQLMIEIEDNFSEIQDKVMRCYHKINHKAQKMKHKRPYKAKKKSHRRH

SEQ ID NO: 7327 - protein, 159 aa, Staphylococcus epidermidis
FCKRSTIMTDSNAKEIRTGRLIAISSLVFCILLIIHHFIVLDESTAKSILSLAGQKTSDTAVKNILNSDRYTGIMYILAYLAGTVAFWNRHPYLWWFMFAVYISNALFTLVNLYLFIQGILDVKNVLAVLPILIVVIGSIILAIYMLVVSITRKSTFNR

SEQ ID NO: 7328 - protein, 43 aa, Staphylococcus epidermidis
LNKSTSCGKRKMQPFQIPCITLAIKTKFDNIYIYRVFQSITAY

SEQ ID NO: 7329 - protein, 683 aa, Staphylococcus epidermidis
RGESVEIFETLLIFVALVIVSSFVHTFIPKVPLAFIQIFLGMILYLTPIPVEFNFDSELFMVTLIAPLLFVEGVNVSRVHLRKYIKPVMMMALGLVITTVIGVGLFIHWIWPELPIGAAFAIAAILCPTDAVAVQAITKGKVLPKGSMTILEGESLLNDAAGIISFKIAVGVLITGTFSIFDAIQQFLIASIGGAIVGLIIGMALVRFRLTLMRRGIENINMFTFIQLLTPFVTYLIAELFHASGIIAAVVAGLVHGFERDRIAQTRTQLQMSYNHTWSILGYVLNGFVFSILGFLVPEVIVKIIKTEPHNLLFLIVITLLVALAVYLFRFVWVYVLYPYFYLSVSPFQKMISKNDEDKVTESKPKRSLYALIMTLCGVHGTISLAIALTLPYLLANHETFAYRNDLLFIASGMVILSLIIAQVILPLVTPDSPEVKIGNMSFKEARIYILEHVIDYLNQKSTFETSYRYGNVIKDYHDKLTFLKTVEKEDENSKELERLQKIAFNVETKTLEKLVDDGEITESVLENYMRYAERTEVYKQASLLRRIIVGLRGMLLKRRVKTKINSASSLSVTDNLLELGKINKLVHYNVVSRLAKEATTDNKLEVGMICDGYLMRIDNLTPNNFFNSRHEDTLTKIKLNALREQRRILRELIENDEITEGTALKLRESINYDEMVIVDSMT

SEQ ID NO: 7330 - protein, 162 aa, Staphylococcus epidermidis
NKRRSFSLMNFNNLDQLYRSVIMDHYKNPRNKGVLDNGSMTVDMNNPTCGDRIRLTFDIEDGIINDAKFEGEGCSISMSSASMMTEAVKGHSLGEAMQMSQEFTKMMLGEDYEITEEMGDIEALQGVSQFPARIKCATLAWKALEKGTVEKEGKSEGTTEED

SEQ ID NO: 7331 - protein, 421 aa, Staphylococcus epidermidis
NCRSFRRVTMKLKPFLPIIISGVIFIIFLFLPASWFTGLVTNKTLADNRISLTDQVLKGTLIQNKLFESNKYYPIYGSSELEKDDPFNPGIALNKQNASKETFLIGAGGSTDLINAVELAAQYDNLKGKKFTFIISPQWFTNHGLTNQNFDARMSQSQINQMFNQKDMPANLKKRYAQRLLQFPHAHNKSYLREQAKHPNDVSGNYISSFKENQLTKIEAIKSLFSFTKPPLAEVKPATREDASWDEMKHKAADIGKANTQSNKYDIRDPYWKLIKQNKRKIKRDYEFNINSPEFQDLKLLVQTLHAAGADVQYVSIPSNGRWYDHIGIKKDRREAVYKKIHSTVVDNGGKIYDLTNKDYEKYVISDAVHIGWKGWVYVDQQIARHMDGHAPKNHEVDYSKNKPPHKHHNDRQDDQHQGNK

SEQ ID NO: 7332 - protein, 48 aa, Staphylococcus epidermidis
PHRRYLNYQNQARIIRKRYKITKSIYDTIEHLILKIEIRKNCSLNQCD

SEQ ID NO: 7333 - protein, 103 aa, Staphylococcus epidermidis
EERRTMHEQDFNILEGKKMTLVELGRELENLTGRTIKDTTSDIKRVIAHLPNFESDTDTFVATYHLNHQNDFIDATFVAPKNQSDRLKEIPVHIKLISYISKN

SEQ ID NO: 7334 - protein, 249 aa, Staphylococcus epidermidis
NIKRSLKMNLNCIKAIVFDLEGTLLDRVKSREKFIEEQYERFHDYFIHVQLADYKNKFIELDDDEDNDKPDLYKEIIKQFHIDRLKWKDLFNDFEMHFYRYVFPYYDTLYTLEKLSKHHYMIGVIANGKSKIKQFRLHSLGIMHVINYLTTSETVGYRKPHPKIFEDMIDQLGVKPSEIMYVGDDALNDVAPARAMGMVSVWYKQEDAELEPLTEEVDYTITTIEELLKILPDNFETEGEEQHGNGFNY

SEQ ID NO: 7335 - protein, 178 aa, Staphylococcus epidermidis
FGKSCTIMFVNYFTISKEWLYMLSVTKKNTYESNKDEVTQMIDSLAEKGQEALKELSKKSQHEINDIVHQMSMAAVDQHMHLAKLAYDETGRGIYEDKAIKNLYASEYIWNSIKDNKTVGIIGEDKQKGLTYVAEPIGVICGVTPTTNPTSTTIFKAMIAIKTGNPIIFAFHPSAQQS

SEQ ID NO: 7336 - protein, 104 aa, Staphylococcus epidermidis
IKESMIKMNEDNRNKQIKFERNLITFPYLGFAFIVLLFNIFYTDVKITMVLFGLFFAYNLGMLFIAFIRHFKRTLILTLILTILSGIAFFVLLYVFGLNHDIFG

SEQ ID NO: 7337 - protein, 154 aa, Staphylococcus epidermidis
NVWRRTLMSEQHNLKEQLCFSLYNAQRQVNRYYSNKVFKKYNLTYPQFLVLTILWDESPVNVKKVVTELALDTGTVSPLLKRMEQVDLIKRERSEVDQREVFIHLTDKSEMIRPELSNASEKVATASSLSKEEVKELNRLLGKVIDAFIETKEK

SEQ ID NO: 7338 - protein, 101 aa, Staphylococcus epidermidis
HSRRQILMENLTKEQKYTIAKFYKLYMERSNAGQPEEEANHFKDSVTAQDDYFCDRKYEDFIHNCKVLINEGYLDGEVEDNKIYNIQVTTKAFTEIERSFG

SEQ ID NO: 7339 - protein, 312 aa, Staphylococcus epidermidis
FYRREIMIYTVTFNPSIDYIIFTDGFEISGLNRAKATYKFAGGKGINVSRVLKTLDVDSTALGFSGGFPGDFIAQTLEDSNIQSDFVQVDEDTRINVKLKSGQETEINAPGPKVTHAQFEQLLSQIRRTTNDDIVIVAGSVPNSIPSDAYAQIAQITEKTGAQLVVDAEKDLVETVLPYRPLFIKPNKDELEVMFNTTVKSDEDVIKYGKEILKKGAQSVIISLGGDGAIYVDQHQSIKAVNPQGHVVNTVGSGDSTVAGMVAGLSMGLNIDEAFQQAVASGTATAFSEDLATRDAIENIKSQVTISVLDGE

SEQ ID NO: 7340 - protein, 801 aa, Staphylococcus epidermidis
RCRRERRGIMNLKQSIEEMIKQPDYEPMSVSDFQDALGLNSADSFRDLIKILVELEQSGLIERTRTDRYQRKQSNKTNSKLIKGTLSQNKKGFAFLRPEDDEMDDIFIPPTKINRALDGDTVIVEIQKSRGEHKGKIEGEVKSIEKHSVTQVVGTYSEAKHFGFVLPDDKRIMQDIFIPKGQNLGAVDGHKVLVQITKYADSTDNPEGHVSAILGHKNDPGVDILSIIYQHGIEIEFPDDVLQEAEEVPDVIEPSEIEGRRDLRDELTITIDGADAKDLDDAIAVKKLKNGNTELTVSIADVSYYVKEGSALDKEAYDRATSVYLVDRVIPMIPHRLSNGICSLNPEEDRLTLSCRMEINERGEVVKHEIFDSVIHSNYRMTYDAVNKIITDQDSEIRSQYKDLTPMLDLAQDLSNRLIHMRKRRGEIDFDINEAKVLVNDEGIPTEVLMRERGEGERLIESFMLAANETVAEHFNKLEVPFIYRVHEQPKSDRLRQFFDFITNFGIMIKGTGEDIHPTTLQSIQEEVEGRPEQMVISTMMLRSMQQAHYDDVNLGHFGLSAEYYTHFTSPIRRYPDLTVHRLIRKYLIENSMDKKEIRHWEETLPELAEHTSQRERRAIEAERDTDELKKAEYMIQHIGDEFEGIISSVANFGMFIELPNTIEGMVHIANMTDDYYHFDERQMALIGERQAKVFRIGDTVKVKVTHVDVEERMIDFQIVGMPLPKKTSSQRPAREKTIQAKTRGKSLDHTKSDRNGKGKKKKRKQRKGKNARKKDKQGNTHHKPFYKDKSVKKKSRRKKK

SEQ ID NO: 7341 - protein, 174 aa, Staphylococcus epidermidis
QNRSVDMTHLIREISIKDVENFISLLSQIYDESEFTFYNPGEYLPTISSASQHLEKYITSPTKAIYVAESDEQLVGYVFVNTETYERTQHEAVVYLGVREYYQHQGIGQALINRIEAWALNHHIRRIEATVVTENINAIELFKGMGFQIEGELKDKLFINQKYYNEYVMAKILN

SEQ ID NO: 7342 - protein, 52 aa, Staphylococcus epidermidis
GVFFIVHYLCTFCAPKIQKPTTTWVAGYIMETAGFEPASRGPDTNLSTCVVY

SEQ ID NO: 7343 - protein, 42 aa, Staphylococcus epidermidis
SASGYLTCVSLSVITAKGVTSEPVPDVVGIHINFAFLGLVIL

SEQ ID NO: 7344 - protein, 220 aa, Staphylococcus epidermidis
IVGGKNKMDKSIITIKQAHSIENVISKSRFIAYIKPVSTENEAKAFIDEIKTKHKDATHNCSAYTVGPEMNIQKANDDGEPSGTAGIPMLEILKKQEIHNVCVVVTRYFGGIKLGAGGLIRAYSGAVRDVIYDIGRVELREAIPVTVTLDYDQTGKFEYELASTTFLLREQFYTDKVSYQIDVVKNEYDAFIDFLNRITSGNYDLKQEDLKLLPFDIETN

SEQ ID NO: 7345 - protein, 354 aa, Staphylococcus epidermidis
IKLGGLFDLENKETNIQEYEEMMTDPDFWNDQTKAQDIIDKNNALKSIVNGYYQLTNAVDDMSATRELLQEEYDEDMKIELEEEVQQFEEQIDQYELQLLLDGPHDANNAILELHPGAGGTESQDWVSMLLRMYQRYCEQNGFKVETVDYLPGDEAGVKSVTLLIKGHNAYGYLKAEKGVHRLVRISPFDSSGRRHTSFASCDVIPDFNNDEIEIEINPDDITVDTFRASGAGGQHINKTESAIRITHHPTGIVVNNQNERSQIKNREAAMKMLKSKLYQLKLEEQEQEMAEIRGEQKDIGWGSQIRSYVFHPYSMIKDHRTNEETGKVDAVMDGEIGPFIEAYLRKEMDSRDV

SEQ ID NO: 7346 - protein, 42 aa, Staphylococcus epidermidis
QHVGDAVRRCSGYYAATAKLLFDLSVIFNRNVLMTEPTLRHA

SEQ ID NO: 7347 - protein, 231 aa, Staphylococcus epidermidis
QLKGDGLMRKCIQCNQPIHETIHIYNLFKPPQIFCERCETLWLNSKIHKDGRCPKCLNNKISTDGECHDCQFLSKTFYLMEQLFCDYSYDGMMKEIIHQYKIKRDFYLAEVLARKLVLPQTQYDYIVPIPSPIERDIERTFNPVTTVLDKMGISYQDVLGTHIRPKQSKLGKIERSKAPNPFYIKDEEINIEGKVILLIDDIYTTGLTIHHAGCKLYDKKVRKFKVFAFAR

SEQ ID NO: 7348 - protein, 226 aa, Staphylococcus epidermidis
YRKGVIIMSQSTHQSTDHKRQSQDKNQTHAYAKVWLYFMYYWMIFGIGCYFGQYLPMSWRKPLSLGLLILILATLFIKRARKYGLVISHIYAIIVGLLSYALFTTYLQNLGAEVFYKNIILAIGAFIAFGIIGYFLIKDASSMGKYLFVTLIALIIAGIIGIFINNPIFHTVITIVSLLLFLLYTLYDFNRMKRGQFSPREMGFNLFINLLNIIEDILSLANRFKN

SEQ ID NO: 7349 - protein, 264 aa, Staphylococcus epidermidis
LKGGAKMNKIQICNQIELNYIDEGEGIPIILIHGLDGNLAGFKDLKNELKKQYRVITYDVRGHGKSSRTESYELKDHVEDLNDLMGALNIDSAHILGHDMGGIIASEFTEKYQYKVITLTIVSAKSEDIANGFNKLMVDYQEELAGFNKSEAMIILFSKLFKEKDKAMKWYQSQKLYNRPTPEESAIAVRALLNIKDLTRVHHNVSIPTLIVNGKYDPLIQNKSHYDMDQYYDQVTKIVFDNSGHAPHIEEPEKFLKLYLDFVS

SEQ ID NO: 7350 - protein, 258 aa, Staphylococcus epidermidis
IRGGIAVISEKRQNLILQELTQKDFLTLQDLVDRTGCSASTIRRDLSKLQNMGKLQRVHGGATIHQNRVKEPKLSEKRTQNLREKQEIAKRAACDIQDHECIFLDAGSSTFELIQYIEAKDITVVTNGMTHVEELLKHGIKTLMVGGQVKPTTMATVGANALETLRRYCFDRAFIGMNGIDVKYGLTTPDEQEALIKETAMKLSNHKYVLVDQSKFNQIYFARVPILDGLSIITSQKAMQSKMTEAYMNEFNFIGGKS

SEQ ID NO: 7351 - protein, 187 aa, Staphylococcus epidermidis; identical to SEQ ID NO: 6259

SEQ ID NO: 7352 - protein, 357 aa, Staphylococcus epidermidis
ESIFNLITKQHKEAINVIKLNQIVKRYHTKDKDVLAVDHVDLNIESGSIFGVIGFSGAGKSTLIRMFNNLESPTSGEIIIDGDNISQLSKSQLRKKRQKVSMIFQHFNLLWSRNVLKNVTFPLEIAGVPSGLAKQKALELIELVGLKGRESAYPSELSGGQKQRVGIARALANDPDVLLCDEATSALDPQTTDEILDLLLKVREQQNLTIVLITHEMHVIRRICDEVAVMENGKVIEQGAVSKVFENPQHEVTKRFVKDDLNDDFEDSLEYLEPLDHDAYIVRLNFTGENTTEPIISYMTKTHNIDVNILEADIKNTKNGSLGFLVIHIPHISEEHFKQFKHNLHEQHVNVEVLKHG

SEQ ID NO: 7353 - protein, 393 aa, Staphylococcus epidermidis
KKRGVPMKKQLFILYFNIFLIFLGIGLVIPVLPVYLKDLGLKGSDLGMLVAAFALSQMIISPFGGTLADKLGKKLIICIGLVFFAVSEFMFAAGQSFTILIISRVLGGFSAGMVMPGVTGMIADISPGADKAKNFGYMSAIINSGFILGPGFGGFLAEISHRLPFYVAGTLGVVAFIMSVLLIHNPQKATTDGFHQYQPELFTKINWKVFITPVILTLVLAFGLSAFETLFSLYTADKVNYTPKDISIAIIGGGVFGALFQVFFFDKFMKYMSELNFIAWSLLYSAIVLVMLVLANGYWTIMIISFVVFIGFDMIRPALTNYFSNIAGKRQGFAGGLNSTFTSMGNFIGPLVAGALFDVNLEFPLYMAIAVSLSGIIIIFIEKGLKSRRKEAN

SEQ ID NO: 7354 - protein, 40 aa, Staphylococcus epidermidis
IVILDTDQSFKLVILNIRFQFFLLQLNNSTYLIYLLKQVS

SEQ ID NO: 7355 - protein, 309 aa, Staphylococcus epidermidis
ITFLTHCVIFIFNKIFYSLYTRLINLTTDVLYIIIYINVYKEGTKMSVSVNIENLTKEYRIYRNNKDRIKDALIPKNKNKTFYALDNVSLTAHEGDVIGLVGINGSGKSTLSNMIGGSISPSSGEITRHGDVSVIAINAGLNGQLTGVENIEFKMLCMGFKRKEIKKLMPEIIEFSELGEFIYQPVKKYSSGMRAKLGFSINITVNPDILVIDEALSVGDQTFTQKCLDKIYEFKAAKKTIFFVSHNIRQVREFCTKIAWIEGGKLKEFGELEEVLPDYEAFLKTFKKKSKAEQKEFRNKLDESRFVVK

SEQ ID NO: 7356 - protein, 45 aa, Staphylococcus epidermidis
LSLIKAKHLFKADIVVILIVNSKYLKSLTSYYTLKFTYDIIIFVI

SEQ ID NO: 7357 - protein, 455 aa, Staphylococcus epidermidis
NSLMILSSLLYNSYKEWWKFMSKVNKPLYFYLMLFLLTTLIGAFLLYLPYTGKKPINFIDALFVASSAFTVTGLSPVDVGTQFNIFGEIIILLLIQIGGLGIVTVAMLTLIFLNKKISINNRILFMITWNIDEPGGVIKLIKHLAIYSIATELFGTLCLCLSFIPKFGIGKGLFLSLFTSVSAFNNAGFALFKNNLIDFSNDPVIIITIPILIILGGLGHLVVVDLWNAKSFRKLSLHSKLVLTTTGLLILIGTVFFFLLENQNSMLHMGLIEKIGNAFFQSVTTRTAGFNTIDVGNIKTPTALLLMALMFIGGAPLSAAGGIKVTTFVIATIAIFNTIRKEKNNSIFNREISERYIQLSFVTILISIAFIGMVTFILTIINSNIPLIKILFEVVSAFGTVGLTMDLTSEYYNWTEFIIIIVMLCGKIGLLNISRALVPPKDPKNYRYTKGHIHL

SEQ ID NO: 7358 - protein, 44 aa, Staphylococcus epidermidis
GDIILSAKRVPVFFNPNTRWGIKFNKKEVVVKKGTFEVFQPGKN

SEQ ID NO: 7359 - protein, 241 aa, Staphylococcus epidermidis
DDIMGRKWNNIKEKKAQKDKNTSRIYAKFGKEIYVAAKSGEPNPESNQTLRLVLERAKTYSVPNHIIDRAIDKAKGAGDENYDHLRYEGFGPNGSMLIVDALTNNVNRTASDVRAAFGKNGGNMGVSGSVAYMFDHTATFGVEGKSVDEVLETLMEQDIDVRDVIDDNGLTIVYAEPDQFAQVQDALREAGVEEFKVAEFEMLPQTDIELSEEDQAIFEKLIDALEDLEDVQNVFHNVDLK

SEQ ID NO: 7360 - protein, 507 aa, Staphylococcus epidermidis
LIIIVIQNEERRIYMQFFINQDTPTSIETIVVGVPDHLNQLGEIKYHKTLIKERLETLKQYHVINSSIGKISSTLIYIDEKPKRLLTVGLGNLKILSYQRLLKVWGQLFQYLKDVHVTDCELLLDTFKSKHGNIVEICQTLGLQSAQSIFEFDHYKSDKKPPYQGRVYIQTTEHNIETKINEGQQLGESINYARELSQIPPNILTPQYFAEEIKKHFEGSSVSVDIKDHRQIIDEGFGLIHAVGKGSNHGPRLITVSYYGAEADEPPISLVGKGITYDSGGYSIKSKIGMQTMKYDMCGAANVIGMIDVISKQNLPVNIVGIIASAENMIGESSMKPDDVFTALNGETVEMLNSDAEGRMVLGDAVFYATQFKPQLILDFATLTGAAIVALGDDKAAAFQSHAENELKNLLTVARHVDEKVFELPITETERHLIKQSDVADLVNHTNGQGKALFAAAFISHFSGDIPHIHFDIAGPATTKSATYKGPKGPTGYMIPTVVEWLQQKYK

SEQ ID NO: 7361 - protein, 290 aa, Staphylococcus epidermidis
KEIIMKKFKWINIFKGFGMGTSDLVPGVSGGTIALLLGIYDDFISSISGLFSRRFWPSLKFLLPILVGMLIAIGLLSQLFNYLLSQHHIPTMLFFTGLILGIIPYLLTISNFKKNFSIIHYFILLLGIAIIVVFALLNHGDKHSGETLTLSFSLIIKYFIAGVFASSAMLLPGISGSFMLLVFGVYGTLMYAISELLHFNLNALPIILIVGFGIVTGFMISSRLIQYCLHQHPTMTFALIIGFVIGSLYAVFPGFPKDLIQWIISFFLLITGFLVSYVLGKITAKNEASF

SEQ ID NO: 7362 - protein, 168 aa, Staphylococcus epidermidis
MIVIKGENMSKTKKTNAMRILDRAKINYQMNTYEVTDKHQHGEEIAQLVGAKIEEVFKTLVLENSNHEHYVFVIPVNETLDMKKAAHVVNEKKLNLMPLDQLKQVTGYVRGGCSPIGMKHSFKTTIDASAKNLEKVYISGGQRGMQIIIHVNDLIDMTKAQVESITQN

SEQ ID NO: 7363 - protein, 41 aa, Staphylococcus epidermidis
RCVIISFVYNERRTIFMHTLIIVLLIIDCIALVTVVLLQEG

SEQ ID NO: 7364 - protein, 41 aa, Staphylococcus epidermidis
ILVIYIIFQVGATIVICTFMIYIVTLSVTRIKNKQKRSALT

SEQ ID NO: 7365 - protein, 208 aa, Staphylococcus epidermidis
CVVMQSRYFARIYFIILFVISMTESHIFNFMTLNLFLAYVPFELCLLLKLFKPVKAFEWPLFIVFGLIFLLLVPNTFYMITDLIHLNQFQFNFLAGLNITEWIYFTYLILGVLLAIYLTILIFLEIAHFTSYVWLNRLLIVILMFLNGLGIYIGRFLRLHTVYLLNAPLKIVKEVFLIIDVKALLFVVLMVLIQATVILFIKGVRLYQ

SEQ ID NO: 7366 - protein, 79 aa, Staphylococcus epidermidis
GGIFMITKEDIVADVVTDYPKSADIFRNAGIDFCCGGQESIASAVNHKPNIDLNSLLNKLNHIDNTEGNSTINPGTFKW

SEQ ID NO: 7367 - protein, 46 aa, Staphylococcus epidermidis
IMSMYYRNYTHYYGVIKKVSNIEKTFKKISECYEMIKLMLIDIMKR

SEQ ID NO: 7368 - protein, 302 aa, Staphylococcus epidermidis
GETMKRYLITGGTGMVGSHLVNEIKQTDAHITILTRQDKTSNHPKITYINWSKEGWQHQVPDIDIVINLAGATLNKRWTSSHKQAMMLSRIQSTQTLFELFETREHKPEVLFNASAMGYYPPDLFTSYTELYRTLPFDFLSEIVYQWERFANKFKQFGTRVVLGRFGLILSDDGGALEMMELPYRLYVGGKLGSGRQWYSWIHIDDLIRGILFTINHDNAEGPFNLTAPIPERQNLFGYTLARAMHKPHETWAPKLILRAVLGQMSTVILDTQKVLPNKLHALGFEFKYNNLRNALDDLIKA

SEQ ID NO: 7369 - protein, 287 aa, Staphylococcus epidermidis
GDAMKIDDYRLLITLDETKTLRKAAEILYISQPAVTQRLKAIEAAFGVEIFIRTKKQLITTTEGSMIIEHARDMLKRERLFFDKIQAHIGEVNGTISIGCSSLIGQTLLPEVLSLYNSQFPNVEIQVQVGSTEQIKAHHRDYHVMITRGNKVMNLSNTHLFNDEHYFIYPKDRKEDVTKLPFIEFQADPIYINQIKQWYNDHLGHDYHATITVDQVATCKEMLLSGVGVTILPKIMMKNIDKNMFEFEKVTIDKKPLIRSTYMSYDASMLQLPQVDAFVNLMLNFIR

SEQ ID NO: 7370 - protein, 66 aa, Staphylococcus epidermidis
PLYILSLPGDASDVCLYILLSQSPTPCFYYIKLGCQCHLKSQINTVYINVLIKSLRLFYYKLIYFT

SEQ ID NO: 7371 - protein, 297 aa, Staphylococcus epidermidis
SYNIEAMILNSKVKGIIAILISAVGFSFMSVFFRLAGDLPVFQKSLARNFVAMFIPLFFIYKYRQPMFGKLSSQPLLISRSTLGLIGVLLNIYAIDHMVLSDADTLMKLNPFWTIVLSLIFLHEKVRKYQITAMIIAIIGMLLIVKPEFSSSVIPSIAGLLSGIFAASAYTCVRALSTREKPYTIVFYFSLFSVVVLIPFSIFTYTPMTTIQILFLLGAGLSAAVGQIGITLAYSFAPAKDISIFTYASIIFTALFGFILFGESPDMFATVGYIVIIGASYYMFDKARRETTINQNN

SEQ ID NO: 7372 - protein, 117 aa, Staphylococcus epidermidis
GGNMRSVIKLENTFIFIITIAVYVKLEFSIWLFLLLLLVPDIFMLGYVINRKTGSYVYNIGHTYITPIIIALLYLYIDERLLLQISLIWLAHISIDRTLGFGLKYSSDTDKTIIQKM

SEQ ID NO: 7373 - protein, 386 aa, Staphylococcus epidermidis
GLNMHIEFKYRYYENEKDYEDYQLEMDNFQDSKIAYRLDEVGDVIHFAEQEQRNGSYVALYVTYEAAPFFNKEMVVNNVKQSHIFAAAYSFKSVNSIKNIKKVMPNKNHIKTEGFYFCESDKAMINKIKSIHKAIIEGATYQVNYTTRLKAEVFCPISHLYYQLTMSQNGNYTVLMDTPDIKVASISPELFFQKGDYKGKSNMIVSKPMKGTMPRGKNVKEDELYYNNLKTSSKDMAENVMIVDLLRNDITRIAQSGTIDVPELFSIEKYDTVFQMTSTVCGRLQDDIQLIDMMRALFPCGSITGAPKINTMQYIAQLEDMPRSIYCGTIGLLLPNQRMIFNIPIRTIEYNHEEAVYGVGAGITIDSVPENEVQEFHDKTKILERL

SEQ ID NO: 7374 - protein, 132 aa, Staphylococcus epidermidis
GENMIKVDQQYFELIEEYRECFDEEIFSARYSDILDKYDYVVGDYGYDQLRLKGFYKDSNKKAEISKRFSSIQDYILEYCNFGCPYFVVRRLSPNEFIEEIDDKEDIIDKLHDVKIQPTIQDTEKHTQAIDQ

SEQ ID NO: 7375 - protein, 198 aa, Staphylococcus epidermidis
GMNMILMIDNQDSFTCNLIDYIKVQTTEEVKIISVNDLMTQHLDALNPRAIVISPGPGKPSDYPILSSVLEIFHRHVPILGVCLGFQLIIEYFGGNIIHNDKPIHGHITKIRHSNEGIFKGLPSYFNVMRYHSLMADPSTIPSALKVTALNNENVIMAVAHHKYPIYGLQYHPESILSEYGHEQLNLFLTEVGVKYAH

SEQ ID NO: 7376 - protein, 134 aa, Staphylococcus epidermidis
DNDICVVYLYLEVQILNEQKLIKLLEFYKQYKALSGYIDKKYKLTLNDLAVLYLAKIYCLDERILMQTFLKLATGELDISRTKILMSIRRLIDKEKLNKVRSNRDERKIFLYMDENNMSEFDALFEDVEKFLSY

SEQ ID NO: 7377 - protein, 247 aa, Staphylococcus epidermidis
RGDIMKIYSQGDQAIVVSIEKNVSQRLTEDLLSLRAYLIDKSYPFITEIVATESDLMICYDARDMIKHHHIQSPFLYMKALIDSIKLEIRHHRQQLQAKYIQKQQSVNIPVIYGGEFGPDLQHLLKHLKLKLEDFVKLHTQEKYFVSMMGYSPGFPYLTGMNKKLHVNHTSEKKKFIPCGSVIMEGKKCGIVTTDTYNDWLVIGYTPVQLFFPEQQNFTLLKLGDNVTFESKDINEIELGDYKTCQS

SEQ ID NO: 7378 - protein, 580 aa, Staphylococcus epidermidis
RRGITMKEQNPLFFLFKRLSWPYGLIIAAVIITSLGSLSGLLVPLFTGRLVDKFSVSSINWGMIAIFGSIFLVNALLSGIGLYLLSKIGEKIIYAIRSLLWEHIIQLKMPFFDKNESGQLMSRLTDDTKVINEFISQKLPNLLPSVLTLIGSLVMLFIMDWKLTLLTFITIPVFILIIVPLGRVMQKISTNTQSEIANFSGLLGRVLTEMRLVKVSNTERLELDNAHTNLKKIYRLGLKQAKISAVVQPISGVVMLLTIAIILGFGALEIGTGAITPGTLIAMIFYVIQLSMPLINLSTLVTDYKKAVGASSRIYEIMQEPIEPTEALSESKDVTIIDGELVFEHVDFKYDVKKILEDVSFSIPQGEVSAFVGPSGSGKSTIFNLIERMYDIERGDIKYGNQSIFDIPLSKWRTKIGYVMQSNSMMSGTIRDNILYGINRKVDDEELIEYAKLANCHDFIMQFDEGYDTMVGERGLKLSGGQRQRIDIARSFVKNPDILLLDEATANLDSESELKIQEALETLMEGRTTVVIAHRLSTIKKAGQIVFIDKGEVTGKGTHHELMASHDKYRHFVTSQKLSD

SEQ ID NO: 7379 - protein, 277 aa, Staphylococcus epidermidis
SKILENESRGIIMSRLSGEQVKIGYGDSTIINNLDVAIPDGKVTSIIGPNGCGKSTLLKALSRLLSIKEGKINLDGKSIHATSTKEIAKKIAILPQSPEVPDGLTVGELVSYGRFPHQKGFGRLTAEDKKEIDWALSVTGTSEFRHRTINDLSGGQRQRVWIAMALAQRTDIIFLDEPTTYLDICHQLEILNLVKKLNEEEGCTIVMVLHDINQAIRFSDHLITMKAGDIVATGQTDEVLTKDILEKVFNIDGVLDIDPRTGKPILVTYDLFCQTYS

SEQ ID NO: 7380 - protein, 151 aa, Staphylococcus epidermidis
NIILNIKEKNKEMQQIYPSVTHPYQFELNKDFNFSAAHYIPFEEAGKCIRTHGHTYYVNLTIAGNTLDKCGFLVNFRDLKKLVHEQFDHYLLNDLPAFKDKSPSTEIVAQTIYHIIQKELNQRENQPKCVQVYLRETPSSYVVYRPKEDQV

SEQ ID NO: 7381 - protein, 148 aa, Staphylococcus epidermidis
LTIFKFKKMGFKIYGYDINREVSLMAISKINDCFELLAMVTYADRLKGIIKKEFSISFEEFAVLTYISENKEEEYYLKDIINHLNYKQPQVVKAVKNLSQENYFNKKRNEHDERTVLILVDSKQRKKIDDLLKRVNNRITEANNENEV

SEQ ID NO: 7382 - protein, 47 aa, Staphylococcus epidermidis
ITILNTPFNRKCLFCLYFNIKLTRYEVFNSTHIALFKHIFFFIFISF

SEQ ID NO: 7383 - protein, 71 aa, Staphylococcus epidermidis
LKILKVNYQANNPTNAAVSKDTKIPANNIIGTYLETKSDVFLSTIPFNVPIIIPIVEKFAKETKNVDITAL

SEQ ID NO: 7384 - protein, 291 aa, Staphylococcus epidermidis
CGIMLLVINMIEIGLTGWGDHDTLYEDLERKTDKLKTYASHFPIVELDASYYAIQPERNIIKWINETPNRFQFVVKIHQALTLHADYRDYAESRDILFKQFKEMINPLKEHNKLAMVLVQFPPWFDCNVQNINYILYVRKQLTDIPMSIEFRHQSWFDNQYKEQTLSFLTQHQIIHAVVDEPQVKEGSVPLVNRITSEIAFVRYHGRNHYGWTKKDMTDQEWRDVRYLYDYSNDELADLARKVEILNQKAKKVYVIFNNNSGGHAANNAKKYQNILDIDYEGLAPQQLKLF

SEQ ID NO: 7385 - protein, 42 aa, Staphylococcus epidermidis
WQVMINTDILLHLKNYQININHALINEWKGVVFYISFVKMSF

SEQ ID NO: 7386 - protein, 79 aa, Staphylococcus epidermidis
GGYISMSKTLELVFKSNLNKPVKLLLPDFNAITTEQLIKESMNQLLELDILRFSLGKPVKIYAAQLIDKSTTVIFEDKN

SEQ ID NO: 7387 - protein, 202 aa, Staphylococcus epidermidis
EFNMIIYILINIAIVLLILGFDLYRHRFRQLKFSSILLSVLINSMIDIFAINQFNFITMFTVTLFMIWTLLQIYLNFKLYPFVISDQKFIAIILAIVISLLQFITDKSSTQSVYMSIPYLSPTIFIIGAILLFVGTFKIDEVERLSLFRKIKRPMTTGTIIIILSLISTMILTPFWYVFLIIYSLLIGFILWQGVFFIKDKK

SEQ ID NO: 7388 - protein, 359 aa, Staphylococcus epidermidis
FYDILKKLSYKKLEKLQTNTHLSYLNGIKGIITLKLNRRIHAWRRDMENKPDYFHHIEHRKFQSSSKITLWLSLVITMIFTVVEFVGGIVSNSLALLSDSFHMLSDVLALGLSMVAIYFSSKPPTKNYTYGFLRLEIIVAFLNGLALIVISLGIMYEGIMRIIHPRPVESGIMILIAFIGLIANIVLTIILMISLKKENNINIQSALWHFIGDLLNSLGIIVAFVLIHFTGWNIVDPIISILISLIILRGGYKIIKNASKVLMERVPDRYDTDEIMGAMKDVEGVIDIHEFHLWSVTTNQSSLSAHVVLSDDYIKSPYATINKVSDLLKTQYGLEHVTLQIENINLNHLDEEYFKQLQE

SEQ ID NO: 7389 - protein, 425 aa, Staphylococcus epidermidis
LRDIMKNTQKICYFFSVKSLLLRFIDYSHTSFSMFKIIFGKEKNKVVKTMKVLVAMDEFNGIISSYQANRYVEEAVASQIEDADIVQVPLFNGRHELLDSVFLWQSGNKYRVSAHDADMKETEAIYGQTDSGMTIIEGHLFLNGKKPIQHRSSYGLGEVIKAALDNHTEHLVISLGGIGSFDGGAGMLQALGATFYDDEAQIVDMRKGAYLIKYIRRIDLSGVHPQLTKVNIQLMSDFSSRLYGKKSEIMQTYESLDLSQNEAAEIDNLIWYFSELFKNELKIAMGPIERGGAGGGIAAVLNSLYQAEILTSHELVNQITHLENLIQQADLIIFGEGLKEEDQILETTTIRIAELTQQYSKPAIAICATNDKFDLFESLNVTAMFNTFIDMPDSYTDFKMGIQIRHYTVQALKLLKTQINLPLSS

SEQ ID NO: 7390 - protein, 74 aa, Staphylococcus epidermidis
IYCIITSYIFELFLNYFNFKIKFILFNYKNAPQKLKFSLAFGVHNIVLSILICFQSMTGLKMYLCQAYYINNSE

SEQ ID NO: 7391 - protein, 313 aa, Staphylococcus epidermidis
GECMLTTDRLVNTLNLELLTGEEGLDRPIKNTDISRPGLEMAGYFSHYASDRIQLLGTTELSFYNLLPDEEKKGRMRKLCRPETPAIIVTRGLEPPEELIQASQETHTPIIVAKDATTSLMSRLTTFLEHELAKTTSLHGVLVDVYGVGVLITGDSGIGKSETALELVKRGHRLVADDNVEIKEITKDELVGKPPKLIEHLLEIRGLGIINVMTLFGAGSILTEKQIRLNINLENWNKNKLYDRVGLNEETLKILDTEITKKTIPVRPGRNVAVIIEVAAMNYRLNIMGINTAVEFNERLNEEIVRNSHKSEE

SEQ ID NO: 7392 - protein, 98 aa, Staphylococcus epidermidis
PPGIPRSIMTVFKLARDAYTAAVIPAGPAPIIATSTSTSVILNASYLLIIMRIIYHTFHFINLYAQYKFNCFIQFVSRNIKIVHQLPLGKWLARTTIR

SEQ ID NO: 7393 - protein, 109 aa, Staphylococcus epidermidis
GILMTKISVVVYGAEVVCASCVNAPTSIDTYQWLQALLLRKFPQHHFEFTYIDIRNDTENLTDHDMQFIERINEDELFYPLVTMNDEYVADGYIQYKQITRFIKSYFTM

SEQ ID NO: 7394 - protein, 110 aa, Staphylococcus epidermidis
MNLIPTVIETTNRGERAYDIYSRLLKDRIIMLGSQIDDNVANSIVSQLLFLQAQDSEKDIYLYINSPGGSVTAGFAIYDTIQHIKPDVQTICIGMAASMGSFLLAAGAKR

SEQ ID NO: 7395 - protein, 101 aa, Staphylococcus epidermidis; identical to SEQ ID NO: 6275

SEQ ID NO: 7396 - protein, 56 aa, Staphylococcus epidermidis
GKLITFAIKYYQPESDDVLVGLFYFIIETIMFLNHMLKGIMIYQVNLIIMKRFLNI

SEQ ID NO: 7397 - protein, 150 aa, Staphylococcus epidermidis
SFLIYFWLNQWLTKEGDSMKVVYYSFSGNVRRFISRAGIKDTFEITQDNCNESVNEPYILVTGTIGFGEVPQPVQSFLNVNHTQLQAVAASGNRNWGQNFAKAGHTISEEYKVPLMMKFEVQGTNKDIIEFKDKVGNFNENHGRKEIQSY

SEQ ID NO: 7398 - protein, 117 aa, Staphylococcus epidermidis
LLLIARNFSFIKQLYTTYLKNNQFVQLKMELNGYRDALYGGGKSAKSLMTKKDIKMSNKIANAMKRLEKVIDNSHEKIDARAIREYVNKYPIIEGQVIHINSCLDNDISGTYIYYSA

SEQ ID NO: 7399 - protein, 55 aa, Staphylococcus epidermidis
KQIIFNSLKNSTRSLDIIKKVGLRIHLESIVLPHNVNIAYIKFEIFLTNNYYNFF

SEQ ID NO: 7400 - protein, 175 aa, Staphylococcus epidermidis
IKIIKGARKLTQGRQKDELKDITLLGNQNNTYEFDYRPEVLETFDNKHQGRDYFVKFNCPEFTSLCPITGQPDFATIYISYIPNIKMVESKSLKLYLFSFRNHGDFHEDCMNIIMNDLINLMDPHYIEVWGKFTPRGGISIDPYTNYGRPDTKYEKMAEHRLMNHDMYPEKIDNR

SEQ ID NO: 7401 - protein, 95 aa, Staphylococcus epidermidis
SKSIIFATSFMNYSRSFFKYMKLISKSIYLSFIFFIFSLMLFTNQSFANDNKRFQLKPGDIIVTKGPVLNGFLVTVVWQLIMTLYFKLKVQGINQ

SEQ ID NO: 7402 - protein, 335 aa, Staphylococcus epidermidis
NMSIIIENSGLFSSFQDFGRKGYEHEGVIPSGALDELAHEIANRLVANDKNEATLEMTQKMATIRFTEPALIALTGGNFKAETEHMKIYPNKLYLINEGETLKFNETSRTSRVYLAVGGGFKLEKWLHSASTDFNVEIGGFEGRKLKKGDEIELKHHYSQRHLKLFDNLSDKRTTDWGIDGYALSFNYVSDVFHVIKNKGTEDFKKEATRRFTTAEYSVSSKTNRVGMVLDGPQIKAYYDDMPAHQSVKRGTIQVKRDGTPIVLLNDHYTLGSYPQIGTIASYHLTKLAQKPQGSKLKFQFIDIETAEKNLIKYSNWLNQLFHGIEHRMQLEMLK

SEQ ID NO: 7403 - protein, 61 aa, Staphylococcus epidermidis
DTVFTLVKVQIVLWTFANAFWFVAKNNKSTKQIDKITATELKNKFFNFISLPTFLLRFILS

SEQ ID NO: 7404 - protein, 81 aa, Staphylococcus epidermidis
GKTMSNHNYSDEKIEVIDPSDDRYKGDDYFNKNSSQNNQNLKTFNQTYSYGCTHSGCGCILGCLTISLISFLLSLLIFWII

SEQ ID NO: 7405 - protein, 216 aa, Staphylococcus epidermidis
LMTIAQNGGFLMFSKKKDKFMVQLEEMVFNLDRAAIEFGKMDFNTHLDLKAYSDNIKTYESHGDELMHQVISDLNQTFITPIEREDILSLCNAIDDVLDAMEETSAMFEMYSIEYTDEYMAEFVENIQKAVAEMKLAVGLLVDKKLSHMRIHSINIKEFETNCDGILRQSMKHIFNSETDPITLIKIKDIYQSMEEIADKCQAVANNFETIIMKNS

SEQ ID NO: 7406 - protein, 237 aa, Staphylococcus epidermidis
MAKIPVLEIFGPTIQGEGRVIGRKTMFVRTAGCDYRCSWCDSAFTWDGSAKEDIKLMTAEEIYDALLEIGGHRFNHVTISGGNPALIKGIQELVDLFEDKHIYTALETQGSRFQSWMTQIDDLTISPKPPSSGMKTNLEILDSVINQCTFHSLNLKVVIFDDADYDFAKLIHHRYPNIPFYLQVGNPYLDDNVDQHTDKLLERYEQLVDRVMQSSDMNHVYVLPQLHTLLWSNKKGV

SEQ ID NO: 7407 - protein, 305 aa, Staphylococcus epidermidis
LKKMTSNEKEMGKSELLVVTGMSGAGKSLVIQSLEDMGFFCVDNLPPVLLPKFVELMAQGNPSLQKVAIAIDLRGKELFKSLVKEIDIIKSRNDVILDVMFLEAKTEKIISRYKESRRAHPLNEQGQRSLIDAINEEREHLSEIRSIANYVIDTTKLKPKELKQRISKFYLDENFETFTINVTSFGFKHGIQMDADLVFDVRFLPNPYYVEELRPFTGLDEPVYNYVMKWKETQIFFDKLTDLLKFMIPGYKKEGKSQLVIAIGCTGGQHRSVALAKRLAEYLNEIFEYNVYVHHRDAHIESGGR

SEQ ID NO: 7408 - protein, 358 aa, Staphylococcus epidermidis
VGEIMKLAIIIPVYNAEETIKRAILSVDTSVPYEIICINDGSTDQTQHVLTELQQKHPHIKVIHQSNQGAARSRNVGLEAMSEDVDAFLFLDADDEFLPSRIDLMVNAFNKNKETDVVIGQMARDVNGEWQVISTHQSMVKDAIVTLDRKPDILQSIGPGAKLFSSKYAGLRFDEDVVFCEEHTFIVKAFSKARDIQLIPNIVYGYNEREGSVTAQRADTFLPYMSDALKVRQRVMELLLLLDEKIYYSYRMDNLIVSYLIQAHLKKNNKITQSLLESVIAYMKAMQHTHYSGEAMFRIVRAVEQSATHWTKPLYLQWKKALSEVGIGRPGLIRFKLQVIPKKISFSGKESLKRIFKK

SEQ ID NO: 7409 - protein, 68 aa, Staphylococcus epidermidis
LKEIRGSLMIYLQNFITTTIQLNIYLILVIGLLYVIIHYYRNKGVNAFLDIYLNYIPGTYSRIWPRLI

SEQ ID NO: 7410 - protein, 168 aa, Staphylococcus epidermidis
IILIIQKVTVPLILELLNGESLRQYIQSAYHETLKEEFKNLTPYMTKLAKVHGRSHPYLLKLQDLYREFGDSMLDHIRKEDEEDFPKLIQYSQGQDVQNIKIILEDLINDHEDTGQLLNVMNQLTSDYQTPEEACGTWKLVYQRLQNIERQTHQHVHLENHVLFKKVS

SEQ ID NO: 7411 - protein, 91 aa, Staphylococcus epidermidis
GRMINAVVIAVILMIILCLCRLNVVISLFISALVGGLISGMNLEKVINVFGKNIVDGAEVALSYALLGGFAALISYSRITDYLIVSYTTGN

SEQ ID NO: 7412 - protein, 91 aa, Staphylococcus epidermidis
CLVIRSANMKKLLFIITVIILTIVVSACGNESKRDIKQFERQYEEIHQKQHSVEKVMDKIPLKELDNLSKTDTTDKNKKEFVHFNRILITI

SEQ ID NO: 7413 - protein, 355 aa, Staphylococcus epidermidis
KEPITIFSIRSQIIIGVISSVILTTIILVIAYKLMWFNGHMTLTLAITTMITSCLTLSICSIFINPLIQKIKQFNIKTKQFINHEKFIDDETFQSPREIKELNDSFNKMAYEINNQMNMIKNEQQEKTEIIQNLAHDLKTPLAGIRSYSEGLRDGVISDPQEVHEAYEILIKQANRLSILFDDITHVINLNTGRSYPLELIQLDQLLVNILQPYEQHIKQENRTLEVNFCTDIDAFYQYRPPIERILTNLLDNALKFSNSGSRIDIIISECKENDVISISIKDEGIGIVPELQSRIFERTFRVEDSRNTKTGGSGLGLYIANELAQQIDASITVQSDLDIGTTMTLTLKKFQFKK

SEQ ID NO: 7414 - protein, 217 aa, Staphylococcus epidermidis
GETMLTEEKEDYLKAILTNDGDVSFVSNKKLSQFLNIKPPSVSEMVGRLEKEGYVETKHYKGARLTEEGLKQTLDIIKRHRLLELFLIEILQYNWEEVHQEAEILEHRISDLFVERLDKILNFPKTCPHGGVIPRGDQYKEIFTTSILNFEPGERVTVRRVRDKTELLVYLSSKDIYIGNTVEIVSKDDTNKVIILKRNDIVTILSYENAMNIFAEK

SEQ ID NO: 7415 - protein, 521 aa, Staphylococcus epidermidis
IEKMCLLIYLLIRRKRHMNEFFATLSDRKGQLFSTIIEHIQLSFIALFIATLIAVPIAILLTKTKKLSEIVMNIAAVLQTIPSLALLGLMIPIFGIGRLPAIIALVVYALLPILRNTYTGIKEVDPSLIEAAKGIGMKPLRRLTKVELPIAMPVIMAGIRTAMVLIIGTATLAALIGAGGLGDLILLGIDRNNSALILIGAIPAALLAIIFDFILRYMERLSYKKLLISLGTIVIVIIIAIAIPMAAQKGDKITFAGKLGSEPSIITNMYKILIEEDTDDTVEVKDGMGKTSFLFNALKSDEIDGYLEFTGTVLGELTKEDLKSKKENDVYQQAKSSLEKKYDMTMLKPMKYNNTYALAVKRDFAKKYQIKTIGDLRKVEDKLKPGFTLEFNDRPDGYKAVKKTYHLNLSNVKTMEPKLRYTAVKKGDINLIDAYSTDAELKQYNMVVLKDDQHVFPPYQGAPLFKEKYLKDHPEVKKPLNKLANRITDEEMQEMNYKVTVKKEDPYKVAREYLEKEKLIK

SEQ ID NO: 7416 - protein, 95 aa, Staphylococcus epidermidis
RGEIIPMIIEVILMVCLIIIQLMIGHLWHQIGWSYTKAILLMCLPLGIGLYLMQLFYYEPRYTNWEVPLKTKLNLKYMYILTLLEYILIYVCFFM

SEQ ID NO: 7417 - protein, 440 aa, Staphylococcus epidermidis
LKEILNMPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 7418 - protein, 219 aa, Staphylococcus epidermidis
IVVFSYLHSLSLNIIHKRIYYENELCYSMSDFIVYIIFINEEYFMYANVQPFIKNESVKQFTYEYNKVKDVLFTILDSPIKYTQHIGGTCHFNYQTEPILDILVGVNNLHDITSLDEKRLNYAGFYRLHHSYKKKVVMARFNNLSELKQEVRLHIIQMETSLFKQYQTVNHLLHNDKAIAEWFASKKNEIVQHAKKIREYESQKQNLFEKLYKESNLLS

SEQ ID NO: 7419 - protein, 295 aa, Staphylococcus epidermidis
LRRISIKMKIAVMTDSTSYLPQHIIEQYNIPVASLSVTFDDGVNFTESDDFSVDDFYKKMASSKTIPTTSQPAIGDWIENFERLREQGYTDVIVINLSSGISGSYPSATQAGEMVEDIQVHTFDSRLAAMIEGSFAIYAAQLVQKGYKPDDIINELTEIRQHIGAYLIVDDLKNLQKSGRITGAQAWVGTLLKMKPVLRFEEDGKIHPHEKVRTKKRALKSLETNIFKEIEGMEDVTVFVINGDKTEDGKSFLQQLKEDHPNVHIQYCEFGPVIASHLGSGGLGLGYFPRRIDIN

SEQ ID NO: 7420 - protein, 252 aa, Staphylococcus epidermidis
GRGILIMQIKLPKPFFFEEGKRAVLLLHGFTGNSADVRQLGRYLQKKGYTSYAPQYEGHAAPPEEILKSSPFVWFKDVLDGYDYLVDQGYEEIAVAGLSLGGAFALKLSLNRDVKGIITMCAPMENKTEGSIYEGFLEYARNFKKYEGKDQQTIDQEMEQFHPTETLRELSDTLNGVKEHVDEVIDPILVVQAEQDTMIDPQSANYIYNHVDSDEKEIKWYQHSGHVITIDKEKEKVFEDVYQFLESLEWTE

SEQ ID NO: 7421 - protein, 48 aa, Staphylococcus epidermidis
LKVLKKCFNKITIIIILLKHSQPYILLIKIFKKENLFEFKGNMESSHK

SEQ ID NO: 7422 - protein, 42 aa, Staphylococcus epidermidis
ASFVPCENDCNAAVKIWKNLKLRLVRVKFEFLKTILTIVYII

SEQ ID NO: 7423 - protein, 102 aa, Staphylococcus epidermidis
MTFVSHQRHLPIFFKKCVLFFQSISIYIVKGGFIMNEVNQVTIIFTQIKHNSEGKVVEHKRRFSNINPLVSNDQIKSFRSIIERISGEEYDKVEIVKTESLI

SEQ ID NO: 7424 - protein, 567 aa, Staphylococcus epidermidis
NYSVSELILIFCKHSIIYVGDIIVKKLTKMVLSYKLYPTLMLIMSVFLSFTVVAQNISISHFLNHLLYYQQQSLLLLLSVIFISLILRATFNMLIQFLGDHLAFKVKHMLREQVILKKSVRSIGEEINILTESIDGIGPFFQSYLPQVFKSMLIPIVIIITMCFVHLPTAIIMIVTAPFIPLFYVIFGLKTRDESKDQMTYLNQFSQRFLNTAKGLITFKLLNQTKQSEQQLYKDSTRFRDLTMRILKSAFLSGLMLEFISMLGIGLVALEAALSLVVFNHINFVTAAIAIILAPEFYNAIKDLGQAFHTGKQSEGASDVVFSFLESEDKADSPTLKVDEQQFEQVLIKHVDFQYANSNHMALKNISFSVNKGEKVAIVGPSGAGKSTLAKLLSQSVTPTHGTLSFNQASLNIGFLSQRPHIFADSIKNNIAMYDDEICDEQVIQVLDEVGLKEKVLSLKYGIYTSIGEGGEMLSGGQMRRIELSRLLLLKPDIVIFDEPAIGLDIETEKVIQQVLEHHFSTTTVFIIAHRDSTIRSSARRIYIESGHLIKDDSIISVTRSEVKIDQ

SEQ ID NO: 7425 - protein, 322 aa, Staphylococcus epidermidis
CRYVIINEDILNRRVCVVMATRNEEILRKPDWLKIKLNTNDNYTGLKKMMREKNLHTVCEEAKCPNIHECWGARRTATFMILGAVCTRACRFCAVKTGLPNELDLNEPERVAESVELMNLKHVVITAVARDDLRDQGSNVYAETVRKVRERNPFTTIEILPSDMGGDYEALETLMASRPDILNHNIETVRRLTPRVRARATYDRTLQFLRRSKELQPDIPTKSSLMVGLGETMEEIYETMDDLRANDVDILTIGQYLQPSRKHLKVEKYYTPLEFGKMRKIAMEKGFKHCQAGPLVRSSYHADEQVNEAAKEKQRQGEEQLN

SEQ ID NO: 7426 - protein, 49 aa, Staphylococcus epidermidis
PIHVTLCECLTLLLVIAVQTLIFVIIKVTALAFFYFKKIFYYKYNRINI

SEQ ID NO: 7427 - protein, 43 aa, Staphylococcus epidermidis
YFNVKLHIKTKYFGETLEGTGQAEDYRLKLSPKKASQQYEVLL

SEQ ID NO: 7428 - protein, 62 aa, Staphylococcus epidermidis
FNNVCNMLTDFTKTVAKYIIWYIDDESEMTLWDVNGTTLKRKKPKKIKILVEYMPNLVKKYM

SEQ ID NO: 7429 - protein, 91 aa, Staphylococcus epidermidis
NNNVNSKQKKWVTIMIWYVCAAFFPCILVVLFSVVTRSKWIGTLVTLVIIGASVYKGFFHNEWIIFIDVTSLLAGYLIIDQLEFHKNQNDS

SEQ ID NO: 7430 - protein, 172 aa, Staphylococcus epidermidis
LLNVGVFNYRKRVLIMKKISLFIIFLIRVISGIVIFRQGWEKFTGDFTLNGLVPVIRDNTDSPQWYKWFFEHIVAHTTGLFNIIVPLGEMAIGLGLILGIFAYAASFFGAFVMINYILADMIFTYPLQLAFFIILLMSHSLLAKVSLKEIIAYFRDRNNRGEDKHDPLTNRG

SEQ ID NO: 7431 - protein, 49 aa, Staphylococcus epidermidis
VVNVPRCHTADTILMNHYNKMHIKQVLELKKARHHFEFDISLHINKRTM

SEQ ID NO: 7432 - protein, 279 aa, Staphylococcus epidermidis
EANVMLLTIILLILIGGLSAILGSIVGIGGGIIIVPTLVYLGVNHHLLHGITTQIAIGTSSVILIVTGLSSSLGYLKTKQVDIKNGSIFLFGLLPGSLVGSFLSRYLTLDSFNLYFGVFMIFVSILLMIRHKIKPFKIFDKPKYARTYVDAEGKTYRYSVPPLFAFITTLFIGLLTGLFGIGGGALMTPLMLIVFRFPPHVAVGTSMMMIFFSSVMSSIGHIFQGHVAWGYSIILIISSVIGAQIGVRVNRSMKSDTVVMLLRTVMLIMGVYLIIKSFI

SEQ ID NO: 7433 - protein, 40 aa, Staphylococcus epidermidis
IVCVIRLFELSFMFDLHYKLKFMVLKLKCSIKIDVPNKIT

SEQ ID NO: 7434 - protein, 59 aa, Staphylococcus epidermidis
PKCVDDGANPPTRLISSGTPVESKNVPSIQINLTKYLVKLSIKQFDTAYNHIKDGPIKQ

SEQ ID NO: 7435 - protein, 219 aa, Staphylococcus epidermidis
DKFVFKNEREVNNMSGISKFISAIVVLLLLIGLAFGIYSFVDSSKKGNERLSDKTTQQEKKKDDKDKKEKKDKKSVEEKKNNTQQTQQVPQTQQTQQTQQTVQTPQRPTTQTPVRQNPQTGEKRAKEPKTDERKKTRQDSSNFKESPNEKDQSSTQQKPQQNKSNQSSENRQSTQNKSNQTQSTRPQNNGNSGNQNASSGQNTQKQNNNNQNSQSSKKD

SEQ ID NO: 7436 - protein, 283 aa, Staphylococcus epidermidis
RNCLKFYQIILKQKEKNNMAMDLITKQDGTTLHYSTMGQGYPVVLVHTAFDNYAVFNDLAKVLAKSFQVVLIDLRGHGYSDKPRNIEFYDFADDIKFLLDAIYIDEAAFIGHEMGALIAADMSVRNPGYISSITLVNPTSIEGELPEERLFRKYAHKIRNWEDDKQEKFLDKRRYYKARKMNKFLKHVVDTNSISTKEEIQAVKDVFKSEGIADVFKHVQVPTLIVAGEHGERTTTLEAKEVADLIQHCEFNVYQHSSAYPFVEEQAQFTQETTNFIQQHAPK

SEQ ID NO: 7437 - protein, 86 aa, Staphylococcus epidermidis
LNHVNSLLMLLSNQIKNAFSIFRKFEKAFVEMFFLSSSKVILYVNWHHFYFRRLPGFLGHIPPPLSIRVKAYLICINPTIVLMFRQ

SEQ ID NO: 7438 - protein, 97 aa, Staphylococcus epidermidis
FFNVTSCGELSNTSFVNVLRLNAAKHNTETVIADTTVITVRENAFFLTRYIIGDVNITSVTLTVPFLNRCIALNINETVLLKKKYDPITVKNKIAKG

SEQ ID NO: 7439 - protein, 425 aa, Staphylococcus epidermidis
CFNVLSCSFKLIPIDEIKMLFLQGIHKKIGYEGSNIIFCIMPNLCQYKNLFSQEEMNDIIKIIIEYRLHVAFSIDKIEQIYELNQLFTYQYENLKIMNKCSVSDYNVQFIFNLNEKSIREIYRNILKIQNIELEYKIGLDISCMFNDTAQFKSLASQIKRLKFDYLYIDNARLKSSYLLDNEEGLLLKNILQFKHLIDDLKQFDFSSENLIFLNLYNHQLLNNNEIDLSNSAPLLFKTISKLKKHFKGYGLNVFSNPKVFNAVHLFDENGFKTTFGLIFNHLSWMTNQNQIEQRFYNIIENADQYYLYLYDWRVIESESNESDFKDVDIWINFEDEALIDEYICVIAKVDDEGGNINHMISQNLRHKYVWSTPFLMRVEENFRPYMHIMEHDFKKGPLKIRMKYNAVYLVEIYKKDKINKRRSTT

SEQ ID NO: 7440 - protein, 47 aa, Staphylococcus epidermidis
NINVPIKLKRNHTDDINNFNQFIADGKLCRFTKIKVKTYVGGRYENR

SEQ ID NO: 7441 - protein, 800 aa, Staphylococcus epidermidis
MSLVYLMATNLLVMLIVLFTLSHRQLRKVAGYVALIAPIVTSTYFIMKIPDVIRNKFIAVRLPWMPSIDINLDLRLDGLSLMFGLIISLIGVGVFFYATQYLSHSTDNLPRFFIYLLLFMFSMIGIVIANNTILMYVFWELTSISSFLLISYWYNNGESQLGAIQSFMITVFGGLALLTGFIILYIITGTNTITDILNQRNAISRHPLFIPMILMLLLGAFTKSAQFPFHIWLPKAMAAPTPVSAYLHSATMVKAGIFLLFRFTPLLGLSNVYIYTVTFVGLITMLFGSLTALRQYDLKGILAYSTISQLGMIMTMVGLGGGYAQHTSDELSKFYILVLFAGLFHLMNHAVFKCALFMGVGIIDHESGTRDIRLLNGMRKVFPKMHIVMLLAALSMAGVPFLNGFLSKEMFLDSLTKANELDQYGFVLTFVIISIGVIASILTFTYALYMIKETFWGNYNIEKFKRKQIHEPWLFSLPAVILMLLIPVIFFVPNVFGNFVILPATRSVSGIGAEVDAFVPHISQWHGVNLPLILSIVVIIIGLILALVVNWKEVTHQIIKSASITDGYRKIYREFELYSARGIRALMNNKLNYYIMITLFIFVAIVVYGYLTVGFPHVHQLHISSFGPLEVILSVVTLIIGISLIFIRQRLTMVVLNGMIGFAVTLYFIAMKAPDLALTQLVVETITTILFIVSFSRLPNIPRVKANLKKETFKIIVSLVMALTVVSLIFVAQQADGMPSIAKFYEDAYELTGGKNIVNAILGDFRALDTMFEGLVLIIAGLGIYTLLNYKDRRGQDERE

SEQ ID NO: 7442 - protein, 46 aa, Staphylococcus epidermidis
KMLVKFFPKSILFSIIFIKLRKIRNNLIFFEYSKCYIANSSINFKR

SEQ ID NO: 7443 - protein, 43 aa, Staphylococcus epidermidis
RFIVSPHLKIKSCHLIDTYYYYSYFIHFLANKMSKTFFNMHLK

SEQ ID NO: 7444 - protein, 237 aa, Staphylococcus epidermidis
KRIVKVMEATCMDKKKLIKTLINVLPIVIVPLVTERKRIKEHPDVQKVTNATSKATSKTTSAISNKASDVKEYVGDKKQEFDNKRELKKIAKENDPAYIEKKGEKLAKQNRKEADKMDKKLQKNIEKRHKEEQKQREANQKQRIKDMKKTQKYEEQVGLTPGKIDHEIEKKGEKLEKDNRKDIKKLDKKLQKNIEKRHKEEQKQREEAEKARKKEFKKYENYVADSVVKQHKESNHS

SEQ ID NO: 7445 - protein, 143 aa, Staphylococcus epidermidis
MMIVIVTLTLRRWIDMAIVNKVIIVEGKSDKKRVQQVIAEPANIICTHGTMSIDKIDNMIETLYDKQVYVLADSDDEGEKIRKWFKRYLSESEHIYVDKTFCEVAKCPKNYLAHVLSRYGFNVKKEKKLMNNLKTERLVLVNE

SEQ ID NO: 7446 - protein, 489 aa, Staphylococcus epidermidis
GRVVMADLINILNHFVQEQPEAVAVRHTNDELTYKQLDEESSKLAHLLQDSKKPMILYGHMSPYMIVGMIGAIKSGCGYVPIDTSVPKERVNMIIDKVQPEIIFNTSDETLEQTNAQVLKVSDIQDSQYPIVFDSQMKQNDVVYTIFTSGSTGEPKGVQIEYASLNEFAEWMVSLNKTGTGKEWLNQAPFSFDLSVMAIYPCLTSGGTLNLVDKDMIKKPKLLNEMLVQTPMNVWVSTPSFIEMCLLLPNLNEQQYSSLKQFFFCGEILPHKTAKALVERFPNSMIYNTYGPTEATVAVTSIQITEEILNQYNPLPVGVARPGTKLFATEEGELVIEGQSVSLGYLKNEEKTTAVFNFEDGVRTYHTGDKAKIEDGLWFIQGRIDFQIKLNGYRMELEEIETQLRQSKHVREAVVVPVYKNGKVIHLIGAVVPTEPVEDNLAMTTHIKHELKSRLPEYMIPRKFEWMEQLPLTSNGKLDRKKIAEVVNG

SEQ ID NO: 7447 - protein, 637 aa, Staphylococcus epidermidis
LMQVIIMQESKNLMRIKSNLKQPMKQTSRDGVSLRKLKNNKGNVIMQETLSHYFGYKSFRPGQEEIITKILNHQHTLGVLPTGGGKSICYQVPGLMQGGTTIVISPLISLMKDQVDQLQAMGIQAAYLNSSLTHKQQKEIEEQIKRGAIQFLYVAPERFENTFFLNLLRKIEIPLIAFDEAHCISKWGHDFRPSYQSVIQKVFTLPQNFTIVALTATATAEVQQDIMSKLSIGQNDVVKTSTKRRNLIFKVNPTYQRQKFVVDYVANHEGQAGIIYCSTRKQVEELHEALNSEKIKSTIYHAGLTNKERIEAQNDFLYDRVEVVIATNAFGMGIDKSNVRYVIHYNMPGDLESYYQEAGRAGRDGLKSECILLFSERDKGLHEYFITVSQADDDYKDKMGEKLTKMIQYTKTKKCLEATIVHYFEPNENLEECNQCSNCIQENKTYDMTREAKMIISCIARMKQQENYSVIIQVLRGEVTDYIKHHHYNELTTHGLMKNYTTSELSHLIDELRFKGYLNENDEILMCDTSVKQLLNNHTKVYTTPFKQKTKEKVFINTVEGVDRALYRELVDVRKQLSDKLGIAPVSIFSDYTLEEFAKRKPESKQEMIAIDGVGSYKLKHYCPKFIETIQSYKTRI

SEQ ID NO: 7448 - protein, 160 aa, Staphylococcus epidermidis
VKQVVLNIVIAFLWVLFQDEDEFKFTTFFAGFLIGLIVIYILHRFFGEEFYLKKIWVAIKFLAVYLYQLITSSISTINYILFKTNEVNPGLLTYETSLKSNWAITFLTILIIITPGSTVIRISKNTNKFFIHSIDVSEKDKENLLKSIKQYEDLILEVTR

SEQ ID NO: 7449 - protein, 61 aa, Staphylococcus epidermidis
DNKVYSCKVTRLHNHALLSIECDNRELMITFTVRDIKQFEVCSGYTDVKAKKNYTGIFIRL

SEQ ID NO: 7450 - protein, 639 aa, Staphylococcus epidermidis
ERKVYLVASIMSFNEIIFKNFKQNVTHYAIYLLSLVISVVLYFSFVTLKYAHHLHGNQSFPAIKEGSQVGSYFLFIIIVVFLLYANFLFLKRRGRELSLLQIIGLTKKDIMKMIMLEQLMTFMMTTIVGIILGIFGSKILLMIVLRLLGINVSVSIIFNYHAILETLLLIAVSYVLIVFQSYVYLLKRSIKELASDVNKKEFSHTRTTLGEVVLGLLGIIMIVSGYIMSTKLVDNVETIIQPFAILFLTVIGSYFFFRSTVSLIFKAIQRLRNGTVSVTDVMFTSPIIYRVKKNAFSLTVMTVVSAITVSVLCFAALSRSTLTNEVLLSSPHDVTLKNQKQANELAFKLNNRNIEHYYNYKEVVYAKVYKDHLFSEGVYRPKEITVTSDKYIPNVSTKKGQTDIIIPRGSLKDVVKTDKKRTAYVGSKKFRLKVSLRKGINKVYFMSDVDRGRPTLILNDEDYQKIREHIKEKNIVSQYGFDLKNKNDLPELEKLVSSINEDIETRSEAASEISSLTGILLFVTSFLGITFLIAAGCIIYIKQIDETEDELENYTILRKLGFTHQDMSKGLKLKVIFNFGLPLIIALLHAYFASLAYMHLMNVTNQIPIFIVMAVYTATYAVFAIIAYNHSKRTIKHSI

SEQ ID NO: 7451 - protein, 439 aa, Staphylococcus epidermidis
EEKVMTTKTLNISEEQLVDYSKAHNEPSWMTELRKKALKLTETLEMPKPDKTKLRKWDFDTFKQHHTTGDAYTQLTDLPKSVKEIIDVENSENLIIQHNNELAYTQVSDQAKHDGVIIEGLSEALVNHSDLVQKYFMTKAVDVDEHRLTALHTALVNGGIFVYVPKNTVVEHPIQYVVLHDDEQASFYNHVIIVTEESAEVTYVENYLSTTSGEDNQLNIVSEVIAGANSNVTYGSVDYLDKGFTGHIIRRGSADADASINWALGLMNEGSQIIDNTTNLNGDRSTSALKSVVVGTGDQKINLTSKIVQYGKETDGYILKHGVMKENASSVFNGIGYIKHGGTKSIANQESRVLMLSENARGDANPILLIDEDDVEAGHAASVGRVDPEQLYYLMSRGISRAEAERLVIHGFLDPVVRELPIDDVKRQLREVIERKVSK

SEQ ID NO: 7452 - protein, 471 aa, Staphylococcus epidermidis
NQGVIKMAKQAPDVGDYKYGFHDEDVSIFRSERGLTENIVTEISKMKEEPQWMLDFRLKALKLFYKMPMPQWGGDLSELDFDDITYYVKPSEHTERSWDEVPEEIKRTFDKLGIPEAEQKYLAGVSAQYESEVVYHNMEKELEEKGIIFKDTDSALRENEELFREYFASVVPAADNKFAALNSAVWSGGSFIYVPKNVKLDTPLQAYFRINSENMGQFERTLIIADEGASVNYVEGCTAPVYSTSSLHSAVVEIIVHKDAHVRYTTIQNWANNVYNLVTKRTFVHENGNMEWVDGNLGSKLTMKYPNCVLLGEGAKGSTLSIAFAGKGQVQDAGAKMIHKAPNTSSTIVSKSISKNGGKVIYRGIVHFGRKAKGARSNIECDTLILDNESTSDTIPYNEVFNDNISLEHEAKVSKVSEEQLFYLMSRGISEEEATEMIVMGFIEPFTKELPMEYAVEMNRLIKFEMEGSIG

SEQ ID NO: 7453 - protein, 58 aa, Staphylococcus epidermidis
VGLVYFMKFITIKAITEKGLDKKVNQFLKSHPQIEIIKFDYQMGYSGVSVGILYRDNI

SEQ ID NO: 7454 - protein, 224 aa, Staphylococcus epidermidis
EDEVVVTKALLPSQQRIDLNSSMLLEKSLIKYRRHIMKRIAVYCGASKGKNPSYVKEAYELGKYMAEQGYELVFGAGSVGIMGAIQDGILEHGGKAIGVMPKMLDEREITSQKVSELILVDSMHERKNKMTELADAFIMAPGGAGSLEEFFEMYSWAQIGIHQKPIGVFNLNGFFEPLQHLIDHMIKEGFIDEKYQKLAPLYDTKESLIEGLKHYKPLGVRTYD

SEQ ID NO: 7455 - protein, 65 aa, Staphylococcus epidermidis
LKFLRRRIYLSLKEIWKVLINKKWQTEEICYLILYIFLASIFTTPLFGIPLGVLAYLYLNEEILK

SEQ ID NO: 7456 - protein, 54 aa, Staphylococcus epidermidis
CLLLIQVKTYFTHFLISINLLLVLKIPYYYSIENHIDGVYNLNTRPKSYKCIKL

SEQ ID NO: 7457 - protein, 59 aa, Staphylococcus epidermidis
FSLLVFIKLYERALFFKYFNVKLHINTKYFGETLEGTGQVEDYRLKLSAKKPSQQYKVL

SEQ ID NO: 7458 - protein, 176 aa, Staphylococcus epidermidis
LQLFRLSVRSQFQDSSGKDVSSMEIIKDIVSLIASILIFLGSIIALISAIGIVKFQDVFLRSHASTKSSTLSVLLTVVGVLIYFIVNSGFFSVRLLLSLVFINLTSPVGMHLISRAAYRNGAYMYRKDDASRQSTILLSQKEFNTPEELKKRAKLREERREKLYYKEKEYINKMDD

SEQ ID NO: 7459 - protein, 181 aa, Staphylococcus epidermidis
ELIFMKPKVLLAGGTGYIGRYLSRVIEHDAQLFALSKYPKPDKGSTNKITWLKRDIYNHKDVVEAMKGIDIAVYYLDPTKHSAKLTHATARDLNFIAADNFGRAASINKLKKIVYIPGSRHDNEAIERLGAYGVPVDCTDVEVKRPHINVELQTAKYDDVRTAMKMILPKKMDAQSTCRLF

SEQ ID NO: 7460 - protein, 52 aa, Staphylococcus epidermidis
ITIFLDSQLLYKYLFHLSIQKLCHFNVIINMKWQSFLIFKEKIKQGGIAYGQ

SEQ ID NO: 7461 - protein, 50 aa, Staphylococcus epidermidis
LKSFWAFYYHTVLYLFIKDSTTRLIYYYSFTNIIYNLVKIIVSHNIEEML

SEQ ID NO: 7462 - protein, 309 aa, Staphylococcus epidermidis
IGTLKIICERVMLQMKSKLWIVICALIVVLAACGQDANHSSNNKDTEKSDKKYHRIISLIPSNTEILYRLGIGEDIVGVSTVDDYPKDVKKGKKQFDAMNLNKEELIKAKPDLILAHESQKNSAGKVLKSLKDKGVKVVYVKDAQSIDETYDTFKSIGQLTDREKQAKELVDETKHNVEKIINSVPKHHKKQEVFMEVSSKPDIYTAGKDTFFNDMLEKLDAKNSFDDVKGWKSVSKESIIKRNPDILISTEGKSKSDYIEMIKKRGGFDKINAVKNTRIETVDGDEVSRPGPRIDEGLKDLRDDIYKK

SEQ ID NO: 7463 - protein, 69 aa, Staphylococcus epidermidis
PMTLLWLAILILLTVLGKKMSNQAIKNNQVLIAKLIATITTFCAFVLVYLLMQSIMPHIIKLMNVFYHH

SEQ ID NO: 7464 - protein, 52 aa, Staphylococcus epidermidis
KLQLIFEIDLINRYFKVGVDKSVSMILSLIIFNKIMRHLCKNLISSLLRICK

SEQ ID NO: 7465 - protein, 291 aa, Staphylococcus epidermidis
SMFLLELIKGIILGIVEGLTEFAPVSSTGHMILVDDMWLKSTNFLGSQSAFTFKVVIQLGSVFAAAWVFRERFLEILHIGQHKPEPSTSGDRRSKPRRLNLIHVLVGMVPAGILGFLFDDLIEKYLFSVPTVLIGLFIGAIYMIIADKYSKTVQHPQTVDQINYFQAFVIGISQAIAMWPGFSRSGSTISTGVLMKLNHKAASDFTFIMSVPIMLAASGLSLLKHYEYIHLAHIPFYILGFLAAFIVGLIAIKTFLHLINKVKLVPFAIYRIVLVIFIAILYFGFGIGKGI

SEQ ID NO: 7466 - protein, 117 aa, Staphylococcus epidermidis
LIKFYQYPKCTTCKKAAKFLDEHDVNYESIDIVQHTPTKKEFKNIVDKTGVNINKLFNTHGIKYRELNLKEKLKNMSDDEKLELLASDGMLVKRPLAISGNHLTLGFKENEYQHQWL

SEQ ID NO: 7467 - protein, 55 aa, Staphylococcus epidermidis
SPKFSVEVKEINTGINAEAKLVALAKPKCINILNKVINAIVAMIGKCLRPIKPNV

SEQ ID NO: 7468 - protein, 40 aa, Staphylococcus epidermidis
KAKLRILIEMFYRDNKLVFELPVENLTKGLNINLVINKKA

SEQ ID NO: 7469 - protein, 98 aa, Staphylococcus epidermidis
MNKLKDIEDITVNFNKEKHLIFGYTPMCGTCKISERMLDIANEILQLPIKKIDLNFYPEWSKEKQIMSVPVLLLMRREEEIKRIYAFQSVTYLLENLK

SEQ ID NO: 7470 - protein, 59 aa, Staphylococcus epidermidis
FNKFNDHYPLLDYIRFVNTIDLYNLKYLFRNYDYIFCIIVLSVSDEYLSPKPKVLSILI

SEQ ID NO: 7471 - protein, 325 aa, Staphylococcus epidermidis
LMKFIFKGYTLFILLVILTIVSLFIGVSQLSLIDIFHLSDEQINILFSSRIPRTVSILLSGSSLALSGLIMQQMMQNKFVSPTTAGTMEWAKLGILMSLLFFPNGPILIKLLFAVVLSIVGTFLFVQLINLIRVKDVIFVPLLGIMIGGILSSFTTFVALRTNALQSIGNWLTGNFAVITSGRFEVLYLTIPLLILAFVFANHFTIAGMGKDFSHNLGVSYEKIIKIALFITATLTALVVVTVGTLPFLGLIVPNIISIYRGDHLKNALPHTLMLGAIFVLIADIIGRIIVYPYEINIGLTIGVFGTIIFLILLMKGRKNYANER

SEQ ID NO: 7472 - protein, 449 aa, Staphylococcus epidermidis
LETSTIISLVIFFLLIALTTVFVGSEFALVKVRSTRIEQLVDEGNKSAKIVKKMIDNLDYYLSACQLGITVTSLGLGWLGEPTFEKMMHPLFELLHLPSPLTTTISFVVSFIVVTYLHVVLGELAPKSFAIQHTEQLALLYSRPLFYFGNFMKPLIWLMNGSSRVIVRMFGFDPDAQTDAMSEEEIKIIINNSYNGGEINQTELAYMQNIFSFDERHAKDIMVPRTQMVTLNEPFNVDELLDTIKEHQFTRYPITEDGDKDHVKGFINVKEFLTEYASGKPIKIANYIHELPMISETTRISDALVRMQREHVHISLIIDEYGGTAGILTMEDILEEIVGEIRDEFDDDEVNDIVKLDDHTYQINGRVLLDDLNEKFGIEFEDSEDIDTIGGWLQSQNTNLQKDDFVDTEYDRWTITEIDNHQIIWVNLNYEFNSGRPSVNEEQEDDERD

SEQ ID NO: 7473 - protein, 502 aa, Staphylococcus epidermidis
FMTSNKSHEKAVQEIPQHGFFGHPKGLGVLFFVEFWERFSYYGMRAMLIFYMYFALQENGLGMDKTTAMSIMSVYGSLIYMSSIPGGWIADRITGTRGATLIGAILIIIGHICLSLPFAMVGLFTSMFFIIVGSGLMKPNISNIVGRLYPENDVRMDAGFVIFYMSVNMGALVSPIILQHYIDIRNFHGGFLIAAIGMALGLVWYLLFNRKTLGSIGMKPTNPLSSSEKKKYGTIIGIVVIAIVLILMIAYFTHTLSFNLISNTVLILGIALPIIYFTTMIRSKEVTDTERSRVKAFIPLFILGMLFWSIQEQGSNVLNIYGIENSDMKLNLFGWKTHFGEAIFQTINPLFILLFAPVVTLLWQKLGKKQPSLPIKFAIGTILAGASYILMGAIGHIYGDTQFSVNWVILSYVICVIGELCLSPTGSSAAVKLAPKAFNAQMMSLWLLTNASAQAINGTLVKLIKPLGQTNYFIFLGVVATVITLIILAFIPKISKAMKGIR

SEQ ID NO: 7474 - protein, 135 aa, Staphylococcus epidermidis
YNEFVIKVKKLWEVFYMPTVILTEAAAFEVRDMLKNNDMSDGYLKIKVNGGGCTGLTYGMSAEAEPGENDEILEYYGLKVLVDRNDAPVLNGTTIDFKQSLMGGGFQINNPNAIASCGCGSSFKTAKVAGNPEQC

SEQ ID NO: 7475 - protein, 50 aa, Staphylococcus epidermidis
RWFLNSKQMYLYSFCIRYSFMIYRPHNFRYINYIRDLLSNTFHYKHIIDL

SEQ ID NO: 7476 - protein, 41 aa, Staphylococcus epidermidis
NMKLLDIIYIMLKKTYTKNFINLLARCSIWLIQKEIIKRKK

SEQ ID NO: 7477 - protein, 547 aa, Staphylococcus epidermidis
GMTTLLGELESKATSINKKNLVIQDFDTKCPNRNIFVVGGPGSYKSAGYVIPNVIVKNQQSIVVTDPSGEVYEKTSNIKRMQGFDVRVVNFKNFLASDRQNFFDYIDKDSDCSIVAELIIKSAGDSKINKDVWYKASVGLLNSLLLYAKYEFEPEKRTIGNIIKFIQNNKPNQDEEGSVELDKRFNELSKDHPARESYEFGFAVSEGRTRASIILTFVADLRNYIDNEIRSYTSDSDFDLRDVGLRKTIIYVMLPVLGNTVQSLSSLFFSQMFQQLYRLGDENGARLPVPVDFLLDEWPNIGAIPDYEETLATCRKYGISITTIVQSISQAVDKYNKDKANAIIGNHAVILCLGNVNNDTAKYIKEELGNATVEFETSSEGSSSGKDSRSKSSNKNVSYTGRALLNEDEISNMQQDKAILITKNRNPKIIKKLAYFKMFPNLTETYIAPQNEYKRKKNQSMIDKHNRLREEWDKKQEKNKQQKLEEYKEEQRQKELEKEQQPQEEQQNEKVKESKDKNDQEDKKDEQQKINDSKKAFYEKLKQKQAK

SEQ ID NO: 7478 - protein, 55 aa, Staphylococcus epidermidis
MKVTNTIRFEEEKKNLIDNVVNTLEEYKDVIDSELRTIRNTNHLVMRNNLVLLQS

SEQ ID NO: 7479 - protein, 1026 aa, Staphylococcus epidermidis
KVLTKKYLNTQNEISAFWNTQKIFKKSIDNRKGQESFVFYDGPPTANGLPHAGHVLGRVIKDLVARLKTMQGFYVERKAGWDTHGLPVELEVEKKIGIKGKQDIEKYGIENFINECKKSVFNYEKEWRDFSKDLGYWVDMDSPYITLENNYIESVWNILSTFHKKGLLYKGHKVTPYCTHDQTALSSHEVAQGYKNVKDLSAVVKFQLTNSKDTYFLSWTTTPWTLPANVALAINKDLNYSKIRVENEYYILATDLINSIITEKYEIIDTFSGSNLINLKYIPPFESDGLVNAYYVVDGEFVTNSEGTGIVHIAPAHGEDDYQLVLERDLDFLNVITREGVYNDRFPELVGNKAKNSDIEIIKLLSKKQLLYKKQKYEHNYPHCWRCGNPLIYYAMEGWFIKTTNFKNEIINNNNNIEWFPSHIKEGRMGNFLENMVDWNIGRNRYWGTPLNVWICNDCNHEYAPSSIKDLQNNSINKIDEDIELHRPYVDNITLSCPKCNGKMSRVEEVIDVWFDSGSMPFAQHHYPFDNQKIFNQHFPADFIAEGVDQTRGWFYSLLVISTILKGKSSYKRALSLGHILDSNGKKMSKSKGNVINPTELINKYGADSLRWALISDSAPWNNKRFSENIVAQTKSKFIDTLDNIYKFYNMYNKIDHYNPNNEITKSRNTLDNWALSRLNTLIKESNIYVNNYDFTSAARLINEYTNTISNWYIRRSRGRFWEQGISNDKKDAYNTLYEILTTLSRLVAPFVPFISEKIHYNLTGKSVHLQDYPQYKESFINQALEDEMHTVIKIVELSRQARKNADLKIKQPLSKMVIKPNSQLNLSFLPNYYSIIKDELNIKNIELTDNINDYITYELKLNFSSVGPKLGNKTKNIQTLIDSLSEYDKKSLIESNNFKSLSSDAELTKDDFIIKTLPKDSYQLSEDNDCVILLDKNLSPELIREGHARELIRLIQQLRKKKNLPINQRIDIYIGVTGELLESIKTNKNMFKENLLIKNIHLNVIDEYENTIHFNNKEIKISLLY

SEQ ID NO: 7480 - protein, 214 aa, Staphylococcus epidermidis
LSFALRINFIDNYTLKTIYNAILERIITIMANIGYARVSTRDQSLDLQIDALSNFGCEKIFSEKVSGRKVNRTELDKCLDYLREGDTLVIYKLDRLGRTTKQLIDLAQWLENNNIELQIIDMNINTKDPMGKMFFTMMSAFAELEANLLSERTKKGLESARARGNMGGRKAMPQEKKEYIKHLYDTKEYTGQEIAKKTNVSRDTVYRILREFKK

SEQ ID NO: 7481 - protein, 160 aa, Staphylococcus epidermidis
YSYFTLYFYEHMFYNLVEVFTDMKIINPNMPEPYKYETDYRNIPREYLNPHIPKGRGIVKWNAFKTIPQQYEILEQHIEDQNKINMPLLSDDQLQEINEKVSSKISKNILTDLDYWKDGYIYSIQCYINKIDEFNGFMIITNSNSNNKLKIPLSSIVSVQ

SEQ ID NO: 7482 - protein, 54 aa, Staphylococcus epidermidis
KFPYYIKQTWPLYFSRVAMSYQSQAKGDKLCIILIILNYQLKIFKKYFLLQGDM

SEQ ID NO: 7483 - protein, 575 aa, Staphylococcus epidermidis
YMAYSKGNYKKKKIDSIIEELNNKLDDFKNNDKTYKEFLDTTAKFHNYSINNIILIAGQNPEATAVAGYKAWKNKFDRQVQKGAKSMNIIAPIVQKRNVEIKDDNGNIVRDNNGNPKTERKPVITGYRAHNVFDVADTKGKPLITAKDLIKTEFENSNDYKDLYNEFKDYINEELTPSVEEKHFLDDPTLSNGAKGYYSPKSDEIVISDDLSYDMRFKTLIHEYAHSQLHNNDIGKTQISEHSRSLKEIEAESSAYVVANYYGLDTSDYSLGYLSGWGHNISDDELKAHIKNIHSFAKTTIEEINSLPEFSQYIDKKLESEMNKDVYKDLSTMIDTNLKNGFDKITIIKGNLVNDYGLNEISENSYENDDFKVNIDYKGFNTNNSQDQAKIELINKHDDSLNRDYNFTQTYNRNVINNTTTIFVQDDDNEDKNKKYIHERDIDGNILEEKHKLSSQDEIVSFENFVNKSVEENGLKDTLRQFVSNGVLMGYELNVDNIDNTNETYFSMNKNQQNGQRSNMTAKLEHDTNENVYIDFKIKNSAGIKNISYTESNEEFNKDEQNKEIENKQEEEIDI

SEQ ID NO: 7484 - protein, 95 aa, Staphylococcus epidermidis
YMDYTNQKRKYIIFGIVLAITLLIVGIAYYLISLNNAKGQVKEFEKLVQHNDYNSIAKKLSNKEETLSENDAKNFVLFVKSKENQEQYNEQIQKN

SEQ ID NO: 7485 - protein, 64 aa, Staphylococcus epidermidis
FLYLRHNADSSSCSINFYICATTPILVRVVLIFISAPQRRFFSYLYYINTCHVMQCLGLLFKLS

SEQ ID NO: 7486 - protein, 111 aa, Staphylococcus epidermidis
NLNLSNEKVIIKLIKNMEVLFMADIQKMLEQKEKLQEKIKEEKKKEYEKFGRWFFNKFKVNRSADAKKIINKNLLNIEDTKEHNLERNEIIEETKNSNEENKEINEINHNI

SEQ ID NO: 7487 - protein, 46 aa, Staphylococcus epidermidis
YTSQPIITLLRKVIISVINTIVYNTLISLFIFTNICSIIWLRCLLI

SEQ ID NO: 7488 - protein, 548 aa, Staphylococcus epidermidis
VFIKKRSDLIMRFTPRGILNNTDYELNSEFYYVPASDKQMNDQRDMTNKSIVGNLVYRNNFYNEVYTQPVYDLDDSNEKYQTPHIISIDDSEFDYNLTNLDDYFTKDTANKGYEKLVNAIKSEEITYFDSDINEVDDFTQQDEYSNDWYTNTFVDLVLSMKGYSYHVEPNRESVIEDSHIITENDITYNVSYNPEKHHLYINDFPAIPIEENDNIRLLNDNLTQDMEKTYDNINYNFSYNDFKTLEDDSYIYIDLTDYKDNEGKFVKNLIEDIPPNEIIKDRLKQNINLFDERANYNALAVYRRDLEDFSDRNNLDSLDKVKDLKTFYDTEINIKGLNINNDIEKKALNNQLAFNLYNEPLNNMFRDNNVLYEVYEKEIYDEKIPLSIEDRKEVKTYLDDARNNFSNNFYEYTTNKSSILAENSLTVLDKAKYDLEFAPVSNHLYKERENFYEGMKQATLPLHNITKEQYKERENDIEIIGHFKNYINTELHGTKSSEFKPNFVNDSLENETNSIAFEDIINGSEETHSNIINSIKNELKQERDNLEM

SEQ ID NO: 7489 - protein, 102 aa, Staphylococcus epidermidis
KTYKIIGLLIAKSTVVNTLKIGGFIMILLSTAGENAVHINPIFRFFLYFIMCVPMTVALCTIFLKFISIFILPWKVCLYIGIALGIIVTIFLLVITIGIEMT

SEQ ID NO: 7490 - protein, 200 aa, Staphylococcus epidermidis
TMYNFDYSKLPIKNIQKIFPIAGGYVNLSFSVDASNKKYFLKLQPNTKSNFFDYELSSLKELTDKNIPVPQIINKGELDNNSFLLLEFIENGHAYPESYRKLGKIVANMHKNINSLNLFGFSHNFNGGTIEFTNKWTSSWGDLFIKSRMDKLCSEIYKKRLFSISDLLLYEDIRKIMLKSLYYHQSSPSLRFCCKVEFIV

SEQ ID NO: 7491 - protein, 159 aa, Staphylococcus epidermidis
KEDKKVKKGIFILTGIIWLVLIYLAQILAYALNTLSNTSNKQKIFSDISQLFIPPAKHPISTIIGFVSDKNTVFFVIGVIATIICIYILIKQLFESKDGNEKNQDYKIAKHGSHGSAKFAEDSELFSEGHYKKMKENDITNYVYNSLDKSLIEERSDKE

SEQ ID NO: 7492 - protein, 431 aa, Staphylococcus epidermidis
IGGNLMKIRNFNEGTLVGKHNHLEYIINVDLCHISDIDEIRYDLTEPNELFFEVKDLQKEGDYFHIIYNTDNEYNSFLSAKKESKALKLSLMDYVLKVDPLKDNITVMHPANLFFKNIEDIKIGFKGHEYLPKPKINNLEQYKLLIMSTLSQYTFDKYYRNKFEVLSKEKDDFFHKVNNAETFEKLKEIVRHELNQVQTDYLLNEEKRKRETRKKYIRNLILGFVGIAIVISLISFMIINGKQQELDSKIAQADKQEQRSKVYENLYNGNVDQAVKGMKRDDSFNKKDIEKTLKKEKKYEELIELSSKNTPYVIEQLYKEGKQNKIRELAFNFENNDTLSLEKKILDKDGTAFSVGSTGKYEEQSKRLALASAKEGYVESAKDINKKLKDNEVEEEINKAEIKQLKEEKDSTKDKDKKKEIQKDIEELEKK

SEQ ID NO: 7493 - protein, 77 aa, Staphylococcus epidermidis
IVANGYSDDVLVKLFISEIVHIAYSFLLKLYYKINFATEPDHLSEATYHRIFVDDIIYKSSISQASIPTQRGGANLC

SEQ ID NO: 7494 - protein, 53 aa, Staphylococcus epidermidis
IVANRYSDNILVKLFISEIVHTEDSFLLKLYYKFNFATEPVKQCYAKLQCFYP

SEQ ID NO: 7495 - protein, 44 aa, Staphylococcus epidermidis
IVANGYSDNIFVKLFISEIVHTEDSFLLKLYYKFNFATEPNYFS

SEQ ID NO: 7496 - protein, 40 aa, Staphylococcus epidermidis
IVANGYSDNILVKLFISEIVHTEDSFLLKLYYKFNFATEP

SEQ ID NO: 7497 - protein, 57 aa, Staphylococcus epidermidis
IVANGYSDNIFVKLFISEIVHTEDSFLLKLYYKFNFATEPEEICGSFYIERKYIQCL

SEQ ID NO: 7498 - protein, 40 aa, Staphylococcus epidermidis
IVANGYSDNIFVKLFISEIVHTEDSFLLKLYYKFNFATEP

SEQ ID NO: 7499 - protein, 249 aa, Staphylococcus epidermidis
NNHNDLAEGRKFTSIKVKKDWVMMMFKKKNKQNKNNEQQFEIINRYIKGDGRNQSIQEDSLIAGFYKDYVVTKDGYISGGLNITGVNTELLTKFEQNDLLEEYSSFISNILYDEPMIKTITEPVNIQNYIKHLYRQVLLDMKNNNNKPTRRGQLIAGRILFLQEKLAKGEMSTKKHYIFFSEKITENTVAQLDHAVNRLHEKINLNKEALQQAFSHYGLETRPIYQTEYLNQFYALYDYKGYNDYHLSN

SEQ ID NO: 7500 - protein, 48 aa, Staphylococcus epidermidis
NNSNTNDIKFIGVFYCTLTILLKGIFSLLFELELVIIINPLNSSILLM

SEQ ID NO: 7501 - protein, 56 aa, Staphylococcus epidermidis
VFQNADISFWVFKYFFVKTFQPPRVSLISLFLLLVLVNFHEIHFLSCLHRKIYWIK

SEQ ID NO: 7502 - protein, 162 aa, Staphylococcus epidermidis
KMKKLLTIVILFTLVLAGCGQNQSEKNSEKHNEEKTVDTTEERNDMIKGLIEYGYENDDYKGYKHMKDILSEKLQKQAELQNQSAQTKGVKKETKDIKLYQDVDNDDELIYSIKLSITNKKEKNSDYSMRYGKIELTEEEGKQKIDNVEELTQRNLVSMNQE

SEQ ID NO: 7503 - protein, 140 aa, Staphylococcus epidermidis
KGVNYMSVEQEVKDIMLDMLGEEKKVKENIIPRNVDASYKIFLNLNGKELAIVFVPFLLFLTIAFGVTFLMGLLNLITGFMVFIVGLIFGLTIYGLLTIRPISTKENIRMIDTIKQSQRFSRRQKVYFYKSKEGLGDDDV

SEQ ID NO: 7504 - protein, 74 aa, Staphylococcus epidermidis
NYTKAQKGGYITMNNNEENSVFFGKKKKVSLHLLVDPDMKDEIIKYAQEKDFDNVSQAGREILKKGLEQIKSNK

SEQ ID NO: 7505 - protein, 45 aa, Staphylococcus epidermidis
AQQKIVATINLSLMMTYHFKTIKGRVKTRSFLKNRSDLDESNKYN

SEQ ID NO: 7506 - protein, 87 aa, Staphylococcus epidermidis
IMNEYRIQKLYRYICLEFKNQRQLIGKRQEEVAFDLSVTAGHLSRIENGKKPRIALHTFLVMSEYYGVDFHKVVKNAEEKMELDEGI

SEQ ID NO: 7507 - protein, 111 aa, Staphylococcus epidermidis
IIMDKKETKHLLKIKKEDYPQIFDFLENVPRGTKTAHIREALRRYIEEIGENPPIPSKEHTAPLKEHTEPIKRNKESFKDAMERKDQLKQAEMPKIEEKDEEMVDISIDDL

SEQ ID NO: 7508 - protein, 261 aa, Staphylococcus epidermidis
ITMEVVRLNQNLFNKLRGNEISSNKNGSRPYYYSFKRNNNRVCIPFRTNAQKVPNKYKINLGGEQPDKPNSAIDLTKSIVISNDEYLNNRSKAKIPQNVNNFLKQQAPAIEQKYDTMSNDYIKAKASLSKIPLVKYSTMQYFHKELNIQDSIDNQQTKNAINELISNGKSNKYNKLQSSLPNEKLNLLDDYETLYEFKSLTDYPAKINSNDIDNPFLEVEKNNKHFTLSALTIKNEPEKHVKDFLNYDIENEKNKDIDLDL

SEQ ID NO: 7509 - protein, 42 aa, Staphylococcus epidermidis
NRRCGADIKINTARKETTIEIKTHYIVLRRRILRLFFIKFME

SEQ ID NO: 7510 - protein, 143 aa, Staphylococcus epidermidis
LEKCYLNKERKIFMINKVIYSGRIATDLKLRKSKNEKSYVFFNIAVPRQFDNDRTDFINCVVWGKQAESLVDYQSKGNLIIIEGSTETYKKDNINMSRCLVEKTIFLESKKENKKHDVSEDDAISPAEDSGNDKSISDDDLPF

SEQ ID NO: 7511 - protein, 360 aa, Staphylococcus epidermidis
SIMWSAIAKGITMLMKKKALSKILKPVIAIVIGFFLLIFIMIAYLVGSFTKEINESGEQKMKEAESTATGACTGGSVDGSGISAFEKNAKGGALEGKGKDMVKIAKKNKIPPKLFIAIVASESEWGRGANATKQKNPLSIMGAGPLQVYPSIEEGLDKGAKNLYDLYISEGLTTPEKIGPKYAPVGASNDPDDLNSNWVPTVKKIMKSFGGKEAKCSTESSGGGSDGKGFDFKGEFPKPDKSKYNGQSYPWGQCTWYVHQRRKEIGKPVPLTWGNGGDWGDNAKAQGWEVGSKPKAGAGASVKPGNFGAPPPYGHIMFVEKVKKDGGIVVSEANVKGLGVISSREFSKAETQRMQFIYDK

SEQ ID NO: 7512 - protein, 370 aa, Staphylococcus epidermidis
LCNRTRYIKLIFEFLKKERNANAVILDPHKNNPRAIRAYQKSGFRIIEDLPEHELHEGKKEDCYLMEYRYDDNATNVKAMKYLIEHYFDNFKVDSIEIIGSGYDSVAYLVNNEYIFKTKFSTNKKKGYAKEKAIYNFLNTNLETNVKIPNIEYSYISDELSILGYKEIKGTFLTPEIYSTMSEEEQNLLKRDIASFLRQMHGLDYTDISECTIDNKQNVLEEYILLRETIYNDLTDIEKDYIESFMERLNATTVFEGKKCLCHNDFSCNHLLLDGNNRLTGIIDFGDSGIIDEYCDFIYLLEDSEEEIGTNFGEDILRMYGNIDIEKAKEYQDIVEEYYPIETIVYGIKNIKQEFIENGRKEIYKRTYKD

SEQ ID NO: 7513 - protein, 129 aa, Staphylococcus epidermidis
LCNRTPKKNSKSFREAVKGIFKFTDINLAREAKNRLIHDYIDQPKYSKACASLDDGFEDAFQYTVQGNSHNRLKSTNLIERLNQEVRRREKIIRIFPNQTSANRLIGAVLMDLHDEWIYSSRKYINFDK

SEQ ID NO: 7514 - protein, 678 aa, Staphylococcus epidermidis
LERREFMIMAFLKKKSQEQVTNKIHNESFQKLTEVLDTDSVDSIYPFSWIEKKSHIETGENYIKNLLVVDYPQSVKGAYLSNLLKKNGNIQITKFIRPANIERMIDHLNNSIKNKTAEQMRTTDPKRNATIKREIESSKKQLDKFLDEKTGFMYMYMYITLNGDSYEKIQALEKDVKRTLTRLRLKTHTPTNAMRESFHTVLPLNRNFLSAFTQQNMDTATAGHFFMFDDSEIIDLTPNTSVFGINKNTDSLVAVDFNNKEKTLNKNMTIIGTSGVGKSTLNMRMILDNIKKSIRQFIIDPEDEFSYITKYYGGTVVNISTSSNIKINPFEIFSEEVFEKEDETDNETTSDVLTENNEHESQIDTLVRSKIGKLKTFFRVLKDEISQTEISVLSSTLRQLYQDKGFKGNAKLSDFKSEDYPTLTELYNKLKDLDPEKYEVLKDLTLIIEDYTMEHGTTTIFDGYTNIKLDNEIVTFNLKPLQTEKDVQSAAYLNIFSFLWDEITKDRTTETVLMTDELHFLATNEYSLDFYYQAYKRIRKYGGGAIASTQQIKDILRTSQEIGSAIIENSHTKFFFGMDNVGVDDVVDKLGLKFSDQEISHLTKKKKGEALLLYGTQRAFIRIDLDREETRLWNKELYETIYEEPADVEPNYVEQLGLTDIDLAELEEELRQAEMIYE

SEQ ID NO: 7515 - protein, 68 aa, Staphylococcus epidermidis
KCRRYNMLKTYTEIIGSELPIYITKSETSELLFSEELDKNLKYEVAGYYLYNAKKDLYKELYKPISEV

SEQ ID NO: 7516 - protein, 353 aa, Staphylococcus epidermidis
IICGGFIMSNVYVMALDFGNGFVKGKINDEKFVIPSRIGRKTNENNQLKGFVDNKLDVSEFIINGNNDEVLLFGNDLDKTTNTGKDTASTNDRYDIKSFKDLVECSIGLLAREVPEEVVNVVIATGMPSNEIGTDKQAKFEKLLNKSRLIEIDGIAKTINVKGVKIVAQPMGTLLDLNMENGKVFKAFTEGKYSVLDFGSGTTIIDTYQNMKRVEEESFVINKGTIDFYKRIASHVSKKSEGASITPRMIEKGLEYKQCKLNQKTVIDFKDEFYKEQDSLIEEVMSNFEITVGNINSIDRIIVTGGGANIHFDSLSHYYSDVFEKADDSQFSNVRGYEKLGELLKNKVEQESK

SEQ ID NO: 7517 - protein, 44 aa, Staphylococcus epidermidis
IICGGFIMSNVYVMALDFGNGFVKGKINDEQFVIPCQKYSHAGK

SEQ ID NO: 7518 - protein, 257 aa, Staphylococcus epidermidis
KYTGMERAIMNRLNTNYFDNFYIDWQNNEISENYVEFCQKQINNLSHIVPSLKKEKRKIIDTCCGCGFHSKFLIDKGHHVISFDKSEEMLNFAYKKNGILGKRQSLDEEFPENHVDLILNLNTSIGYKKNDLKNLLRNSYTSLKKGGILIIDLMNPAFFYKNFEEQMIFNFKDYEVNQTIKINKIYNSIVSTWDVYKNNEYSKDLSRELKFKLYTTNDIICSSLYYNFTLSNISFYGDMKGNEFHENSPRLIVKITK

SEQ ID NO: 7519 - protein, 209 aa, Staphylococcus epidermidis
YRRGFLGNLDFDHEGYRKLLPLKDFKHFIKHSDSKTRNHFIGMAFNNKTDVFSRNFSNKMINIFPKNEFYIHIQQFPENDSPSYMVYNTDITAFIQFRLVGRSENKYLENIIRDYGVLIEVEALHSFKKGMGAMLVSQLEKLSDKLFIPIYLYDTNLKDELYYQDLGFFDTTKKGNHGEPLLVYKPKNLETNKKEKPIKSLFKKVFNIN

SEQ ID NO: 7520 - protein, 669 aa, Staphylococcus epidermidis
GDFIMAMYHFQNKFVSKANGQSATAKSAYNSASRIKDFKENEFKDYSNKQCDYSEILLPNNADDKFKDREYLWNKVHDVENRKNSQVAREIIIGLPNEFDPNSNIELAKEFAESLSNEGMIVDLNIHKINEENPHAHLLCTLRGLDKNNEFEPKRKGNDYIRDWNTKEKHNEWRKRWENVQNKHLEKNGFSVRVSADSYKNQNIDLEPTKKEGWKARKFEDETGKKSSISKHNESIKKRNQQKIDKMFNEVDDMKSHKLNAFSYMNKSDSTTLKNMAKDLKIYVTPINMYKENERLYDLKQKTSLITDDEDRLNKIEDIEDRQKKLESINEVFEKQAGIFFDKNYPDQSLNYSDDEKIFITRTILNDRDVLPANNELEDIVKEKRIKEAQISLNTVLGNRDISLESIEKESNFFADKLSNILEKNNLSFDDVLENKHEGMEDSLKIDYYTNKLEVFRNAENILEDYYDVQIKELFTDDEDYKAFNEVTDIKEKQQLIDFKTYHGTENTIEMLETGNFIPKYSDEDRKYITEQVKLLQEKEFKPNKNQHDKFVFGAIQKKLLSEYDFDYSDNNDLKHLYQESNEVGDEISKDNIEEFYEGNDILVDKETYNNYNRKQQAYGLINAGLDSMIFNFNEIFRERMPKYINHQYKGKNHSKQRHELKNKRGMHL

SEQ ID NO: 7521 - protein, 40 aa, Staphylococcus epidermidis
TSFMLYMIIKVITTIILVIRTKGVYDYGIFKKEKSRASYK

SEQ ID NO: 7522 - protein, 41 aa, Staphylococcus epidermidis
IFFIIIHSNITSFLCFRVILFNYTIPHLHMTCHDKKVKKVL

SEQ ID NO: 7523 - protein, 55 aa, Staphylococcus epidermidis
ISAINKTSIFFINLIITFSFDRFKFYRYNLVKSRKGALMRTFRSRAKFVKLKINF

SEQ ID NO: 7524 - protein, 324 aa, Staphylococcus epidermidis
LDNITFRKRIEEYRKRSIEQKKYESKLNYQSRFGVKDDEVSTFNIKGIATDKKENKLVMAEDREDKQKVLLYANKDNDMYYLNSGSTYKEAVQNTFGNETNYEMVDDELFIYNSKNQALTNYDQLDEYHNRQKQLQYNTKLEQERKQRLTDTNKVSENAKEDLALSLGLTATALKGNINISNVEKVTDNESMVTIENEINGKSEHLISDFKDSFIEKAKEKLTVSPSMRLGFEEFKNASGQIAMGFTEFFGARYDESTLENDPKVVATEKGYSVSVFDKDGNKKDLTSADTFEEAVKLSKEMKHDNSLSRSEIELNQELEKKKI

SEQ ID NO: 7525 - protein, 46 aa, Staphylococcus epidermidis
KEGIYAFFFYTILFISAYLFYFSTHGAVYCDSYLCTDDLYTSAYVL

SEQ ID NO: 7526 - protein, 377 aa, Staphylococcus epidermidis
YSIMTTIVLLKSYLIKKKLYLKMMLKTLCYLLKVKKIKNNTMSKYKKIKSNIDKNKDNNTVYGSITDQYGNNLITIKKNGKTFFFIDKLEFKPKLTSVYVKEFNNTGIYKYQQENAKKVIAESNQTTELGKFFIGKYSIKTDKTIEDSIHNGTLTGKIDIDLSNRGNNNKIYADEDFNQSWFKVKLNNDSLLEKNSYKLLIDDKDVDYNSKKTYGKYYNPTELSVYAIGKLEGKEFKTNRINIRRNYDNKPQNLKLSFKESQIRDYESKSKKVKEKAKSYIKEYTKELNKAYKKKDYKYISDYVKNNSQLEKQLKKQVKSKSKVKFKDVKINNVKRDKNKIYIELSKTNNGNVFQTKYTLDYDNVSNEFLVEDSHDN

SEQ ID NO: 7527 - protein, 705 aa, Staphylococcus epidermidis
KEVILMNTLILCEKPSQAMDLSTVFAKKKKQNGYMEISDEQLNVSGFLTWAVGHLVELKEPQEYDEKYKNFSTYPILLEKDDFQFKVSDKTKDQFNNIKKIFKENKIDEVIIATDPAREGENIAYKILNQLKVTDKVTIKRLWLTSKVESSIRKAFKNILPKEKTYGFYKEGRARELSDWLVGINLSRHFTKISRELGNDGVIHIGRVSSPTLNMVYNRENNIKGFKGKKFYKVSATINKDEQEVKTELKNKFDSEDELHEFLFENDITDLTQKGLVTDIEKEIGYTMPPKFYDLSALQEDMNDKYKISAKRTLEIAQTLYEKKLITYPRTDSRYITEDEKEMLLENIDYLKEITKINLNNELTNNSLINPSKIEDHYAILITGNDFNKVDLKEEEINVYKSILQNVAMNFMDKEQYETTTIEIAVKKLMFEVKGKIIQDNGFKALLNKQKTSEETIPNFEKNEEVDIELDLLEKETTPPKRYTEKTLLKAMANPIETLEDEGLKSTLKEVKGLGTPATRADIIENLKKNKYIQVQKNKIYITKNGILACLLLEGHLLSKPDLTGQWEKYLNGISKGEKDDDSFINTINEMIKKTINEEVKNKESIQKVAKEKVSTNNIAKCPACDNGYLIDRKGFYGCTEYNNGCEFTIPKKLLEKSIPPTVVKALCESKTTKKLKGFKSKKSGKSFDCKLILTKENKLQFSFD

SEQ ID NO: 7528 - protein, 107 aa, Staphylococcus epidermidis
LIMIKKFSLTTVYVAFLSIVLSNITLGAENPGPKIEQGLQQVQTFLTGLIVAVGICAGVWIVLKKLPGIDDPMVKNEMFRGVGMVLAGVAVGAALVWLVPWVYNLFQ

SEQ ID NO: 7529 - protein, 305 aa, Staphylococcus epidermidis
MDWIKDAIKELTEGIADGMMNFIFQFLYTLFYEPLKFFIWLLDKILIDPNSISSDYISNASVLVNSLITSIAICVFAFKMVQVMKQNAEGNAESPGYYVAQLLPSSLLVAVLPWLVDIMTKLSYSATRAFLDVGQKSYLETIKEWSSLKKGQDGFKEMLGSMGTMAGSQIMFILFILLILVFTVVFIFQFVSRIADLVIMKVVAPLVAVSLLADENNYIGVWWRELLAISIQLPLQVFTFFGGINLFFGAKLDVGTLLLGIGFFIITVKSPSFIRSMVYSTGSGRMATGMAGSGAKLLVRKMLSK

SEQ ID NO: 7530 - protein, 230 aa, Staphylococcus epidermidis
QKGVFCMNYFRYKQFNKDVITVAVGYYLRYALSYRDISEILRERGVNVHHSTVYRWVQEYAPILYQIWKKKHKKAYYKWRIDETYIKIKGKWSYLYRAIDAEGHTLDIWLRKQRDNHSAYAFIKRLIKQFGKPQKVITDQAPSTKVAMVKVIKAFKLKPDCHCTSKYLNNLIEQDHRHIKVRKTRYQSINTAKNTLKGIECIYALYKKNRRSLQIYGFSPCHEISIMLAS

SEQ ID NO: 7531 - protein, 230 aa, Staphylococcus epidermidis
QKGVFCMNYFRYKQFNKDVITVAVGYYLRYALSYRDISEILRERGVNVHHSTVYRWVQEYAPILYQIWKKKHKKAYYKWRIDETYIKIKGKWSYLYRAIDAEGHTLDIWLRKQRDNHSAYAFIKRLIKQFGKPQKVITDQAPSTKVAIAKVIKAFKLKPDCHCTSKYLNNLIEQDHRHIKVRKTRYQSINTAKNTLKGIECIYALYKKNRRSLQIYGFSPCHEIRDMLAS

SEQ ID NO: 7532 - protein, 230 aa, Staphylococcus epidermidis
QKGVFCMNYFRYKQFNKDVITVAVGYYLRYALSYRDISEILRERGVNVHHSTVYRWVQEYAPVLYQIWKKKHKKAYYKWRVDETYIKIKGQWCYLYRAIDADGHTLDIWLRKQRDNHSAYAFIKRLIKQFGKPQKVITDQAPSTKVAMAKVIKAFKLKPDCHCTSKYLNNLIEQDHRHIKVRKTRYQSINTAKNTLKGIECIYALYKKNRRSLQIYGFSPCHEISIMLAS

SEQ ID NO: 7533 - protein, 219 aa, Staphylococcus epidermidis
QKGVFCMNYFRYKQFNKDVITVAVGYYLRYALSYRDISEILRERGVNVHHSTVYRWVQEYAPILYQIWKKKHKKAYYKWRIDETYIKIKGKWSYLYRAIDAEGHTLDIWLRKQRDNHSAYAFIKRLIKQFGKPQKVITDQAPSTKVAIAKVIKAFKLKPDCHCTSKYLNNLIEQDHRHIKVRKTRYQSINTAKNTLKGIECIYALYKKNRRSLQVLLQS

SEQ ID NO: 7534 - protein, 230 aa, Staphylococcus epidermidis; identical to SEQ ID NO: 7531

SEQ ID NO: 7535 - protein, 227 aa, Staphylococcus epidermidis
QKGVCYMNYFRYKQFNKDVITVAVGYYLRYALSYRDISEILRERGVNVHHSTVYRWVQEYAPVLYQIWKKKHKKAYYKWRVDETYIKIKGQWCYLYRAIDADGHTLDIWLRKKRDHQSAYAFIKRLIKQFGKPQMIITDQAPSTKVAMAKIIKVFKLKPNCHCTSKYLNNFIEQDHRHIKVRKTRYQSVNTAKNTLKGIECIYGLYKKTVGLFRSTDFHHATKLVIC

SEQ ID NO: 7536 - protein, 336 aa, Staphylococcus epidermidis
ITILLKLLKYTFKGVFIMSKQFFTVEENYKERFYQLPKVFFTNPNYKDLSNDAKIAYAILRDRLQLSIKNNWIDTEGNIYFIYTVADLEVILNCGNKKITKIKKELENVDLLIQKRQGLNKPNLLYLLKPAITKNDIYEIDKAENEVEALQDKEVSKGHVQKCQKDTSRNVKRTRLEMSKGHTNDTDFIDTDFIDTESNDMNNMNDTNQHSNHSNHFSNIHDKESLKYIELQELPELIKSYINNFSYEEVKSIKSVILKAKKSFNNKYDTFYMLEDIDEELLLVLKRFKGYLVKKQEKVANMEGYLMRSIIAELEEMHSTIMRRKNMENNPLSLFN

SEQ ID NO: 7537 - protein, 47 aa, Staphylococcus epidermidis
ACRFKVHKKYNEKKHHYTNVIPTLYSHYTNCLFQFPIGWNQQALVCC

SEQ ID NO: 7538 - protein, 47 aa, Staphylococcus epidermidis; identical to SEQ ID NO: 7537

SEQ ID NO: 7539 - protein, 52 aa, Staphylococcus epidermidis
YFCNQHSSLSTKQKISGYNESLISKIHYNQIKEGYNEREKYKTQSKLYYFKT

SEQ ID NO: 7540 - protein, 68 aa, Staphylococcus epidermidis
RQILHPLNPHAPTAKRKLFAAFPTLIRFAHIYIEKKRMRKRHNRFTKNRYTKNKLRDAVYASLNLLIK

SEQ ID NO: 7541 - protein, 40 aa, Staphylococcus epidermidis
PKLWRVGWGFHGINPMKVPTQQHTNACWFQPIGNWNKQLV

SEQ ID NO: 7542 - protein, 40 aa, Staphylococcus epidermidis; identical to SEQ ID NO: 7541

SEQ ID NO: 7543 - protein, 166 aa, Staphylococcus epidermidis
FKIRSEKKMKERYGTVYKGSQRLIDEESGEVIEVDKLYRKQTSGNFVKAYIVQLISMLDMIGGKKLKIVNYILDNVHLSNNTMIATTREIAKATGTSLQTVITTLKILEEGNIIKRKTGVLMLNPELLMRGDDQKQKYLLLEFGNFEQEANEKQENALSDYYSFKD

SEQ ID NO: 7544 - protein, 256 aa, Staphylococcus epidermidis
AKFIITKLKRVIMNEKNIKHSQNFITSKHNIDKIMTNIRLNEHDNIFEIGSGKGHFTLELVQRCNFVTAIEIDHKLCKTTENKLVDHDNFQVLNKDILQFKFPKNQSYKIFGNIPYNISTDIIRKIVFDSIADEIYLIVEYGFAKRLLNTKRSLALLLMAEVDISILSMVPREYFHPKPKVNSSLIRLNRKKSRISHKDKQKYNYFVMKWVNKEYKKIFTKNQFNNSLKHAGIDDLNNISFEQFLSLFNSYKLFNK

SEQ ID NO: 7545 - DNA, 15 bp, Artificial
  Description of Artificial Sequence: Synthetic oligonucleotide linker
gtcttcaccacgggg

SEQ ID NO: 7546 - DNA, 11 bp, Artificial
  Description of Artificial Sequence: Synthetic oligonucleotide linker
gtggtgaagac
